United States Patent 7,745,391 (HUMAN THROMBOSPONDIN POLYPEPTIDE) - sequence listing, part 238

SEQ ID NO: 648860 - DNA, 1347 bp, Homo sapiens
  misc_feature (338)..(338): n is a, c, g, or t
gtgacatcgtgtttaaaccctgcttggaagtccctgacgcaccgccgtgatgcccagggaacgacagggcgaccgggaaggtccaattacttccttgaagatcatccaagcgtattggattgattgatctcgcaagagtgttgtgcatcttcgttgtggtaggccaggaccgaaatgtcgtggcgtgccataagcatgaactcgcacgtccaggatcgcgccatgttccttgcagtgtgcgagatggctcgtgggttgctgaatgtgcgcaagacacatcacagttgatgcgtcgaaaggctcgatcccgagagtgccactcggtagggacacaaacnagagcgctcaggcatcctagggatgcacaagctcgcttgagctcgataatccgtggtggagatattagttggggactatttgattgtatcaaccaaattgtgatggtgactcatgcaaactcgaagactcaacggggacgagtagtatgcgtggggctcaaagtaaaaggcgtttgcaccatggcattgcatttgcactctcggttggccttggggtagcacggatatggtgcacccctatggctttgaacacgcgttgacgtacgtaagcctacagaggctcccaatgaaaacctaccttcgggttccgtcacgtggagccacgaggaagcaagaaggaaccctgtccccatgtctatgcacctatggcgccattataacgtggttgagttcatatcgcgaagctgaccaagagagttcttacccaagtgcgggggtcacccccagtttaggccgaaaatttcccctggggttagttttcacggaaccctaatcgaggccatggggtattactaagcaatagtcccttgtgtcaccaggctgtgcacttttggaacttacttacgggcgaaggcaatgggccaacaatcttcctttgaccgattattccatacgggcttaatatcccttggggacaaaagaggggtttgttcaccccggtcgaaataggttttggccccgaagttagggtgccttggatcctttgcacggcggccatttcggggtcgttaaccccacaagaaacgttgggttttggtgtacaacttcccaaaggattataggcaccacgaagatgtacctttatctacaaatatccgaaaaaccggggatggttaaccgaaaaactcgtgaaggattcccctttacgcccgcatttttgagattccttggactggcgcaacgaacgcggcgtcaactttatacacaagcgacagtttatggcccaccaataggcttattgggtcacattgggacacacacaaggggattcccagtgggggatcacgtt

SEQ ID NO: 648861 - DNA, 1150 bp, Homo sapiens
ggcaggattcgggcacatacctgtacttctgctccagagatgtgcgactcccacaaatcccctgtagtacaacctctctggaccatgcatgatcagaaacacacatgcgatcagagatgagcgagtgcacatcaccaccatcatgtggagacatccagacttgagggaggataggatgaccttatacactatgacaaaatcatcccatgccatcactcatccagaaaacatgcataccatgcatggcactctcatgccattattatatgcaggacagagacacagaaaacaagacaataggccacagtaggtatgaggggcactgcatggcaaccagacagtgacatgaaccatcagcaacagacacacacagacgtcaatccaccacaaggacaccataaaacacaaaaacataaactagaccacactgcacacaagagaagacacagagaacaacacggcaacaacaaagagaaacaacaaacaaaaacaaagcagaaagaggcaaaagaaataacacatacaagaaaggaacaaccacaataacaaatcccagaagacatacacataaaacaaacaaacaaacagcaccgacacagacaggaaatacgcaaataacaccggaaaaaaaagacaaaacaaacccacaacacaacaacaaacacgcagaagagaacacatagacagaaaccaactacacacaaacacaaaagaaacacagaggagcagagacacacacagaacacacaaggcaagacaaagaacaagaagaaagacacatacataacaaacaggacacaactcggacagacacaagatccagagcgaacagaccgagactcacccacacaacaaaaacagaaccaacactgaaacacagaaccacaacgacccggcacagaaacagacacaacagcacaacagagagagcacacaacggcacacacaccaccaacaccagacacacaacacacaaccgaaagaaagagaacaacaaacagcacacggagagagaacgaagcagagacaagaacagaaagcagagcaaacacaagacacacgaagaaccaaaacgacgcgaaacacgcaacgaccgcacggaacaagacgaacgaaaaaaaaaaacgaaacacagaacgccccaagaaaa

SEQ ID NO: 648862 - DNA, 224 bp, Homo sapiens
gttcgactcgaggtactagcaggatcctctatagatcgagcaggctccatctataacgatattatggagtgtcagcacggtactcacgtgtcgacggaacttgtacagggaaggcatgcaccgacagtgatagaatacacgatcgaccatggctccagtcttaacgagtatttggaggtcagtcacgagtgctcacgatgatcgacaggagacttgtccaggga

SEQ ID NO: 648863 - DNA, 196 bp, Homo sapiens
tcgacttctagagcgatcccccattggtccgagaggaaattacggagggcctgaagtccaggaatgtatttcacatagcctgccaaaaaaactttaaggctaaaaacaaagcataaccagttaccactaatcttaagaagataacattatgaatgaggaaaaagttaacagtagtaaattagagcttttgtaatat

SEQ ID NO: 648864 - DNA, 1141 bp, Homo sapiens
gacgggtttggtcccccaaaggtcttgtcgaaatatttgccccccaaattagtatttttccaactgtgaagtttttaaaggagggggctcataccgcccccccacgagcgtttttgccagacaccaactgtttttttcctccggcggggaaaaattcggtaatagatcccccccccgcggtggcttgttaaccacgattgtagacttctttgtccgtgggttttttacacccagaaaaggggcccaacaggccccctccttttggggggtataacataacttttgggcgtgggccacaaaaagggtgccgcacaaaattagtcctttccccaaaaaggcgtttttcacaaaagttatgaataaataaatagtaatattttattatgggtgcaaattttatctggcgcccctcttttgggagatagtaacaccacagggggatcccacaaaagtgtttccctcgtttttgcacccctctttattattgactgtgaatttgttttcgctcagtagaacgcgttcttttgcttaaatattgtgaaagacaaaattatataacacagaataccacccacggttgaaaaaagttttattaaaaaaaatcaccccactccacccgagatatttggggtgtgtggggcgtggtatatatcacaagagtcgctatattaaatataatcgtggagatcggggaatatacccacaatttcaccacacgccacaatataattaaggagatcttaatgccacaaattgtgttataacactatggtataagttgggcgcgcacacattatagaaaataataataatagaaataataataatttttcacacccacgcacattttaactacacttgttaccccttccccccacatgcctgagaattatattttgtttgtgtgagatatttgatacacacgaaatttttatatgagctttttaataaatgtggagtttcctatttttaaacccacatgcacgcttcactcacaatttttaaaacacataatcagagaaaagtagagaattaataatctaaatttaatacccaaataaatttaacctaatttaaaccagcagaaaagtgcttagaaagttattgtgttgccttagcacttctttcctctcccattgta

SEQ ID NO: 648865 - DNA, 403 bp, Homo sapiens
gtgcctacaggagcggcagctgccttcctgtttggtgaatgggtacgtggggtgattgattcttagtctgtttgtgctattgtaacaaaatacctcagactggatgatatggtttggctgtgtccccacccaaatctcatcctgaattgtagctccctcaattcccacattttgtggcaaggacccagtgggaggtcattgaatcacgggggcggctctttcccgtgctgttcttgtgatagtgaataagtctcacaagatcttatggttataaaaatgggaggtctcctgcacagcctctctctctctttgccggcttaaccacaggccaccatggccaccagaaaggaactggaagatatgatagaaaatctagagccccatattgatgatccagatggta

SEQ ID NO: 648866 - DNA, 827 bp, Homo sapiens
tacacatcttgtaattaccttttttgttgttgtgtagcaagcatttgtaacacatgtccaaataattccacagtcctgaagcatgaatcgaatccctttctcactttggaaggtgacttttcaccttaatgcatattcccctctccatagaggagaggaaaaggtgtaggccgtgtcctttaccgagagccaaacagaggccagggagactccgctgtgggaaacctcattgttctgtacaaagtattagctaaaccagaaggggtgatgccaggaggagttagccataacaataacaaaaacaaaaaatgtggctgtctcaatgttttcagcttctaatggatatcttggagataatgtgatttctatatggtaatcttctttcattagaagtgaccaaacttaagatggtaagacctctgagaccaaaatttggtcccatctctacccctcaaatgcttagagaatggatcagtgtccccctgtatgttgaggtgaccacttaattgctttcctggcctcgcttgggagactagaacggaacagaagactgtgtttgggccaactgatttagccatgtggaaactcatgctcatttaccctttttcttgggtgttgaagcctggtgtctctagaagtggcatcttcaatgtgctttggatcagtccagtgcgggcacatcttgaatagcttttgtacaaagactttttcacatttatatactttctgaccctttgctttgggtttgtgcacccggggccccattggtgtgaaactctaggccggggggggtggggccctaaagtcttccaaccacccttttgggg

SEQ ID NO: 648867 - DNA, 297 bp, Homo sapiens
gacgctgtggtgcagggggggctgggcactggggagcggctctgaacgggagtggcagcagctgacccccttagatttggaaatagtgccaaggaaaaaaaaggactctgaaactctggcataaaatacacataaagtatctcaaatcaggtttgagcggtggcagtgcagcaggtgaggtggggccggcctagagcccctcaggacaagcccctgggtcccgtctcagggcgggggcacgcagcagggtgcagggtcacagcctggttccagctcgagtctcctccctgagggagg

SEQ ID NO: 648868 - DNA, 806 bp, Homo sapiens
ggaggcgttggtgcgaggaggcgccgccatcttgcgggctgctgggactccgctgtcggttggcgacttccctggacgtaggtaagtgtgttgaggccgggttgctgaggccttgcttcgtcttcacgtttgaccacatctaggccacgatgccggcgagtaccagacctgggaggagttcagccgctgctgccagagaagctttacctcgcgtggaaccctatgaaggcgaggtgtggttctcaggatataggacattctgatgggaactgtgtgtgtggaaagtaacacgattgatcttagttatgtgtggtggtataaatagacgaatcaaagcgtcaatgaatgtagaaggaatcgacttgaggaagagttcgcacaggatcaagcttatagtgctgacttgtatggtaagccaagggtacagcccgcacatgattgacgcatggcataacgtgaggtgaattgggtttgagaatgaaaagaactcttcgtacgtggtagcttgaggaacgtaagatatactgtggagaaagtgaagaagaatagtggtcggggacagaaaggtacgtgttatggtaacttagagtgtggcatggttcagaaagctttaagagagtgcattgtatatgtaaagtgtgtcttattgaaactgtaccttttagaagaaggctaagggaatgcagattgtttacaaggttagaaaagccgttaatttgacctattgggaaaattgaaccagagaatgcattctgtcgttcaaaactggagattactatgatggtaggttaaaaatggttaatggg

SEQ ID NO: 648869 - DNA, 453 bp, Homo sapiens
  misc_feature (7)..(7): n is a, c, g, or t
  misc_feature (213)..(213): n is a, c, g, or t
gcagtancatttggccataagcggtggctcacacctgtaatcccagcactttgggatggcctaggtgggtggatcacgaggtcaggagctcaagaacaacctgaccaacagggtgaaacctcatctccactaaaaataaaaaattaaaaattacccggcatagttgcatgtgcctgtcatcccagctcctcgggaggctgaggtaggagaatngcttgaacccggaaggcggaggttgcagtgagccgagatcacgccattgcaccactgctttagagcatttgtgcattcagcagtttctttattgttgtgaagcaggttctttcaccaatggtgactcactgaatgctcacataactccatgaaatgattggctttagccccattttacagatgaggcagccaaagcctggagaggttatatgtgaaaggataacacaggaagtgctagga

SEQ ID NO: 648870 - DNA, 317 bp, Homo sapiens
gtggagggagatgagcccggcctcagtttttttcccaaccccttttcctttggcctgggaccgcgaaattttccctttaacccaaggcccggcctttttcccccccccctttttcggggggcctttggttacctccctccccccccccccggcccccggttttaaatattggtggggggaaggggaaaggggtgggccccccccctcccccccatttaaagggcccccctttttggggccccccccttaaaggggtgccggcgtggggggggccccaactttttttttttttgggccataaagctgttttgccccca

SEQ ID NO: 648871 - DNA, 404 bp, Homo sapiens
gccaagtataccagaccttgctcacctacagtagacgattagtagggcgcggatatagctggacgaggtggtgactgtagctcagtgacactgcgtggaacgcggcgcttgcagaggtgagagagcagcgcaaccgtactgtgtgaccttctgggcgtacccaggccccagatggtagccccagactggtgcctgctaagaagccagtcctggagcccatacctacacccctgccaggtgaggatgtcttgtccctgagggaggccggtgtggacaaggcctcgcaacagtggtacctccagctgttgaaggggtcgcgctggcccttggaggctggcactaggctgacagctttccctctctgcacctgcgctctggtgacttggggtggacgcctctgcctt

SEQ ID NO: 648872 - DNA, 633 bp, Homo sapiens
  misc_feature (26)..(26): n is a, c, g, or t
  misc_feature (73)..(74): n is a, c, g, or t
  misc_feature (81)..(81): n is a, c, g, or t
  misc_feature (95)..(95): n is a, c, g, or t
  misc_feature (118)..(118): n is a, c, g, or t
  misc_feature (123)..(123): n is a, c, g, or t
  misc_feature (136)..(136): n is a, c, g, or t
  misc_feature (145)..(145): n is a, c, g, or t
  misc_feature (148)..(148): n is a, c, g, or t
  misc_feature (154)..(154): n is a, c, g, or t
  misc_feature (157)..(158): n is a, c, g, or t
  misc_feature (164)..(164): n is a, c, g, or t
  misc_feature (191)..(191): n is a, c, g, or t
  misc_feature (217)..(218): n is a, c, g, or t
  misc_feature (222)..(223): n is a, c, g, or t
  misc_feature (227)..(227): n is a, c, g, or t
  misc_feature (233)..(233): n is a, c, g, or t
  misc_feature (237)..(237): n is a, c, g, or t
  misc_feature (249)..(249): n is a, c, g, or t
  misc_feature (252)..(252): n is a, c, g, or t
  misc_feature (259)..(259): n is a, c, g, or t
  misc_feature (265)..(265): n is a, c, g, or t
  misc_feature (270)..(270): n is a, c, g, or t
  misc_feature (274)..(274): n is a, c, g, or t
  misc_feature (280)..(281): n is a, c, g, or t
  misc_feature (289)..(289): n is a, c, g, or t
  misc_feature (307)..(307): n is a, c, g, or t
  misc_feature (383)..(383): n is a, c, g, or t
  misc_feature (403)..(403): n is a, c, g, or t
  misc_feature (479)..(479): n is a, c, g, or t
  misc_feature (539)..(539): n is a, c, g, or t
  misc_feature (547)..(547): n is a, c, g, or t
  misc_feature (558)..(558): n is a, c, g, or t
  misc_feature (589)..(589): n is a, c, g, or t
gggaggtgcgtcgttggggggggggngggctgggtgtgcacgagatgggaccttttccttgggtccaccaggnnggggggngcccctaggtaccnggctcctcatcacagcggcagcnctctnggttccacatttngtttttttnttntttttnttnntttttngtccggagcctctggacctcggcagcnagctcctccacctggtggcaggtttnntggnnggtncacgcntgcngctgttgcagcntcntattttnctcctncggcntgtngacagnnggcttctncaggctccagggtaggtntcggcaccaggctcctggcttggctggcgggccctggcagggctctcgggtggtgggaaggcggttcggtaaggtnctcaggaggaaggtcccttnccggctgggaacctcaaccggtggcggctcgggcccccggccgcaatcgacgtggtcccccgggccgtcaacctcntccccccacgtgggaaaccgtgggggtgggggaggaatccccaatggggggcaacaatcncaaaggtngggggcatccntccggggggtccccctggtcaatctcaatcnggggaacatgggggtgggtggttggtaggggggggccacggggg

SEQ ID NO: 648873 - DNA, 1989 bp, Homo sapiens
gatcgcatgtgtctgctagcgaggcgtactgctggtcggctgagggtgatatcttgtctgccaatatctgctgtcttccactgagttagccaagaccaaagagcagtgatgcatagtccttgactggcgtagaggatgcatctgctgaacaggcggtgcccagtatcctcatgcatgatctcgtctgggccttctcgtcctcgaatgctgcagcattgtgcgcagcgggacacagttcggacggcttccagatttgacgtggaaccatatcacccatcctgggtaacattacctttgccttccaccatcgcgagcacgcagtgggacatagacaaatcggtagcagcgcaaatcacacggtgggcgctggcgcctcatcgttaccctcacggcagactgtgctcagcgcatagtcgaccccagtcgcgaacgtccggtcgcggagcgacatgcgtagttgcagcccacgctgcgagcgcgagtgggagacaaggagcgacgcacaggccatcgagagaagcgtacccaggccagcgtgcaccgatactctgtccccacgcgtcaggccagcggtcctagcccccagggcacagcggcagacagctcacacgagcaatgcgagagaggcagacgtagctcgcgctcagaggggcgagcaatgccacacatcggatagaggctattggcgcagacagcgtacacccttgtagcaacgcacaagattgcaacctaataagccgacagccgattggagccaatctgcgggccccgtcgctatcgccaaaggcacacgacaaacaattccgaacaagcaatcccaccaacaatatatgcaaccccacagaggggagtacacaccactatgggggcatggaagccttcaccactagacccccattggggagagcatcgccggtgcagcatgccaactccctcacatagcaacacacaagatgggcacacgacagtaaccatagatatggtccggagccgcaacaatacccatggcatggagacagatcccgtagcatggttacccatattccatcaagcagaagagtgcggcctcagcacccctggcattgagtcatcgctagcagctatgaccactctgcgcaacagaaatcaaggactgagcccactggtcacagtcgtacaacgaacgacattcccacaggcgagacaggacagaccacccagatagatacaccattcagcaatacacaggatccacagaccacagctagcaaagagaagcgagacagccaaaagttagaagagcaagcaaccctatcccagcaagagggccagccacacagaggcagcacgctaagaccattagaaacgagcacaaccagtgcagcaattgcttacactccgaaggagacaccacgagccgcatcagcgcaccactgagacgagcgtatacaccaacagtgcacacaagcgagcacacatcaccagtagtaaggtcccctaccacggaagccacgcccacacgaagggccacaacacaatacaccgcaacacgcaaccaccaaaccgcgctcacccacagcccgagccacagccacacacaatccatcaaccagagacacacgagaagtcccacaacctcaaacaagacatgtagccaccacaacacagtgccacgtccacagcacacgaagacaacagaccagagacacaacagaaaggtagccaccgaagactccagggccacacacaagaccacccaagaccacagccacaccaacagaccgcaagaaccagcgagagaaaagcgaagcgcacagcaagagcagagcagcagcacaccaggccacagcaacgccaaacagaaccaacaagagcactacaagcagaaaacacgtggaaagaacatcgagacaaccacacagacccagaagcagaagtcagcgcgaggacagccgcaacaactacgacacaagacaccgcacccacaccccaaccccacaacctaataca

SEQ ID NO: 648874 - DNA, 750 bp, Homo sapiens
aacatcggctaggtacgaggccgggtggttcacataagaagtgcctttcgcctcctgtcgtgattctgaggcctccccagccatgtggaactgtaagtcctattaaacctctttttcttcccagattcttgagtatgtctttatcaacagacatgaaaatggactaatacagtaaattggtaccagtagagtgggttgttgctgaaaagatacccaaaaatttggaagcgactttggaactgggtaacaggcagagactggaacagtctgaagggctcagaagaagacacaaaacatgtggaaacgtttggaacttcctagagacttattgaatggctttgcccaaaatgctgatagcaatatggacaataaaatccaggctgaggtggcctcaggtagagatgtggaacttttttggaactggagaaaaggtgactcttgttttgttttagcaaagagactcatggcattttgcccctgccccagagatttgtggaactttgaacttgagagagatgatttagggtatctggtaaaagaaatgtcaaagcaacaaagcattcaagaggtgacttgggtaactgtctacagggattcagtctttaaagggaaacagaccttaagagttcagaaaatttgcagcctgactatgtgatagaaaagaaaaaccatttctggggagaaattcaaggcagctgcgaattgctaagtgtaagggcctatgtaatccagaccctggaaatgttccgg

SEQ ID NO: 648875 - DNA, 164 bp, Homo sapiens
atgtaccccataaacatagacacctactatgtacccataaaaattaaaaattaaaataaaaaaagagctgctcttagataaaagcaaatcttgcactgatgttgacgttttgacgtatataacgcgatatatagtttcagaagttacattatgaaagaaaaggt

SEQ ID NO: 648876 - DNA, 234 bp, Homo sapiens
cgatctcagctcactgcaactcctttcccaggatcatgcaattctcctgcctcagcctcccaagtagctggaattacaggcgcccaccaccaaaaccagctaattttgtatttttagtagagacgggatttcaccatgttcggccaggctgtgtctcaacactccttgctcttgtggtgaccatgcccacctacagcctcccaagagtgctcgggattacacgacatgacgcca

SEQ ID NO: 648877 - DNA, 329 bp, Homo sapiens
actctcgtgctgcagccatctcagcctcccaaaggtgctgcgattacaggcatgatccattaaacccaggcctttgtttttttgggaaagggattctaattctgtaacccaagccccaagcgtggagttgcaagggcacaatctctgctcaccacaacctcgtgcctccggggttcaagttgattctcccgcctcagcctccctattagcgtggaattacaggctcgtgccaccaggcccagcataattttttggtatgtatagtagagacgagatttacaccatgtgggccaggctggtctcaaacttctgacctcatgatctgccca

SEQ ID NO: 648878 - DNA, 463 bp, Homo sapiens
tctccctattcatttctgattttgttaattaggacactgtccctgtaccctctagttagtttggctaagggtttatctatctcgatgattttctcaaaataaaaccttagtaggttttacacagacagcagctattatgagtgtatgaatgccgtaggcatgtcctaacaaccacacattatttcaaagagctcttccccacctcttacattctctccacttcctcttgctcactgttctccgactcctcgctggaggaagagtaatcagtcactttcttcagatttcaaagggtaccatttgtacaaaaaaaggaaacgtgtgtgctttttatgcatagaacatctctggaaggatttttaaaaactacaaaaagtgatgctattttgggccatggtggagtaatgtggtccctgccttgaaaaaagggaaagggaaaaagggatagggaaaaagtcgacgc

SEQ ID NO: 648879 - DNA, 111 bp, Homo sapiens
tactctctacttcttcatctagaaaggatgatttagactagatcactgttactcaaactttattcattctcaaaccaccttcatggcttttgccacatgcatgcacccagg

SEQ ID NO: 648880 - DNA, 383 bp, Homo sapiens
tctcgaggatctcgcttggatgcggctatttacggttgcgcatagaaatacggacaggctttgctgctgacacagtgtcacacacgcttgctcacagctgtatcctcaggcagacagatgggcctgggatcccgcaggggctcaatgccgtgagtgacagagccatgcagacgaaggtgaacttcttgatgtgggctgccgtgactgtgttgctcgtgctcaccgggtttgtggctgggcgttacttcttgtcgacaagcaggtatacaccagcacggactttccgatcaagccagtccgtagtggcactgtgaccgcacaggggtatgtggcatgtcaaacatcgccactgccgtcgtgatggcatgcagaacatgccacca

SEQ ID NO: 648881 - DNA, 472 bp, Homo sapiens
  misc_feature (463)..(463): n is a, c, g, or t
cattttggagaagttaagtaattgttgaaaaataattcaactggtgagggagtcagacatttcagtaggctgctgtacctcaaaggtttggctggctggcaatcagccttcacatggcaggcatactaattagaaatcagtgtcttgattttcttaaaaagttttggttttgctagcagaaattgtcaattttcccaggcacggtggctcatgcttgtaatcccagcactttgtaggccgaggcaggcaaatcacctgtggtcgggagcttgagaccagcctggccaacatggtgaaaccctgtcttcactaaaaatacaataattagctgggtgtagtagtgggcgcctgtaatcccagctactcaggaggctgaggcaggagaatcgtttgaacccaggaggcagaggttacgtgagctgagattgcgccactgcactccagcctgggtgacagagggaantccgtctca

SEQ ID NO: 648882 - DNA, 147 bp, Homo sapiens
cctagaggatcctgggtgagcaatagacttacttctctgagcctcattttcacatctgtaaaaggaggataataatacctatatctcccagcactattacgttctatagatatagggctattcagattatctacttcttcttttgtt

SEQ ID NO: 648883 - DNA, 308 bp, Homo sapiens
  misc_feature (63)..(63): n is a, c, g, or t
aagaatgcagagaacagaaaataatagagctaaattttttttaatttacaagccacgtatggnggctcacacctgtaatcccagcactttgggagggtgaggtggaagggccatttgaagcgaggagtttgagattagcctgggcagggagaccctgtctctacaaaaaaatttaaaaattagtgggctgtggcggcacgtgcctatagtcccagctacttaggaaactgaggtgggaggattggttgaggcttcaatgagccataattgcaccactgcactgcagcctgggcaacactctcaaaaag

SEQ ID NO: 648884 - DNA, 240 bp, Homo sapiens
cgtgctaggttcagcgattctctgctcagccgtcccaagtagctggggtcacaggtgtgtgccaccacacccagcaaattttggtatttttagtagtgtggcagttttttttaagtgaaaggaagtttattaagaaagtaaaggaataaaagaaaagaaaggctattccataaacagagcagccccgagtgctgctggtggcccatctttatggttctttatagattatatgctaaacac

SEQ ID NO: 648885 - DNA, 383 bp, Homo sapiens
gcgagatgcaggtgtacctgggactgtactggagcttactctggagcacctattttgtgtacacatgggagtgctccactccctatcattgtctgaaggcctcattatgcccagactgctgttgatggtaccattctactgagacactgcctccctggagcccatgcatgcccagatgttcttactgcttaatagccttgagacagctcatttacactgaacctggcaagattgtgggaggctgcgcaacccatgcttgtatgacttactcctgtgcacaacagtgagagcccctttccaggtgcagcatgtgcttcatgggccaccggcagtggctctgtgtctgacagagtaggcttgctcttcctattgcttctacgcgc

SEQ ID NO: 648886 - DNA, 171 bp, Homo sapiens
cgtgtagggatccagacctgtaagcgatcgttgcattactgaactctgtatcagttccacgactgacaccatacctgcaatgatatccaaggcaccacttgaacacacttagagaaacccacaggccagaatgatgtacccatgaaccaggtctttatagccttatctgcg

SEQ ID NO: 648887 - DNA, 869 bp, Homo sapiens
ccgcggtgtgaaaagtgaaacggggctcgaagggacggaggtttttactaaagactttgccggccagggaccaaccagacttggggtcggcaaggacgcgcgaaagaggcgcgcaccaggtattgggtggtcaacaggacagagttgccacgacacagccctgggggctccccgaccccacggcccacactggggcacgacagaggttgtaagaagcagatgtaataccaacagggcaacaagcagcatcccccccaggtcttgggcccaaagagacggaggagacaccaacaccacgccgtggccgtctcaactcgatccctccactgagtgaggccccccggaggagtcgcaaaaactggaaaatgtcgcccccggttggggcacaaccaccaccgggacaagcttgctccagtaagggccgccataaagaatggccgaaatacaagccgccgacaggcaggcccaaggcccgggggccccacaaagacgcacgtagcagccgccagcaaatcgggtgcttttaatagggagtgccacaaaaaattgtctctcccccaccgcccctccgcacagaagagggggctcctctttccatgaataaccgcgatgatatggtggagattatgcctatacataatcgacaatgtaagaagataggtggcaaggagatgcgcacacttacttaagcggagctcaactgtttcagcacggctttgcgagatgcctcccgcacgctgttctgaccagtcgggccccagggctccaattcgcccgtgtctgcacttgtcacgaaccctactagctattgttctccaccaatgggcccccaccattgttcgcagccgaaaagcccccgaccccaaaca

SEQ ID NO: 648888 - DNA, 259 bp, Homo sapiens
aagatgttcgagaggatcaataccggatgtgaataaggaatgtggctaaccctcaattttcatcctgtaccaccccgtccactgacgtgcgtacgggaagttaattgatgaatttatacattggcaattcatgcagttccctgcaccttatttagaaacaaaataagctgtgctcacattctacttgcttggtacacattaagatgtgcaaaaccttccatcagtacgcctgtttgatggttacatgttgaatatctca

SEQ ID NO: 648889 - DNA, 297 bp, Homo sapiens
aggtcttagggagagtacatagctattgaaggattataaagcactttgctaatattaaatgcaccatcaaagctgaataataatcttaatttagggtgaagggttccattagcagagtaaaaataaaaaggacaaagggtagtgttgctttgtaccttgataacagtgtacaaatcaaaagtgctgctattgatcctcattgccctgtgaactctcaacccaggaatttggctcccctccctaactctctaagtacttcccttacccactcagtgtggtgatggcacctccctaaga

SEQ ID NO: 648890 - DNA, 307 bp, Homo sapiens
gcgtcgacaaaatgtcatgaggccaggcacagtgactcaatgcctgtaattcgagcactttaggaggcctaggcggaaagatcacttgagactaggagtttgagaccagcctggggatcatagtgagaccttgtccctacaaaaatttaacaaaattagttgggcatggtggtgcatacctgtagtcccaggtactcaggaggctgaggtgggagtattgcttgagcccggaaggttgaagctgcaataagttatgatcatgccactgcactctagcctgagtgacagactgaaacccgcatctcac

SEQ ID NO: 648891 - DNA, 397 bp, Homo sapiens
agcgccgtactgcgcacagtgctttctgactgcgctgcggaggcacagacgcgtgtagccatgccccaagtccacctgagcctccctgtcactgctgcccaccacctcaaccccgtccttcctccaggcaggctgaatggggaagcggctctcgaaagctgaaatcactatcaccggcttaccatgcttgaccaccagtggctctctcagtttctctgtcacatctggagcaatggcaggggaatactggacggtcagggtggcctcgctctgctggtcaccagctacaaaggtgtacctcccaacttgggtcccctgcacatgcgtgatgaagaggctgtgcacgataccgtattgcttaaagatgactccatactgggtggtgagcttgacgcca

SEQ ID NO: 648892 - DNA, 234 bp, Homo sapiens
gtgatagatggcagcacctgtagatctcagccacgtgggaggttgagatgggaggaagtgacagatcaataggtattagactctcattaaggacagcgcaacctagatccctcacatgcacggttcacaacagggtgcgttctatgagaatctaatgctgctgctgatctgagaaggtggagctcaggcgggaatgtgagacaaggggagtggctgtaaatacagtcgaagctt

SEQ ID NO: 648893 - DNA, 180 bp, Homo sapiens
  misc_feature (121)..(121): n is a, c, g, or t
  misc_feature (124)..(124): n is a, c, g, or t
gccctagaacaatgggaactattacttccatgttagccaaatcttcaggtttctctctctgggtcaagcttcttcctgactggtcaatgcttgagattttactacctgcttgccatttccntgnactacgtgtgtcactatcatacatgtacacaataatggcagaaaatctgagcggca

SEQ ID NO: 648894 - DNA, 301 bp, Homo sapiens
gaacttgggggaagggagcccatcatccgcctgctgatatagtgtctcatggaagaggatgacacccccaatacagaggttcacgcggtcgtcagctgtcagcagcagcaagcggtagaagcgccggttctcctcggtgtactcggagtcaatggactgaagacgcttggaaatgctcccagtggactcatctgcagccaggatacccttgccaggtgacacgatgcggtgagcgatttcagagagctccttcttctgctccggggtcatggctggatatgggtaggtatgatgaatgacg

SEQ ID NO: 648895 - DNA, 317 bp, Homo sapiens
acagactacatcttattccctgcgcataggcaacatgtgatgaaaatatcaacttacctttgggctagatgtatacagattatgcttaaataaccgtggttagaaattattcaatgcatgcttgtcctgccccacgcaatctccctgaatttagctaaaatcaatcaggcacaggcacagtctcaaatattgattaacatatgccatgctactaaacaaggttatctagaatgcacacctcggtgctttaacaacagatagaataaacctcatcaataagcattttcctaaatatcgtcttaaggaggttattggca

SEQ ID NO: 648896 - DNA, 439 bp, Homo sapiens
agaggttatgggtattggtgtctctatccccaggaatagaacttaaggggtgggaagagcaggaaaagaagctggatcacagaagagaggaggttgtgtctcttgctcatagcaagcctgtgggtagaggatagagtgatctggtgtcgaatagcaggatccatgtagattcgcagtatggcctggatgggagtgaagggcattctggtactatgtccctagcccatcatagatgcccctctgctgagtggtagctaggacgcttcgtgtatgaacatttgtcgtccgtcagctctgaatgtactcacttctcttctagaatctagccacgccctcccgccaggcgtggagagaaagggtgctcctcgaggtgctcctgtcatacatcagcccaaacggcaagatagcaacataaatatacaagaattagtcacttata

SEQ ID NO: 648897 - DNA, 879 bp, Homo sapiens
ggataccggcttttaaaagtagaagaaaaaaactacaaatgcatgaatgtacccaactgtgtgtgttttttttttcttgtgtattttccaccttcctacacttccagctgatgttttttttggttggtggttggtggttttttttttttttttttaaaattagaaagaagacaagggtcttgctattgtggctacagggtgggtcttagaatttcttgggcctcaaggggatcctcttcacatgggcctcccaaaggtgttggagattttgccacagcccttaattgttgtttggtaaaggtggcttttctcaaagattggggcaagagtagttttctataagactgggggattaaatttaatcttttctggtctggtaatttctctgggctttcaatggttactttatttggtacaaataaaatttcccaagactttgtatgaatatagttggtggataagtggtcctttgatagtagtcctgctttttaatcttccagctactggttaatcactttcttttggcaaattggcgaaattttttacttgggctatttaaccatggggtttagaaactttccgggtcttagagtccagaaaatgttatcgatgtgtggagaatcatgcttaattccatccagtgtttttttgaaatatttgccttttgaaaaagtgacggtctgtggggagctttatatacacaatgtttgtattgagagacaatcacttgagggtgtccgaactaacactttgtgttaaaaataatttttttagacaaatttgtggtttccagggatatcgaatttgacgtttttgaaaacccgctgtttggggtgcaaaagttctcttggtgggaaaatttaccagttttttgcatgt

SEQ ID NO: 648898 - DNA, 303 bp, Homo sapiens
  misc_feature (205)..(205): n is a, c, g, or t
tattatctcactgtggtaccccggaggagttattcgtaggccaactacaaaacaaaacagcaacaaaagcttgaagtacttcttgcacttaatttcctccttcataaaacagtttcaggccttataagacttctttgacaaagctcacaaccaactgcacataggacagcagggattccacagggaccttctcccactgcaaganctgaactactttgagatgcccagcaactccctggtagaccaaggcctacgaataactcctccgggatccgtgcacgttaacgattactaggactatgc

SEQ ID NO: 648899 - DNA, 150 bp, Homo sapiens
cattcggcctaggcatctctcatggaaaatggcagtattaacggttccagatgtgaggggtcaggcctctgtgcctgtatctctggactctgcctgagggcctggccctcacatctggaaccgtttacatacggcccttttccatgagag

SEQ ID NO: 648900 - DNA, 266 bp, Homo sapiens
ctaaacaacgagtacagagagcatcttagacatgacctgtcatatccaggtgactgtatgacaaaggtaagatagttgatttctgctcttgatagcttaccatttattcaagagcagccaccaattaagcacacagccaagaaacccagagaaggtgatctcgaaacctaagctgagtagaacaggcaaagctgtacaggagagttaacggaagagggaggtatctggattcaagcccgggcaacaagcaagaccctgtctcaaaa

SEQ ID NO: 648901 - DNA, 1091 bp, Homo sapiens
  misc_feature (1091)..(1091): n is a, c, g, or t
ggagagagagagagagagaactagtctcgaggttttttttaattttttttggaaaagcaattttatggaaaaattgggagggaagtcttccatattattttataatagtaaaaatactaaagtggaatgtggctaaaaaaacgccggggctgcagacggacagcggcagcgtctgggccaggaggcttggaggggcccagggatggccacccccacagggagtcagggagggccgtggggcgacagcgaacaaggttaagcgtcgaaaaggtcaaggtgcaaccggggaaagactcatcatgaggggagaggcctcccggtgggaacagtccaccaaaaacgtgtgacacacaacggggaacgggcgagagaggctaccccgtggtacacaacagactaaaaacacccccaaaaagtgcattgtgaaccaaccgttcaataccacaaacaaagcacagtatggaaacacacagtagacacccatacgtgtcccaacggggaataaaccccgtggacccaatccaccacattcctcgtggatccacatcccagggggcccaagcccctccgggagtaacagtcctcgagagacacggagccctaaagagctaggagaggagcaagacatgtaatagccctggacaaacccccccagagaaagcaaggcgtgcgtggcacaagacaatcaaccccaaagacagagggtacagaacatctaggtcagcccacacagcgataaaaacactagaggagcccaagggccaccagaaagagaatagaccaggaatacagcctgagacgaacgacgacacgaggcacacgaggggagcggagcgtagcgcgtggccaccacgaacgtcagacaggggtgcaacccacacttggcgggcaacagcgcaaccctagggccgggggccccaccgacaaatgtgccacacgatatgcggcgccaatcaaggtgggcaaaaaagccgccataacaaacgtgtacccctaaagtaagaatcacgacgatgtgtatcactagaaaggagctagagagggccaacaaccgggagagaaaaaaaccacgggggagccgaaaacacacn

SEQ ID NO: 648902 - DNA, 844 bp, Homo sapiens
  misc_feature (161)..(161): n is a, c, g, or t
  misc_feature (427)..(427): n is a, c, g, or t
cagagctcaaaccggccggggcgaaagaagggggaaaagcaggccaacaattgcgagcaacgtaaggcccccgggagcgcctggtagcgcgatgtagtgaagcaagcgggggaaccgggccaagcaccggacagctggagaaccgcccaccggagttgacnacaacaacgcccgcatagcaccacagttggtagtcctccccagagtggactcgcgcgcgccgtgatccgtctcctcctagcaccctcaacccccgaggagaacataattgggcgcggacgaacaaagcccccgagcgcaggaatagctctcattctgcagcagaaatccccgaacgcgatgagtgacagtgccccctccaaagaatgaggtcattcatgttctgttagacgcccacacgcgagttcggggtgcggcactcaatccncaccaatctacaacagagggagatatgtccccctgcgcatgaacaagggagtgcccgcccccgtaagaagaatctgctccacggatgctaggacacagacacctccattacacaaatgaatggcactgacgcgagacgagacctctcatcttaacagggccactcgacgcatagagagagtagcaacgcaatggaggccccagcgcctcatgcggcttatgcgtaagggcttctccctagaagaatatgcttcgaccgacgtagagaatatcccccgccgaggaaggtgtccccaaacacaatagatcatcattggggtggaagacgcaggagacagtgacgatgtctcagactggtgaggaaggcggcgaaatacaataaaggatcatctaccccgccccacaatgatacagagaa

SEQ ID NO: 648903 - DNA, 445 bp, Homo sapiens
  misc_feature (15)..(15): n is a, c, g, or t
  misc_feature (36)..(36): n is a, c, g, or t
  misc_feature (74)..(74): n is a, c, g, or t
  misc_feature (155)..(155): n is a, c, g, or t
  misc_feature (291)..(291): n is a, c, g, or t
  misc_feature (301)..(302): n is a, c, g, or t
  misc_feature (417)..(417): n is a, c, g, or t
cggcggtaaacatcnaatatggggacgttagtcggntcttacgccagtgtcgcgcgcatgttagatgaaaggtncaagcgtgccctggtccgaaggcgtgctgttaaccttcgacgattttctgtcgggaatcgaaaacttcggcgagcgcattnaaccactgatgcaatgccgcgcccatctacctgcgctgactcaggaggtggcatgatgacgaccttaaccgctcgaccggaagccattaccttcgatccgcagcaaagtgcgctgatcgtggtggatatgcaaaangcttattgcnnacccaggcggctacttagatctcgccgggtttgatgtctcaaccactcgcccggtcattgccaacattcaaaccgccgtgacgcagcgcgagcggcagggatgctgatcatctgnttccgaaatggctgggatgaacagtatg

SEQ ID NO: 648904 - DNA, 963 bp, Homo sapiens
catgagatacagtagttagttgtctgcgcgttctagtagtgatatataagcggagagtttttggcgcccccgtttgttgttgccgccggatataagacgtggtatctaggctctcccaaagaactggcttaaccacaagaggtgtgaccggcgccattcacagaacgtgcggttaagattataactcgccccggccaaacacagtgtttgctggcacaagaaaaaaaggggcttgtcgcccgtgaaaaaaaaccacaaggggaaaaccacagagcagaccttggggaacatcaagtgggcccaagatcacagggagcatcgtgcatgggcagatagaccccagacaacttatttagggagatcgactcttaatcccctccaaagtgccagggacaccagacgccatttatttccacggcggggcagccccgcccccgccgttggctggagtacaacgccagaccgccggtccacgagtgcgtatgatgtggtcaactcccgcatctgttgtacagcgataattttgggcagaacccgtttgtataacgctgaataaggggtgtacattccactcaagcaggttttaaaagacgctgggagtgtggaagtaatgtaaacacacgaacaagacgtggagacatttcttggaaacacctctgcgaaaaagaacgacaagttgacatatgccccttaacaccacgcaccgcgtggccatcatggtatccccttggtccaggaataaagagagttagagacctcgcgctccttcttgtgaaaaatcgggggggacagaccatagcgagtttaccctgggcaaggcggttctggctaatatcccggccccccgagcattaacgaaaagataaaccaccagcgagcatttcgttgtttcagtgaaaagtaacagaagaaaattagaaaactgttctaaaaaaaaaaagttttataaacagccacaaaaca

SEQ ID NO: 648905 - DNA, 824 bp, Homo sapiens
  misc_feature (23)..(23): n is a, c, g, or t
  misc_feature (62)..(62): n is a, c, g, or t
  misc_feature (164)..(164): n is a, c, g, or t
  misc_feature (212)..(214): n is a, c, g, or t
  misc_feature (220)..(220): n is a, c, g, or t
  misc_feature (224)..(224): n is a, c, g, or t
  misc_feature (226)..(226): n is a, c, g, or t
  misc_feature (234)..(234): n is a, c, g, or t
  misc_feature (237)..(237): n is a, c, g, or t
  misc_feature (252)..(252): n is a, c, g, or t
  misc_feature (254)..(254): n is a, c, g, or t
  misc_feature (259)..(259): n is a, c, g, or t
  misc_feature (261)..(261): n is a, c, g, or t
  misc_feature (278)..(278): n is a, c, g, or t
  misc_feature (280)..(280): n is a, c, g, or t
  misc_feature (284)..(284): n is a, c, g, or t
  misc_feature (293)..(293): n is a, c, g, or t
  misc_feature (366)..(366): n is a, c, g, or t
  misc_feature (406)..(406): n is a, c, g, or t
  misc_feature (409)..(409): n is a, c, g, or t
  misc_feature (430)..(430): n is a, c, g, or t
  misc_feature (440)..(440): n is a, c, g, or t
  misc_feature (457)..(457): n is a, c, g, or t
  misc_feature (468)..(468): n is a, c, g, or t
  misc_feature (476)..(476): n is a, c, g, or t
  misc_feature (479)..(480): n is a, c, g, or t
  misc_feature (482)..(484): n is a, c, g, or t
  misc_feature (497)..(497): n is a, c, g, or t
  misc_feature (502)..(503): n is a, c, g, or t
  misc_feature (540)..(540): n is a, c, g, or t
  misc_feature (544)..(544): n is a, c, g, or t
  misc_feature (553)..(553): n is a, c, g, or t
  misc_feature (587)..(587): n is a, c, g, or t
  misc_feature (591)..(591): n is a, c, g, or t
  misc_feature (600)..(602): n is a, c, g, or t
  misc_feature (605)..(605): n is a, c, g, or t
  misc_feature (617)..(617): n is a, c, g, or t
  misc_feature (619)..(619): n is a, c, g, or t
  misc_feature (623)..(624): n is a, c, g, or t
  misc_feature (640)..(640): n is a, c, g, or t
  misc_feature (651)..(651): n is a, c, g, or t
  misc_feature (653)..(653): n is a, c, g, or t
  misc_feature (657)..(657): n is a, c, g, or t
  misc_feature (663)..(663): n is a, c, g, or t
  misc_feature (665)..(665): n is a, c, g, or t
  misc_feature (667)..(667): n is a, c, g, or t
  misc_feature (669)..(669): n is a, c, g, or t
  misc_feature (681)..(681): n is a, c, g, or t
  misc_feature (686)..(686): n is a, c, g, or t
  misc_feature (693)..(693): n is a, c, g, or t
  misc_feature (699)..(699): n is a, c, g, or t
  misc_feature (706)..(706): n is a, c, g, or t
  misc_feature (715)..(715): n is a, c, g, or t
  misc_feature (720)..(720): n is a, c, g, or t
  misc_feature (724)..(724): n is a, c, g, or t
  misc_feature (744)..(744): n is a, c, g, or t
  misc_feature (747)..(749): n is a, c, g, or t
  misc_feature (752)..(752): n is a, c, g, or t
  misc_feature (812)..(812): n is a, c, g, or t
ttccaggggcttgcatgtctcgncccaacctggtcggggagttcactttcagaagctcaggnatggaccttccccagccccaccagcaaatcatctctccctgcttccaggagggtacttactctccaactagtgggctttatgggccaggaaggatgataggnaggggtgtgtggggtagtaggtccctccaaactgagaaatacgaaagnnnaaatgnccangnttctatcnttntatgattgttttatngntgccncnctgtgagactgaggggnancggngaaaggggnggggagtgttacaacccttatggccacttctaggttgtgcagactgccactcttgttactacgatggactgtnagatcagcaggtggcccaggagggcttgcttgatgcgggntgntttttccttttgcctccgtgncatgcctgtnaggtagttggtacttantggaatcccantgcatgcntgnngnnncaggcacagagangcccnntgactttcccaaggtcacacagcctgaaagggaaagncggntgttccagntgttttccttctaacacccttgggcctgcctccngctngatgctgcnnntcngtcctctcttgngngtcnncgccccggcgctatgngctggtcgtcncnggtngtgtgncncngngttggggctcgngcggntcttgcntttccnggtgccntcttccccncagtncccngtgggcccttgcgttcctgnttnnnttnctccggctctgtctctctgttcctgccccttgctctgtgccctggcctctctggcccccnttccgtccgtgc

SEQ ID NO: 648906 - DNA, 372 bp, Homo sapiens
ggcgggagtgctatgaggatgaagatgccagagtcggtctccaagagggagtggaaataattggtcctagttgctctgtgagattcaatcaacaaagtgctgtcctcggggaacacactagctaggaacccaacatatagctcttcttttggagggcagcatagaggggctttgggccctgggacccagtacgctgtggttaggtcacagagagctgggtccagctaactcccctgcttcttctccagcaccacttcaacctccttcaagccccggcggtcagagaacagctaccaagatgccttttcccgccgccacttctctgcatcttcagcctccacaaccgcctccacggccatcgccgccaccact

SEQ ID NO: 648907 - DNA, 128 bp, Homo sapiens
gtccaggctgcagtgaaccgtgatcgtgcccctgcactccagcctgagtgacataatgagacccccattacaaaaaaaaaaccaaacgggccaggattggtagctaaggcttgtaatccaagccgggc

SEQ ID NO: 648908 - DNA, 772 bp, Homo sapiens
  misc_feature (36)..(36): n is a, c, g, or t
  misc_feature (64)..(64): n is a, c, g, or t
  misc_feature (67)..(67): n is a, c, g, or t
  misc_feature (92)..(92): n is a, c, g, or t
  misc_feature (133)..(133): n is a, c, g, or t
  misc_feature (140)..(141): n is a, c, g, or t
  misc_feature (147)..(147): n is a, c, g, or t
  misc_feature (149)..(149): n is a, c, g, or t
  misc_feature (172)..(172): n is a, c, g, or t
  misc_feature (204)..(204): n is a, c, g, or t
  misc_feature (245)..(245): n is a, c, g, or t
  misc_feature (255)..(255): n is a, c, g, or t
  misc_feature (283)..(283): n is a, c, g, or t
  misc_feature (295)..(295): n is a, c, g, or t
  misc_feature (301)..(301): n is a, c, g, or t
  misc_feature (307)..(308): n is a, c, g, or t
  misc_feature (312)..(313): n is a, c, g, or t
  misc_feature (315)..(315): n is a, c, g, or t
  misc_feature (330)..(330): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (376)..(377): n is a, c, g, or t
  misc_feature (379)..(380): n is a, c, g, or t
  misc_feature (414)..(414): n is a, c, g, or t
  misc_feature (480)..(481): n is a, c, g, or t
  misc_feature (487)..(487): n is a, c, g, or t
  misc_feature (489)..(489): n is a, c, g, or t
  misc_feature (496)..(496): n is a, c, g, or t
  misc_feature (499)..(499): n is a, c, g, or t
  misc_feature (502)..(502): n is a, c, g, or t
  misc_feature (505)..(505): n is a, c, g, or t
  misc_feature (513)..(513): n is a, c, g, or t
  misc_feature (516)..(516): n is a, c, g, or t
  misc_feature (523)..(524): n is a, c, g, or t
  misc_feature (528)..(529): n is a, c, g, or t
  misc_feature (555)..(555): n is a, c, g, or t
  misc_feature (637)..(637): n is a, c, g, or t
  misc_feature (651)..(651): n is a, c, g, or t
  misc_feature (763)..(763): n is a, c, g, or t
ggtacactatacaaaactttgtaaaaaaacagcctnctacgctccgcaattccccccatccccnccnccccccaccatggctgcccccaccnctgagggcctggcagctgctgcgccctcgctttcttgacanttccctnncttctntnctctcttccccaggccaccccancagacatgtttgccaaggcctttcgggtcaantccaacacggccatcaaggggtcggacaggagaaagcttcnagctgatgtnacaactgctttccccacccttggaactnatcaagtctctnacttantacctnnaaannangacctcaacattgtnaagttgtatgctcacaaaggggatgcagtgactgtgtacntnantnntnntaaccccatcctctttgaactggagaaaaatctntatccaacagtgtacacgctgtggtcctatcctgatcttctgccaacctttacaacatggcctctnntgctcnanaaactgntanggngancagatttnatnctccctnnactnntgatgccccctgctggtctccctcangtacacaagggccacctctgtcccatttctttggtggggaacagaccccctgtagccattggagttgcagccatgtccacanctgacatgctcacntcacgcctgaagggaaggggcttctctctgctccacacttaccaggaccacttgtggcggtctggaaacaagtgctctccaccttccattgctccactggccctggattcancagatctca

SEQ ID NO: 648909 - DNA, 423 bp, Homo sapiens
tgcagtgcattgtaaaggtgaaccatacttaaagtggatagtccatgacagaaaaatgttctttcctcttctttttaaaacaaggtcttcctctgttgcccaggctggagtgcagcagcgcagtatacgtcgctgcaatcttgacctccttggctcaaatgatcttcccactgcaacctcctaagcagttgggaatataggcatgtgccaccatgcccagttacttttttatttttattctgtagacacaaggtcttgctgtgatgcttaggctgatctcaaactgggcctcaagcagtcctcccaccttggcctcccaaggtgttcggattatcgtgcccaaacccagatgaattgtcaaaagcatgagttcttaaggaaaggtagctattgtaactgtgaaaccaattttcactgtggcat

SEQ ID NO: 648910 - DNA, 230 bp, Homo sapiens
tgtatggtagactcattgtaataccatttgagcctagaatattctggttttttgagacgtagtcttgtccatattgcccaggccgaagtgcagatgggattacacgcgtgaccaccatgcctggccagaatattcttcatggtaaaatttaaacgctgtaatttccaacagtcttgcagagttatagatctaattagatttcccatttctcctgaagtcaaatttggtta

SEQ ID NO: 648911 - DNA, 312 bp, Homo sapiens
  misc_feature (15)..(15): n is a, c, g, or t
  misc_feature (28)..(28): n is a, c, g, or t
  misc_feature (241)..(241): n is a, c, g, or t
ttgaattcctaagcncaaacaatcttcnagccaagtagcctcccgggtggctgggaccacaggcatgcaccactaagcccagctattttttttttttaatagacagggtttccctatgtcgggaaacctatgtagggtggtctcaaactcttggcctcaagtaatgctcttgcctcagactcccaaggtattgggattataggcgtgagccatcacacttggccttgggtttgaattttanactagaattgtactcttgtggaatttgtatgtaaagtaaacagcaaatattaaaacaccccaatttctttc

SEQ ID NO: 648912 - DNA, 569 bp, Homo sapiens
agcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccaaaaaaaaaaaagagagagactgctttcaaagaggaccaagactacggtgaaattaaaacggttggctgggctgggcatggtgggctcacacctgtaatcccagcacttggggaggccgaggcggttgggatcacctgaggtcagaagttcgagatcagcctgaccgacatagtgggaaccctgtctttactaaaaatacaaaaattagctggggcatggtgggaggcacctggtaatgccagctcctccagaggctgaggcaggagcaatcgttgaacccagtaggtgcgaggttgcagtgagccacagttgcgccattgcactccagcctgggcaatgagtgaaactctgtctcacatacacaacttac

SEQ ID NO: 648913 - DNA, 115 bp, Homo sapiens
tagaggatccttaagggtctggaaaggggcacctctcttgaacccaaatgctctctcttcttatacccaaaccatggctctatttcttcttcacatccattgtctcttcatgtct

SEQ ID NO: 648914 - DNA, 113 bp, Homo sapiens
aagggttctttggccgctaatttttgattttttgaaacacgcggtttgccacattgcccaggctagtcttgaactcctggactcaagccatctgcctattacaggcatgaggc

SEQ ID NO: 648915 - DNA, 250 bp, Homo sapiens
tccgcgtaagcacatgtcttacagtacagaatgttcattctagtctacatctattactttcatccttctacaggaagttacatagccacctgtaggcactttctcatccttagtataccatatattcacattatatgtcttaatcaacactaagacaaaagtaggaaacataggatcatcaattactacatgaattgtaccaattctattcaactaaaccaacactaatcattcgaaaatgtaaagataa

SEQ ID NO: 648916 - DNA, 370 bp, Homo sapiens
  misc_feature (46)..(46): n is a, c, g, or t
  misc_feature (116)..(116): n is a, c, g, or t
  misc_feature (189)..(189): n is a, c, g, or t
  misc_feature (206)..(206): n is a, c, g, or t
  misc_feature (230)..(230): n is a, c, g, or t
  misc_feature (258)..(258): n is a, c, g, or t
  misc_feature (340)..(340): n is a, c, g, or t
  misc_feature (342)..(342): n is a, c, g, or t
  misc_feature (346)..(346): n is a, c, g, or t
acccctggcccaacatggtgaaaccccgtctctactaaaaatacanaaattagcccggtggcgtgggcctgtaatcccagttgctcgggtggctgaagcagaattgcttgagcccngaaggtggaggttgtagtgagccgagatcgcggcagtgcactccagcctgggcaacagagcgagactctgtcnagaaagaaaagaaaganagagagagagagagaaagagaganagagagaaagagagaaagaaagaaaganagaaggaaggaaggaaagaaagaaggaaagaaagaaagaaagaaagaaagaaagaaagaaagaaagaaagagagagagagananaganagagagagagagaaagaaagaaag

SEQ ID NO: 648917 - DNA, 314 bp, Homo sapiens
ctgagattgagccactggactccagcctgggcgagagtgcgagactacggctcaaaaaaaaaaaaaaaaaaagggtaaaatttgaaagttaaaatgactccttgatctgggggctgcaaaagggatttggtgtaagcgggcatgaaaacaacataagtcccctcggacatctccagcagagctctggagtgactaggtgtattaccaatgagcagtaatatttggaagggaatcttttatttcccttttccccctgatccagtagggtctcaacggggggcttaaaattttcagttaacccagtgcggtttaac

SEQ ID NO: 648918 - DNA, 220 bp, Homo sapiens
  misc_feature (46)..(46): n is a, c, g, or t
  misc_feature (53)..(53): n is a, c, g, or t
  misc_feature (77)..(77): n is a, c, g, or t
  misc_feature (162)..(162): n is a, c, g, or t
  misc_feature (185)..(185): n is a, c, g, or t
  misc_feature (200)..(200): n is a, c, g, or t
caccttggcacggggcaaaaaaattggtgctaaaccttcacccctnagcacgntcagtgagactggtcatgcaagcntttacagtgccatgctcctcaagccgattttttcttatagaaatgttgccctatttgttttctccaatgtatggtatgttatatnattttattattttattttatttnattttattttatcgngggggggcacggtacctgcc

SEQ ID NO: 648919 - DNA, 702 bp, Homo sapiens
gctccctcccgtgcgtcgttgtggccttgcccgctcgcccgcgggggactgcgcgcgctccggtccgcggcaggggcggggacgcccggcctgtgggccccgggcccccgatgatagagctgaggctcggcctgggagctgtgagtatacccacagtccccggtagcgtaggatgaatcgcgtgcgcagtgaaccaggtgtgccttcgcgggatccagtgccttaggcccaggaacgccccgacgacagtagtgccgcggggacgcgcggtcggcctggggggtggctgcggacggtcggggccgaggcctctggcgcggagctgctcgcgaatcgcagaagcagtgccgcaatgtcgtcgattcgccattcttactcattgcggggtcgcgaccatgctacccgtgtggctgctggaggatatgccgcgccagggaggccttccactgggacgagcgcgggcgcgccgccgcctactcgccctctgaggcgctgctctacgcgctcgtgcacgagcaccaagcgtacgcgcattacctgctggccacgttccgcggcgcgcgctcgcaccgccagttgccggcttccgctgctgcgcggctcccgggccggcaggtggcgctggcagtgcgctacaaccgctgtgggcaatctgcgcccgatcctgcgcaccttgcgcgaagttcccgtgcgaggagcggg

SEQ ID NO: 648920 - DNA, 448 bp, Homo sapiens
  misc_feature (11)..(11): n is a, c, g, or t
  misc_feature (16)..(16): n is a, c, g, or t
attaagtggtntgttnttttagatggagtttgtgaattatgaatgagtgagagaatatagttagaaagtttgggaatgatagtttgataatgttaaggttttgtattgggttggagtggtttttttttatttgtaggattatgattaggtttgttattattttttggttgttgtgaataggtagtttaaagatgttaatgtttggtggtatttttagttgatatagttagaatttagtagttattatagaaaagagaagtagttttatttgggtatgtttggttaataaagaagaaagatgtttttttagttgaatttaggtggattattaaatatgtatgaaggagaaatttgagttttagtaagagaaattaattttatatttttgatttaggtggatttttgtttttagttttgtataaattttattatttagatagtttgagtt

SEQ ID NO: 648921 - DNA, 130 bp, Homo sapiens
acgaaataggagggtgctcgtagcacagggttgggttcagtatgtttctcctcccgagaagaatccattaaagcagttacataaatgaccggtagacttgtggccacaaagccattgtattttgctttag

SEQ ID NO: 648922 - DNA, 211 bp, Homo sapiens
attcctctaccgagacgttgtctgcaggcactcagatatggtccagacgtttgacataccgacgtaggctttcctacaatacatgctctaacaaacataggctgtaccgaacccctggtaatagaattgtttacctttataccaagaacggttgggaaagcaccaaaatctgcatgtggtgttgtgccctcagtttccggggaatccctct

SEQ ID NO: 648923 - DNA, 754 bp, Homo sapiens
tggctgtagacggcaggagacttctgccccgtggtgcactgcgagcctcgagacgacagcgcgggtactgccagcatgctgaagtgcgcctcccgcggatgcggccccgacggcgccctgctcgcccatgccgatgctgatgctgctggcagcggctgtgcgggatgcttggctgcttgcttggcctgccagcgttggctgctctgcctgtggcctgctggtgtgcccagtgacagccctggctgccctggtagccggcttcgtgtgcactggcactgcccccagaggcgtgtgcactgccggctgccctgctgcccgctgatgcccatgcagggcgtgcgctgcagagtcccgaggaggagctgaggggccgcggtgctgcagctgcgcgagaccggtcgtgcagcagaaggaggacgctgggcgcgcagcgcgaggccatccgcgagctcacgggcaagctagcgcgctgcggaggggcttgcgggcggcaagggcgctgcggggctgggggccacgggcaaaggacactatgggcgacctgcgctgggaccccggcacgtcgtggagcacgctcagccgctcgctgcagaccctcaaggaccgcttgagagcctcgagcaccagctcagagcaaacgtttcaatgctggctgcggggacttcgcgaggtgtcagagcggtggggagctggagagagtcttgcaggtgaaacttgagaccgaaagtcctgtgcaatgaactcggccggggaa

SEQ ID NO: 648924 - DNA, 236 bp, Homo sapiens
ccccccctttttttaaaaaaaaaatattttaaggggggcgggggggggaaaattttttttaacaaccccgggggattttgccccccttgggaagccccctttttttttgtttgggggaaaaaaaagcccccaacccccctggggcctgggggaaaaaggaaaaattttttttttttttgttttttaggggggggggatttatgggttttccccccaaaccccggttttttttttta

SEQ ID NO: 648925 - DNA, 119 bp, Homo sapiens
atagttaatacataaatagcagaaagtataggggttagtccttgctatattatgctatggttataattaatcatcttatccctatgcggtactatatctatatgcgcccaggtttcaat

SEQ ID NO: 648926 - DNA, 126 bp, Homo sapiens
ggacctgtactgtgcctgcgtgaaatgctcctgctagcaatctgcatcatcgggtgccaatgaccacgcatccatccagatgaacgtggcctgaggttgacaaggtcacaggcaggcttcatgacc

SEQ ID NO: 648927 - DNA, 170 bp, Homo sapiens
  misc_feature (159)..(159): n is a, c, g, or t
aacgaaaacggcgatgtgggagaactccttcacgaagtcggcaatctgctccccggtgtccccgtacttcactaaccagtggccggtgctgcaactccatcttctggttgagggaatccacaaaccactcataccccatggaaaattgcaggccatgtncaacgcctccg

SEQ ID NO: 648928 - DNA, 414 bp, Homo sapiens
aaacaccgccctccttgcacagacaaggcaagtgtggttagcaagctcagaaatctctgcacctctgatcacagccttggcttagggccccattccactctgcctttctgtcacctgagtccactaagaaagtcacctgagtccacctggacatattccaccttcctggaactggaatattgttccacataagctcatacgcaagataattgttggaaggctaaaagagaagaaagatttgtgatatcattgatcaaataacaccagatattgtgtgacaggttgcaagtgctgttgagggaagtcagggaccccgaacagaggaaccagctggagccacagcagaggaacataaattgtgaagatttcatggacatttatcagttcccaaataatacttttataatttcaaaa

SEQ ID NO: 648929 - DNA, 1211 bp, Homo sapiens
agcgggagtccactgtcagcgaccgagcgggccgtcgccgccgccatgaaccccgaatatgactacgctgatcaaagctgtttttgattggcgactcaggcgtggcgccagattatgccctgactcgtgccttgggtattgctgagtgatcagcagtatcacagatggagctacatcgaggcaacccatcgggaggatggcacgtggcgataggatcccgtaagaccatcagaggctggtatggcatacagtcttactcaaatcttcagatcgtaggtgacacaagcgggagtccaaggcaactggattccggtagcattccactatcactaatgcgtaccgtaaccgtggagtgcgttcctcgagttgagtcaatcaatccgttggattgttattgaacgattcaagcttgtatctcaggaaagtcccttatcgactcgagaaccgtgtaacagcagttgggtcttgtcaccggtgcaagatttggactcggcttagtggccgaagcctgattaaccgtttctaatcagaagacgtcacgttgcgttggagccacatcaaatgtatggcgacaaccttcacacacacaaggaaatggatgtgtgggaactaaacctattctaaccagcccatacgggaaggtattggcaacagaacttcctcatgagggcgtaataccccggtatctattggggattgaactgacggccggctccattggtaaacatgaccccacctcgaacactggcatcgtaggccatgggcgattccctagttgagccatgatgggcctttgccattgaacaaattcttcaacacatgcaggggactggtgggcggccctttgtgatgacaagccctcctccttgggggagagtctgaagaccggggcctcccagatgttcttccaaatggacttcttgaaccatcgtcgactccccccctttggttcaaaaggtcccccgaggcaatagatccgatagttaggggcagtagggcatagacactaaccgcaggaacgaggggtgacccaccacattgggtaacgcatttgtgggcaaccacggtggaacggctgagcggggcaatcctcatttccattcctcacgcacacttgtacgtatgttccctctatgtgtcaaggcgagcgtgccaatgtgaatgtggttaacctcttgcctcactttccttacgacctctccgttcccatt

SEQ ID NO: 648930 - DNA, 140 bp, Homo sapiens
atgggctcccgagtcaaagctctgctctcggcgttcggaggccagctccgctgcagtggctcttcaggcccatgggctcattcctgacaacggctttccaggccagtttttcccttccggcggccctctccgggcccaga

SEQ ID NO: 648931 - DNA, 123 bp, Homo sapiens
cacccctaaaatggcacatggccaatgtgataatttattgctggctgtttatttatcggcaacatgccgtgttgctgttgcacccgcaatggatgaagacatgtggcatcatgcttcaaccag

SEQ ID NO: 648932 - DNA, 150 bp, Homo sapiens
ttaaatgcccatgcctccataataacctttaagaaatgaataacctttgaagcctcctaaataggcctccaaggaacaaccaaataattccgcttaaatgtttccagtaaaagtagcccgagaccaatacaaaatgttttcccctaaagg

SEQ ID NO: 648933 - DNA, 163 bp, Homo sapiens
acagaagactggactctctatggctctcacaatggctacactctattgacaacatgagtctgtacactttcacagtcccagtacgtcacggccactacagacatccccgatttcatgtactaacgggcgcatagctgacgtactccatacccacacatcttag

SEQ ID NO: 648934 - DNA, 358 bp, Homo sapiens
aggaagagggaagcccattataaaaccatcagatctcctgagaacttccacgtggtcccacccttgacaggtgggaattattacaattcaaagtgagatttgtgtggggacacagagccaaaccacatcaaggaacataactcaaaataatgagagccatgtatataacaaatccacagccaacatcatactgaatgggcaaaagctggaagcattccccttgaaaactggcatgaaaccaggatgccctctctcaccactcgtattcaacatagtattggaagttctggccagggcagtcaggcaagagaaagaaatagagagcacccaaatagaaagagaggaagtcaaactatcc

SEQ ID NO: 648935 - DNA, 770 bp, Homo sapiens
cacaggcccgcagcggcgctataccttcggccacaggtagcgcgttccttcgctatgctgaccgtcgatcccgggggcgctagagcgccggctccggggagggcagggaagcgtcagggacctttcttcttcttttttggtattctttttttggagacgggagtctcgtactggtcgcccatggttgggagtgtagtgggcgcagatctcgggttcactggcaatttccgcctcccgggttcacgccattctcctgcctcagcctcccgagtagctggggactacaggcgcccgcaaccaggcccgggctaattaggggtattttaagtagagacggggtttcaccgtgtgggccaggatggtctcgatcttccgtgacttcgggatccacccaccttcggcctcccaaagtgctgagattacgggcatgagccaccggggcccgggacaagcggtcaaggggaccctttcttagaagccttgctgtggccttgaggtccgggactggggctgtcccggattccggtttctgccatcagtgggggccaaaggcctgaagacggctggtaccgcaaccttgggcgcctcgggtccgggctgcgacgtgggagcgtcctagcctacggaccgggaaccggataggagacgaatagacagggggaaagccctggaacattaggccggcaccacgacagggggacccgttgggcaggtcaggcaaggctgactggccttggggactcgggaaccaggaggcttacgggcgatgc

SEQ ID NO: 648936 - DNA, 208 bp, Homo sapiens
tcggtagcgggaatcgtgttaatatggtattgtgatggcgcaggatcaaagtgaacctttataacaacccaaccaattaaagctaaacatccatttgatcctccatccggtatgcagaagccaactgttgaagatacaagtgatgattcagttactttagcctgggaccccccgtcgatcacaataccatatttaacacggaattccg

SEQ ID NO: 648937 - DNA, 279 bp, Homo sapiens
aagtgtctttcaagaagtaagtatcagcacagaggaagatgaccaaatactgaactcgaactgtatagcttaaccacgtgatctgagaaacacaatcaccaggctcatgaaattatttggaagagactatagaaaggccaagaacccaaaattaaatttcttcctgttaattgcttttttctaatctttgttttagtatttcgtacctgccacttcaagaccatcatcaactttctaagaataaaatacaaagatgcatttcagtcttgtaagaacact

SEQ ID NO: 648938 - DNA, 453 bp, Homo sapiens
  misc_feature (453)..(453): n is a, c, g, or t
gatcgtagcttggaacaggaatgggaggatcttgatccttgaatatgtggcaattttttcatattcgggagcaaactgcttggaaggtccacagcatggagcataaaactccagcagcactgtgtcttggtcaggcacaaaattatcaaagtgtgcatcatttaggaccaagactccattttcttgcttaagttccaagtcgtcttcttcctcatcatcagcttcctcctcctcctcctcttcatcctcaatggcatattctctgtgagaagaatctggatgccttattctctaggaataacaacttttccttaattagcacttcctaatcttcagagttcttatgtctgcagctagctcacttcgaagaaaaatgcagggaccatgaagtagttgttactattcctactggagtacgcgcttcatgggcagggaccacactcacaatctttn

SEQ ID NO: 648939 - DNA, 114 bp, Homo sapiens
attagagctgcaggacccggctcacaagcgccttcttctggacaccctgcagctcagcacgtgatagcggaggcaccacgaagctagtgaactcagaagcccctcgcgctgcta

SEQ ID NO: 648940 - DNA, 172 bp, Homo sapiens
tgggaggatcacatgaagatagacgttcaagaccagcttgggcaacatggcaagaccctgtcgctctctctttctctatatataaaataatcaggcgtggtggtgtacgcctgtgttcccagcttctcaggaggctgaggtgggtgtattcattgagcccaggagtctgaag

SEQ ID NO: 648941 - DNA, 117 bp, Homo sapiens
  misc_feature (82)..(82): n is a, c, g, or t
acatagtggtcaagattcgcagaggtggagtcgagattgcattcagaaggttccggacatctcggctcgttacaaatatcancagctctgcatcttctggaggtcaattacactttg

SEQ ID NO: 648942 - DNA, 431 bp, Homo sapiens
  misc_feature (189)..(189): n is a, c, g, or t
ctttgagaccagcctggccaacatggtgaaaactcatctgtactaaaaaaacaaaaattatgtgggttggtggtgtgcgcctgtaatcccagctacttgggaggctgaggcaggagaatcgcttgaacctgggaggcggaggctacaacgagccgagattgcaccactgcactccagcctgactccgcnctcaaaaaaaaaaaaaaaaaaaaaaaaaggcgtttctgttcaaatagggaaaggatacatccttctttctttctttctttctttctttctttctttctttctttctttcctttctttctttttctttctttctttttctttcctcccttcctttatctctctctctctctttctctctttctttttgagatggaagttcactcttccttgccaagctggagtgcaatggtgcgatctcggct

SEQ ID NO: 648943 - DNA, 171 bp, Homo sapiens
taccagggagcagttgcatcgtgggttatccctcttgtattactgggattaagagggttcagatcccggaatgcctgaaccaactgttttgagcctactttggggataaaggattaattggtcttctggatttggaggcaatcagcggacagcttggaagctgtgtagttg

SEQ ID NO: 648944 - DNA, 261 bp, Homo sapiens
agatccctaacccagaactacaagtgactatatctggtgaatatctacacagataatcatattaatgaaaacaagggatattgatagggtcgggaagacaagagggaaagaactccagatatgcgtgtgtgtgtgtgtgtgtgtgtgtacaccctccgccttctctatagtgtcaggtagcggggttcatacacatacaatcttatggttacttatacaatttttactctcccactctcatttgggtctggtaagggactg

SEQ ID NO: 648945 - DNA, 446 bp, Homo sapiens
cgaaacttcacgtctgaggtatataccagaaggctaatcatatgcgtctaccatatgagctagcaagcttcactctcaggtatacacccaagagaaatgaaaacatgtccacgagaaagatgtgtgcatgaatatcaatagcagcactattcataatgggccaaaaggagaaaagaatccaaatgtccatctgatgaatagatagacacagggtgggctatcctcacaatggaagtattatttggccctgagcaaggaacaacgtgctgatacatactacgacctggataaacactgcaaatattacgctgagtgaaagaaatcagacccaaaaggacacatttgatgattccatttataaaaggtctagaataggccaatctgcagagatagaaagggcccgggttggaggcaatgatatcacgggtaaccgtagacgttgaggg

SEQ ID NO: 648946 - DNA, 683 bp, Homo sapiens
  misc_feature (357)..(357): n is a, c, g, or t
ggaggaacctgtggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacntgcctatttcatgtctgacaccagaaaacagaaaaggctcttgggtgaaggacaccaccctgtccaataaaaccaaatggacaaggcaaggaggcatccacaaagtgcgtggaaagagctggacacaaattatctcaactacggtgaagaatgaccccccaggaagtggcaacatcaaggaaacccacatgacacttatcaaaacatggaggaagcttagtttcaaaataaacatttaactgccaatacacacttatacaaagaacaaaattacggaaccttttaacccatactacaaccctcttcaattgacactccgcttgttt

SEQ ID NO: 648947 - DNA, 620 bp, Homo sapiens
  misc_feature (390)..(390): n is a, c, g, or t
aaactaaaaaattaagaaataagccaacaaaatgtctccaaaaatatctcccaaagtgctgagattacagacgtgagccaccatgcccggccagccttatttttcataaacacacgtagtagggccaggtgactgtcagtccccttctcttccctgtagcagagctagggagcttcgttcagcacaagagggaatggccaggactatagccagtaggaaacagttttcttctaaatcaagttatgccctcaaagagttcatagttgatgcatttctttgcttggatttttctttttaggcccaggcacatctaatttatatttttctgggaggatggaaaatttgattgtgtttcatagaagtggcacccagaaatgctcacaacatgtncctggtgtcgactgccatgcagagatgtttacgagcagtcatctctcctcttccactgccaaacttcaatggtgcccctatgagtccattggtggtacagtttatagcagtgcgctcaggaagtttgcaaacaagttgtaattttagcaattctcattcctcagctttttatgagtccttgggagaacattttttgcttagccaaagtttatttgatattgctgaacatt

SEQ ID NO: 648948 - DNA, 408 bp, Homo sapiens
gatctcgtccccagtctgttcacacatgagatggtggctttgttattgatcactcggtgtaatagtagcacaggagcaaacgtgcttctctattacgtcgtcctgcacccctgtcccccaccttatccgtgcgtggcaaactcatacctgaggacaaatatttctgcacaatataattacatctatcttcaatagaggagtccttataaaggtcccaaaataataataggccaagggcatgaacaaccaattcccagaatccactgtacattgttacaatacacaggttaggtcgggcgcagtggctcttgcctgtgatcccggcactttgggaggcctacacaggaggatcacttgatgccaggacttcgataccatcctgggcaatatagcgagacctcatctcta

SEQ ID NO: 648949 - DNA, 262 bp, Homo sapiens
  misc_feature (158)..(158): n is a, c, g, or t
  misc_feature (191)..(191): n is a, c, g, or t
  misc_feature (202)..(202): n is a, c, g, or t
  misc_feature (234)..(234): n is a, c, g, or t
  misc_feature (247)..(247): n is a, c, g, or t
taccctcgctgacgtgtatcccctgaaccaagaacctcagggcaggggaaagacagcaaggaacatgtgagcccgaggctgcagaaggaagagtcagtgaatggctgcggtgtgacaacatgcaccaccagtggcttctgcgtggccgcatgctttgngggtgattttcatggttcatgggtggctagcanagttcatcacngtggtacctttaagagacccacgatgtgtacnagtgccaaacagngagtttctggttcct

SEQ ID NO: 648950 - DNA, 224 bp, Homo sapiens
catgctgcaacaggaggcgccgattttctggatgacataataccaggtcactgctctcctccagtgattcctgtgcggcgctccttgaggccgagcgaggaagtggctgtgcgtctccagaaggtcgtcagcgcatggcaagaggcggccaatggccttgctagctgaactgcagctcctcctgcagggccctggagtaccaacttcagcatgatcttgagcag

SEQ ID NO: 648951 - DNA, 144 bp, Homo sapiens
agttgactctagagatcccgctcagagtccaggcaaggggggatgtatatcaaggcccgatgtagtccaggtgaagcttgtggcccttcttggtgccctccaggtgcactttgtggcaagaagtggcagtgaagagtcgcaagg

SEQ ID NO: 648952 - DNA, 719 bp, Homo sapiens
gaggaacgcagatggtgcctcatctgaaggcatgagtgccgtagcagtgccctaggaggtcgagctcaaggggttcgaactccagtggtcagacctgctcatatctcagcattttttgaggaacgaactatcccagatatggtgtgggaagatgcacgcacatatacttgtcaccgagccaccattctggctccaaggctgcatcgtctccactggacgtagcgagagggttgtcagtgttttgcatccgtgggtctgcattccgggtgcttatttgaatccttgcgtctgagatgggactattccctggctgtagacctcactcttcatgtgtcactgtggcctttggacaagttgttactgacatatgtacatggggatgccttgcatgaaagctgccaacggagagggcttgtgcacgtttcagctttaacctttggtgggctttgtatctaaattatcacgactgtgggcatctgctaagctgttgccatgctgtgagaagctcttgaccttttggactgtgcatactttgaaggaattgatgtatgcctgcgttgtgcctctgtgtggtcatgccatgaagctcacaactagggactgaagtaacacgatcaggtccagtggtgcacagactgtcttctcttaatcacaagattagtttgcgaattgaatcttgtgagggcaaaggttgagaggaatggtatctacgttgtgag

SEQ ID NO: 648953 - DNA, 657 bp, Homo sapiens
  misc_feature (147)..(148): n is a, c, g, or t
  misc_feature (155)..(155): n is a, c, g, or t
  misc_feature (171)..(171): n is a, c, g, or t
  misc_feature (196)..(196): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (222)..(222): n is a, c, g, or t
  misc_feature (231)..(231): n is a, c, g, or t
  misc_feature (253)..(253): n is a, c, g, or t
  misc_feature (292)..(292): n is a, c, g, or t
  misc_feature (309)..(309): n is a, c, g, or t
  misc_feature (321)..(321): n is a, c, g, or t
  misc_feature (340)..(340): n is a, c, g, or t
  misc_feature (363)..(363): n is a, c, g, or t
  misc_feature (370)..(370): n is a, c, g, or t
  misc_feature (421)..(421): n is a, c, g, or t
  misc_feature (442)..(442): n is a, c, g, or t
  misc_feature (532)..(532): n is a, c, g, or t
agtaagtccgtgaggttaaaaagcatcttacctggagtccataggtatttcggatgagcaaagcagtatgttggccagtatgtgtgtttaccaaaatggccgccacagtgattaaagctcagagacgtataagaactgctggtttcnnctgaagncacatggatggcattnagtgttctgtgactggtctggcacnctactntngntgacaaagatgggaangggtctaanagtcatgtcacttataaaagancttgggaggagcttttttcgaaagatccaaagattttgnaaggagagattacagcngaactaagaccncgtagaagataggtagatntcagctcaatataaggaatggtnttgtagnatcagtgcagttccgaatggaataagctgtttgaacatggcttagcagaanctgaatgacacactgttaganattctagggaattctgcactgagtacagcattggattagatctgtgggctgtttccaactcaagattctgatatctcatcataagcattntgagcaaggcagttggtataaaggtggccgtagtaatagaagtcagtgtgaagtctaaagcaattccgcaatgaatttaaaggcaagaattttagggacaaggatacagaaaaatgcctagtaag

SEQ ID NO: 648954 - DNA, 653 bp, Homo sapiens
  misc_feature (1)..(1): n is a, c, g, or t
  misc_feature (32)..(32): n is a, c, g, or t
  misc_feature (143)..(144): n is a, c, g, or t
  misc_feature (151)..(151): n is a, c, g, or t
  misc_feature (167)..(167): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (218)..(218): n is a, c, g, or t
  misc_feature (227)..(227): n is a, c, g, or t
  misc_feature (249)..(249): n is a, c, g, or t
  misc_feature (288)..(288): n is a, c, g, or t
  misc_feature (305)..(305): n is a, c, g, or t
  misc_feature (317)..(317): n is a, c, g, or t
  misc_feature (336)..(336): n is a, c, g, or t
  misc_feature (359)..(359): n is a, c, g, or t
  misc_feature (366)..(366): n is a, c, g, or t
  misc_feature (417)..(417): n is a, c, g, or t
  misc_feature (438)..(438): n is a, c, g, or t
  misc_feature (528)..(528): n is a, c, g, or t
ngaagtaggggagttagatggctcttccctgnacaaatgggccccacaagtgattaaagccaggggccgtatttctcggcatttgtcaagctggaacagtctttagtgaactcagctacgctcttttagaactgctggtttcnnctgaagncacatggatggcattnagtgttctgtgactggtctggcacnctactntngntgacaaagatgggaangggtctaanagtcatgtcacttataaaagancttgggaggagcttttttcgaaagatccaaagattttgnaaggagagattacagcngaactaagaccncgtagaagataggtagatntcagctcaatataaggaatggtnttgtagnatcagtgcagttccgaatggaataagctgtttgaacatggcttagcagaanctgaatgacacactgttaganattctagggaattctgcactgagtacagcattggattagatctgtgggctgtttccaactcaagattctgatatctcatcataagcattntgagcaaggcagttggtataaaggtggccgtagtaatagaagtcagtgtgaagtctaaagcaattccgcaatgaatttaaaggcaagaattttagggacaaggatacagaaaaatgcctagtaag

SEQ ID NO: 648955 - DNA, 309 bp, Homo sapiens
ctccctgccggccgatcgattcctttccattccattctattacatttgatcctattttattaaattgcattctattcgagtgatttccattcgagccctttccattcgattccattccattctattccattcctttggattccattccattccgttccgttcacatcaattccttgcgattccattacattcgatttcttgccattcgattccattccttttgactccatttcattcgattccattccatcccattaatttccattccattcgagacctttccattgcagtcttttcccttcgagtcca

SEQ ID NO: 648956 - DNA, 523 bp, Homo sapiens
ggtcgcggggggcagtggcggtgtaatgttggctagcaggatatttaggctaatttgggaagcgagccaggtgcacctctgtgtgtgtacgagctcatgaaagtggtgtgaagagcgaagacttttcgatcccagcttatatggatcggggtgaacagtccctatgtccggaggtggtccaatgtcagagcaccctgtcgtgggcagtccaagaatgcctcttgtcatggaatgaagggatgcaaggggacctccatggacgcgagcgcgtcgtcgcaactggtagtgcagagagagtccggaagtttgtgaatacgctatttagagttgcccaggagcaggctattcgcctcggaggattgtaactagggggctgcagaactagtcggtgaagaacggtgtcgtgggagcggtcgcgcatcgctctacctttccccatacccgcggatcttggctgaaccccgggttgttacttaccgtgtttccttgcgcaaaagtcgtgccagtaaagacactgatgtcg

SEQ ID NO: 648957 - DNA, 378 bp, Homo sapiens
  misc_feature (161)..(161): n is a, c, g, or t
  misc_feature (168)..(168): n is a, c, g, or t
  misc_feature (179)..(179): n is a, c, g, or t
  misc_feature (191)..(191): n is a, c, g, or t
tattaccactaaattcgcggccgcgtcgacgaagccattcacttcatcaaaaccaagaagaaaagaaagagagagagaaacaggaaggagctggggttacaacccctgcaccctaacttccttccaccaggacttactaatttttgttgttgtttaaattntttattnatttcaatttntattaaattttnacaaatctttcattacaaattacaaaacaaaacataaaaccacacacgcacccaaattaaccagagtcacagtctctccatttccttgaacatctatacaggtagaaaaggtcttgggaatagaaaccgaagcctcccattggacttacacatttactactgaatatatttgttctgaggtcgacgc

SEQ ID NO: 648958 - DNA, 316 bp, Homo sapiens
caaaaaggctgggtacgcctcctaaggcgtctgtccccccgtgtccgagctccattaccaatgtctgtaggccgcctctaaagagcgtagcgagtttctcgtggttgctctgaaaaaagcgttgctgccgccggctatgatgcggagaaaaacaacagccgtatcacacttggtctcaagagcctggtgagcaagggcactctggtgcaaacgaaaggcaccggtgcttctggggcctttaaactcccccagaaggcagccttccggggaagccaagcccaaggttaaaaaggcgggcggaacccaacctaagacg

SEQ ID NO: 648959 - DNA, 457 bp, Homo sapiens
  misc_feature (88)..(89): n is a, c, g, or t
tcctgtggcccctccgccggcgtttgtgctgtgtgacatccctctcctccaccgctgcctggggttgggggcagtcggggcagtcagnncaggccaggccacccctgggtgaagagggcattggggccagaagggtctgcactgaccacctccaagtttctgttcttaggctgttcccgccgcagcagaatataaagtgctgaagccagaacccagactgggacgcaaggcccagaacctgcgcagggccaccggcaatcggccaccatgcccctgccctgctgtgcctcgacttacccatctgctgctggggtaatcctaaccatctcttactgagggaccctgagtgccttgttcaagttcagtgtggtgagcccattggtgggaggtgtttttcctccccaaagactgtattttgaaaagtactaataaaatacaggaggtgagtaccaaggca

SEQ ID NO: 648960 - DNA, 249 bp, Homo sapiens
tacatgatacaatcgagctcggtacctcgattaggcaaatagaatcttggccactgacccgggcacatggcagcacagcactggttcgaaccgttactctgtcacctggaacagaaaaagtacatgggaccttaagctcaccttctttacttgtatcaaatgatgactggtatactggtctcccatcccttcgcttgtggcaggagatggcttaaataaataacttaaacttagattggccttatcgag

SEQ ID NO: 648961 - DNA, 202 bp, Homo sapiens
ttatgtcttagtttcccatagggcatatcttactcaagctatctaacagctcttaaaatattggatattgtatttaagtttttgatattttggttaattcactctacgtattcttcaaatagcaatatcgtctgctacattttctggtgcttcaaaggattgattttgcatatgatcgttagacataatccgcgaggtgtgt

SEQ ID NO: 648962 - DNA, 282 bp, Homo sapiens
  misc_feature (17)..(17): n is a, c, g, or t
  misc_feature (59)..(59): n is a, c, g, or t
  misc_feature (134)..(134): n is a, c, g, or t
  misc_feature (197)..(197): n is a, c, g, or t
  misc_feature (215)..(215): n is a, c, g, or t
tgataattcatattttnaggccaggaacagcagctcacgcctgtaatcccagcactttnggaggccaaaatgggcagatcacttgggcccaggagttcaagaccagcctgggcaacatggccaaaccccatctntacaaaaaattagctggatgtggtggcatgtgcctgtagtcccagctacccaggaggctcatntgggaggactgattgagnccagggagctcaatgctgcagtgagccatggagccatgattcatgccactgcacttccagcctgggg

SEQ ID NO: 648963 - DNA, 118 bp, Homo sapiens
tccgtaacgagcgccgctgcaggagtcaggggtgttaggagggtcgttacggaggcgtcgttacggagggctgttacggacgtgttaggaggcgctcgttacggaggcgctcgttacg

SEQ ID NO: 648964 - DNA, 1051 bp, Homo sapiens
  misc_feature (181)..(181): n is a, c, g, or t
  misc_feature (363)..(363): n is a, c, g, or t
gtttctgggcttcagtctggtactctctctgccagaaacggttctgccggttcccccagctctgggtacccggcgtctgcatcgcgtcgcctatgtagtgggccatcgtccagtgcgtcgtgctcagccagaaacacagaagccgctgaatccgggtagatgaagaagtttcaaatctggnaagagcatccaagtggcgtgccacagacgtatggcagatatcatccgaagcatgtttgggacccaagtccagtgatgaagatgcttttggacccaagtgcgaggcatcgtgatgaccaatgagtggcaatgccattcttcgagagattcaagtccacgcatcctagcggccaaggtccatgnatcgagagattatgccggacccaggatgaagaggttggagatgggaccacgagtcagataattagttcttgcacgggacaatgctgtctgtagctgagcacttcctggtaagcagcagatgcagcccaacagtggtgatcagtgcttaccgctaaggcatcggatgatcatgatcaggaccctaagagaagaatcaagtatcccagtcgacatcagtgacagtgatatgatgctgaacgatcatcaacgagtcgtctattactaccaaagccatcagtcggtggtccatctttggcttgcaagcattgccctggatgctgtcaaagatggtacagttctgaggagaatggtcgggaaagagattgccgttcagcacaagtactgccacgtagtgggcaaacgataacccggatgcctcattgcacggaccggggccgagtagccgtcctgaataccagggtgtgaacctgcaaagtatgcagggcagttcaggaacctcggcttggtcctccggactgccacggcgggaatcaaggaaaccgctaaaggcccacgggactggggacacccggagagggagccctgccgcaatttcccagcggtgcccgatcacccaaacgctctgaggacctaatccccgagccgagggggcacacgcaaagggcctaaaataggcacagagcccagg

SEQ ID NO: 648965 - DNA, 165 bp, Homo sapiens
ctgtatcccccgaactttgttgaggctgaggtaggaagatacttgtagcccaggagttcaagactagccctggcaatgaagcgaaaccccatcgctacaaaaaattagccaggcaatgtggtgcatgcctgtagtcccagctacttgagacctgagcaagccagg

SEQ ID NO: 648966 - DNA, 109 bp, Homo sapiens
tctttcttttgtttcttccctgcttgctttcttgcttgattgcttagttttcttaaaattattatttatgcattctttttcagacatttcacctagttctagatcgcga

SEQ ID NO: 648967 - DNA, 234 bp, Homo sapiens
  misc_feature (175)..(175): n is a, c, g, or t
cagaggacccgaaatgaacgaacatcatataataacaatgtaaaaaattttataacaaggatggactgattttcatatatccaaatcagagtcactgtacatatacacagaattgtctttggcattgaaggccaagagggaacagccataaaaattgagtgtttctggtagcccnctttatttttggctgatccaacagtttgttaaggaaaagccagcttgccggttatttta

SEQ ID NO: 648968 - DNA, 744 bp, Homo sapiens
  misc_feature (530)..(530): n is a, c, g, or t
  misc_feature (577)..(577): n is a, c, g, or t
  misc_feature (579)..(579): n is a, c, g, or t
ggcagcgccgcatgggccgcaagcccggggtgctgccatggcgcgactgtccgtctcgctggccctgcagggcacatgcccaatggctgtctagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatntggtggtcaaagtgcgagcccctatggttaatccaacattaggtgtncntgaagctgaccttttaaagacatcaggaacgctgattagtgccatctaccccagccaaaatccagagttgctaaataaactttcccagggaaaaagtacagatctgggcaatggaccaggttccaagaagtcacaattgctcagggatatgatgcgctaaggtca

SEQ ID NO: 648969 - DNA, 524 bp, Homo sapiens
ggcagcgccgcatgggccgcaagcccggggtgctgccatggcgcgactgtccgtctcgctggccctgcagggcacatgcccaatggctgtctagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggtaaagtctcacttcagtgattgtaaatgaaaccttcaagtcataggaactaatagatctgatgattgataaaaggaaaagccatgtagttttatggcctggtgcttgtgagtgatcattttaaacaaacaacaagtaagtgctatcttgtattttccatgtactatagacgttcctgatttccagcgctaacagagaagacaaggtaataga

SEQ ID NO: 648970 - DNA, 759 bp, Homo sapiens
  misc_feature (545)..(545): n is a, c, g, or t
  misc_feature (592)..(592): n is a, c, g, or t
  misc_feature (594)..(594): n is a, c, g, or t
agcgggatgcgcagcgcgcgggggcaaggcccggcgtgtgcgcagcgcgacgtgctctcgcggacctcagggcacagccgcatggggtgtggtctatcggccggtttattggctttcatgggaagtggtgagtcagaaaatggggaacgtcgatactcaatctatgggcaaatacgtagtggtaagatactagtggtgacatgtggcgtgtcgtgtacatatagttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatntggtggtcaaagtgcgagcccctatggttaatccaacattaggtgtncntgaagctgaccttttaaagacatcaggaacgctgattagtgccatctaccccagccaaaatccagagttgctaaataaactttcccagggaaaaagtacagatctgggcaatggaccaggttccaagaagtcacaattgctcagggatatgatgcgctaaggtca

SEQ ID NO: 648971 - DNA, 747 bp, Homo sapiens
ctacttcagagtggtggctcggaatgaaatcggtgacagtgagccacttgactccaggacacctggctcatcaataaggaccagagtgagtctgggacttgcagttagggttaagtctgggtgccctgatggtggggatgacataagggtcccaaagggtacccaagaggcaagataaaatctgaaaaccattgagatagaacggttaatatctgggacgctgcggagagaaggaaatattggctttcttcggggtacttaggggtgagactaaagtggaggtggggaggtacctttgggggcagagaggacggcggaggggctgcggagggacatagagcgcaaacgcgttctgctctgaggggagggtctaacggggctgagaacaggggagggctctagggagccgggaggatgtctgggatccctggaggctaggggttaagggtgggggccgcgtcgggaaactcgaactgaggagctaaagggataagaggggagactgtggtcgctgactatgacgtaggggaagcttggaggcggagttcacacaggctgggaataaccgggtccaggaagctggcgctggaatgacatctcggccccagcgggtgtgggacacgcgtggctctcgggctggccgcaaccctgccagtggctcggcgacgccgcctccggcggtcgcgccgccgccctggcggcgcccggtgccggcagccccttcccgaacccagtgtaaccctcgcg

SEQ ID NO: 648972 - DNA, 986 bp, Homo sapiens
ttgtgaacatactactggtaggaatgtatacaacggaagcatataatataatcattgcatagccacactcactaaccgaagatagatacttgacaattagagggagcgagataaccgcaacatagcgatatcaacatacataacgctcgttgcggaagcacttaaaagtcagatgcgaccacattcacataaggctaaggtaatatactattagcgtctatgcatagagatataaaagtacagtcttgaatagctattcaagataatagggcattagcttctatagctattaatagacaaattattcactctcaatgcgacctttgtaagcatggttaacacagtggggtcctgtagccagagcgtgactccacacagaaggcctttggaaacacacaagcacttgtgggtcacaccgcctgtgcaagaattttgttcttactggcaataaaatgtaccgacacgaaaaacaatctgagcaatgagggtgtagaatggtcctaacaacacctttgagtgaacccgcaagtttgaacaagagggaagggactgaacatgagagcattgaaattctatccttggatgttatagagcatacaagactcagacgagcttgacttgatagaccacgcatgtgtgcttcactagacaacatctaggacatacccacagctcattagatcagactcatcgactgtgcacgaaccggcgtatatgcctacacagaaacctagaatgtgaccctcatggcataccctttacttgtatacttgcactaattcacctacatagatggcacaacccacttcaagaagggggtcctataaacgtgcgcgactggtaggaaaaaagactcaagatcaccggtgaatgccctagacattagcaggggggccttggcattcaacagggcccgagaggtagcaaatacgggctggaacatcttcccctatggtgcaccaatgcccggtcctcaaagagagacg

SEQ ID NO: 648973 - DNA, 206 bp, Homo sapiens
agggacgacgaatctctaagatcttgaacagaaggatcgttggtcgctccaaagcctgagggagactacttgtgtgtgaaagtcgataggactccgaaaggcacccagggtgttgtcacaaattttgaaagttttgccgaatgacgggagaaacaggtacctgtgagatgtggtcgaagatgaaaagaaaccatcaatagcccttg

SEQ ID NO: 648974 - DNA, 144 bp, Homo sapiens
gggcggctgtcccctttttgggggaaaaatgcctgaaaattggggggcccttcaagtaggtagcttctatttcccatatttgtcttatatacaagtatttgcttttttcaaaataattcccataaagcattttaaagttaggga

SEQ ID NO: 648975 - DNA, 154 bp, Homo sapiens
cgctctctgtgggtgcatcattcgtactgtcttttcccttgtcttgaatctgtgacgacgggcagtggtgtattagcattctcgattggtggacatggttatgagacaaagggagaaagctgcgaagcggacctggaccccacagagagagcgt

SEQ ID NO: 648976 - DNA, 1685 bp, Homo sapiens
ttttttgttttttttaagagatgtaaaagaacatgaaaaggctttattattcaaatttggaaaacctagacagcaaaacaattggcattattaatttaggtgcaagtgagcatttgggtctcaataaaagacctcccaaagttctggaacacgacttattacattaaaccaaaagtggaactccatatagagaataaatataatttaacagagtgttccagagagtatagcttatacccaagaacacgtgcgatagacaccactctctctccacctgtgcattatactgtgacatctcgagataacacacagtcttatagtcgccaaacaccgtggtgtgtcccgtgcgaaatacacgtgaagctctcctatatatgcgcgctccccccaaatatatacacacacgcgcctcggagatcttacagcgcgcacagatatcaaatctcactatagagagagagatatatacacgacaaaaatgtgcgcgccacaaagagagaaaccaattatagagctgattggctcctcctagaaaacaaacatcgcgacgacctgctgaggcgacaaaacaacaacctctcgatggggagagatgttgccgaccacaagcagagggtgttataaacagcccccccagcagacttctcccgcaacactgtgccaaaacacatattactccacttataatcttctatgcttcatcccccaacactggtgtcgtcgctcctcacacattataattatatagtcggccgcacacacaacggcagtcgacagccggacgtcagttatcatcatcaacggccgcagacgaacacaaagatagttagcacgaccactcctaataaacacccacccacgtcgtcgatgcaggctggctgcagtacaaattaattcatcattaatgatagtaggaggacgacggaccgtcggcggccggcaggacgggcgcccatattatatgtcgaagagagcccccccacggcacgacacgagtgtagggctcgagtggacaacacaaccacccaacttacaagaaggcagattctatcccccaaaacaattcccacccaacgaccgaaggaggaaacacaaagagtggctgcgtggggtatcttcatctcccacaccagcagaaaggtagtatggcccaccccccaagcgcaacaccacacgccaggagacaaccaccccccctgcttgtatgtgcgatatcaacgctccaataatataactccatagatgggcaggagagatcgacggaggagaaacaatagcgagagggaccacaacaatcgactgggccaaacacgacgtcaacgataggaacacccacccccggagagaagtagaaggtagaaccagcctgtacagtacccgacgaagaaaacaatcagtcatataacaggcacgcatcgattcatcacagcacgggtcggaggggagcaccaccaacaaagggggtcagtataataacaaacaatgtcttaatataatacccgccgcgacgtcatacctaaaaaacagacgaagtaagtaggaagaagatcatacctttgtatgacgaggacaccaattttccaccgataaaatattctcctcgcgacgacgagcaagacaactactggtgattgatatccaccacctttattatcaccaaacaaccatcgttggctacacgcaac

SEQ ID NO: 648977 - DNA, 262 bp, Homo sapiens
  misc_feature (16)..(16): n is a, c, g, or t
  misc_feature (22)..(23): n is a, c, g, or t
  misc_feature (25)..(25): n is a, c, g, or t
  misc_feature (60)..(60): n is a, c, g, or t
  misc_feature (75)..(75): n is a, c, g, or t
  misc_feature (91)..(91): n is a, c, g, or t
  misc_feature (110)..(110): n is a, c, g, or t
cattataggaatttantatggnnantcaggtcatcaatagggaggacaaactttataaangtttgtattttaatnagcactaattaaaaangtgagaaacattaaattancatcactgacacagacttcactgcttatgaaccacattctgcttttcaagaatgtttgatttatctataaaaactttattattaatcaaatggatttccccccaccttagactcatcagcaatcagaaggttgaggagagatgccatgctga

SEQ ID NO: 648978 - DNA, 280 bp, Homo sapiens
ggcgcgtcagaacaagggaagtcatttccacgtggagggagaaagcaagagagtgagcaagacaagtcactagtcttccataggtctaatctcagaagtgacatctcatcttttggctgtattatgttcgttgatagcaagtttttagatccagcttacacttgattgcagcctatgaaaggccctaaagcaggggacccagctaagccaaggccaggttcctgacccataggaactgtgagataataaaattttttttttttttttttttttttttttt

SEQ ID NO: 648979 - DNA, 462 bp, Homo sapiens
  misc_feature (95)..(95): n is a, c, g, or t
  misc_feature (166)..(166): n is a, c, g, or t
  misc_feature (250)..(250): n is a, c, g, or t
  misc_feature (280)..(280): n is a, c, g, or t
ggtgtgggttttggggtatgtgttagacgacttgttgtgcctcttctttcttgtgggtgggtgtgaaggtagtggatctagggtgtaatagaagnttctttctgctcccttatgtagaccattgttagtgctttggttgttggtgctttctgtatggtgtggtgantggcagcagctctcctgttgtgagtagttatagtgctgtcctgcagccaggggcaaaagctgcttttgcatcagagctgagggntgcactaggtgtaacttccaccccttgacntattttagagtgtgaggatgaaaggaagaggaaaaaatagacggagggcgcgcgggggtgcgggcggcagggtgcgcgcgtggccgtgggggagcgcgcgcgcgggccggggctcgtgtcggggcttccaaagagaagttgcagcgaggcgccccccggcgtccggcgcctgggcccggtcg

SEQ ID NO: 648980 - DNA, 883 bp, Homo sapiens
  misc_feature (19)..(21): n is a, c, g, or t
  misc_feature (28)..(28): n is a, c, g, or t
  misc_feature (31)..(32): n is a, c, g, or t
  misc_feature (49)..(49): n is a, c, g, or t
  misc_feature (54)..(54): n is a, c, g, or t
  misc_feature (58)..(58): n is a, c, g, or t
  misc_feature (62)..(62): n is a, c, g, or t
  misc_feature (66)..(66): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (85)..(86): n is a, c, g, or t
  misc_feature (88)..(89): n is a, c, g, or t
  misc_feature (91)..(91): n is a, c, g, or t
  misc_feature (97)..(97): n is a, c, g, or t
  misc_feature (109)..(109): n is a, c, g, or t
  misc_feature (111)..(111): n is a, c, g, or t
  misc_feature (121)..(121): n is a, c, g, or t
  misc_feature (130)..(130): n is a, c, g, or t
  misc_feature (133)..(133): n is a, c, g, or t
  misc_feature (159)..(159): n is a, c, g, or t
  misc_feature (169)..(169): n is a, c, g, or t
  misc_feature (190)..(190): n is a, c, g, or t
  misc_feature (193)..(193): n is a, c, g, or t
  misc_feature (197)..(198): n is a, c, g, or t
  misc_feature (218)..(218): n is a, c, g, or t
  misc_feature (224)..(224): n is a, c, g, or t
  misc_feature (227)..(227): n is a, c, g, or t
  misc_feature (236)..(236): n is a, c, g, or t
  misc_feature (238)..(238): n is a, c, g, or t
  misc_feature (286)..(286): n is a, c, g, or t
  misc_feature (299)..(299): n is a, c, g, or t
  misc_feature (305)..(306): n is a, c, g, or t
  misc_feature (317)..(319): n is a, c, g, or t
  misc_feature (324)..(325): n is a, c, g, or t
  misc_feature (327)..(327): n is a, c, g, or t
  misc_feature (331)..(331): n is a, c, g, or t
  misc_feature (356)..(357): n is a, c, g, or t
  misc_feature (375)..(375): n is a, c, g, or t
  misc_feature (389)..(389): n is a, c, g, or t
  misc_feature (392)..(392): n is a, c, g, or t
  misc_feature (396)..(396): n is a, c, g, or t
  misc_feature (398)..(399): n is a, c, g, or t
  misc_feature (414)..(414): n is a, c, g, or t
  misc_feature (428)..(428): n is a, c, g, or t
  misc_feature (434)..(435): n is a, c, g, or t
  misc_feature (446)..(446): n is a, c, g, or t
  misc_feature (456)..(456): n is a, c, g, or t
  misc_feature (473)..(473): n is a, c, g, or t
  misc_feature (477)..(477): n is a, c, g, or t
  misc_feature (516)..(516): n is a, c, g, or t
  misc_feature (856)..(856): n is a, c, g, or t
tggggagctgggcggggannncggggcntgnnaggcccgggctgaagcngcgtntganagangagngcgcagcgtagananangnnanncnaggaangcaaagatgaananaatggtggangaaataatnaanctgctgtaatccctttatggggagangaagatgaangcggctgtaaagcactctggnaanggtnnactggtaaaaggaggaaatngacttngtngggggtttngngggaggacaaacgggaatagaagttgggggggctgtaggggggctgtnaggtgcatggatnaaaaanngaaagtttaannnggttnntnaaanaataatggagctgcaccctgcagannaaaaaaggctctttaaanaagccgcagcaatnatnaggnanntggagtggacggaanaagtgaaaatgaangcgctnntaatgggaagngaggccctgnagaagcagatgctggcnatgntggtgaactacgtaaccaaggagctgcgggccgagatcnagtatgatgactaggccgcacctccggggaggtggggggccctttaaatgactctgtgattctgaagaggtggcttgggagttgggagaagccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggcccccagtgaagagtaaaggcctgcctgccgcagttccggaggcgtctgctgagtcctctcacccgcatgggtctggggaagtgatnacgctcagccgacggtctgacaaactt

SEQ ID NO: 648981 - DNA, 456 bp, Homo sapiens
  misc_feature (263)..(263): n is a, c, g, or t
  misc_feature (265)..(266): n is a, c, g, or t
  misc_feature (268)..(268): n is a, c, g, or t
  misc_feature (270)..(270): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (308)..(308): n is a, c, g, or t
  misc_feature (311)..(311): n is a, c, g, or t
  misc_feature (334)..(334): n is a, c, g, or t
  misc_feature (367)..(367): n is a, c, g, or t
  misc_feature (390)..(390): n is a, c, g, or t
  misc_feature (419)..(419): n is a, c, g, or t
  misc_feature (433)..(433): n is a, c, g, or t
cagtggccgctcccgtggccgttaggaaatgagcgataacgatgacatcgaggtggagaccgacgaagagcatccgaggtttcaatctgcggctgacaaacgggctcatcataatgcactggaacgaaaacgtagggaccacatcaaagacagctttcacagtttgcggactcagtcccatcacttcaaggaggggaggcatcccgggcccaaatccctggcaaagccacaggattttttccgtatttgccgagggaaaaacncnncncnccngcangntnttgacgncctcaagcggcagaatgctnttntggagcagcaaggggaaagcganagctgatcaagttctttgttcctggggaattcncttctcttcctccctcatggaanatgcaagtaaaaggaaatgcaagtaaccncctgggttagaaancctcaaataaaataaaataaaat

SEQ ID NO: 648982 - DNA, 714 bp, Homo sapiens
  misc_feature (1)..(1): n is a, c, g, or t
  misc_feature (3)..(3): n is a, c, g, or t
  misc_feature (19)..(19): n is a, c, g, or t
  misc_feature (27)..(27): n is a, c, g, or t
  misc_feature (51)..(51): n is a, c, g, or t
  misc_feature (59)..(59): n is a, c, g, or t
  misc_feature (95)..(95): n is a, c, g, or t
  misc_feature (114)..(114): n is a, c, g, or t
  misc_feature (133)..(133): n is a, c, g, or t
  misc_feature (159)..(159): n is a, c, g, or t
  misc_feature (261)..(261): n is a, c, g, or t
  misc_feature (462)..(462): n is a, c, g, or t
ncngtctcgctgcatactncgcggttntccagtcgtactcgcgctgctggngtctatgnccactgcgccgacttggcgcgcactattaactaccntagcgacacacatcgtgcncgactcgttgttctgcgcntcaccgccgagcgagctctatgcgtnctcacgtctatagagtgatcgcatctcgctcctagctctatgacgccgtgcctactcgtgctacgtccggtatcagctacaatagtcacggcgcatgacgcntagctatacgtcgcactcgatcgtatcatgtaccacagacactcgaaagatcgagcgtactgcaactatcgacactccgcgcatcaagcgcatatcgcaccccgtctctcagtgtccgcgacgatagacagctcaagccctcgtcccacgctcgtgtgacgcacgagcagccgccacagagtacgcgctcgtccatgcggntatcatctatcgctcctcacgctcatgcgcatcaccttcacatcgcacgatctataccagcgcaccgcctgccactatagatcacttctatagggtcgtactcgaacggcacgataataaccgcgtacgtccaagcactcgtcgaccagactcctcttcacgcatcatctcgcctacgatctgcatacgtaccgtactgtggacttaccatccgatgcccgatctagtctctctatacacacctgggggccg

SEQ ID NO: 648983 - DNA, 541 bp, Homo sapiens
agagctcctggcctcaggaagtcagcccttcacaccacaggggaagggcctctctgcagtctgaccgctggccctggtgctcctggcatgtggggagccatgtggcctagtggctttgaagtcagaaagccctgggtttgatctccagctctgctctttgaactctaatttcttccttgtgggttacaataatgaatgcatgtcagggcctagcccagagccagaacacagttggccttgaataagtagccttcccttcccctcgttctattgccctcctacccctccaccctaatgttggcttttccaccctatcagttactggggaggatgaggagtgccagtccttcctgggaaattgtagccctagggaagtctggaatgggcagagcctctttccaaaaatggggagggggcacatggctccctggagcaccagattcctggcagatatgctgccctgctgagagtgggtacagagccccgcttaggtctctgtctcagggagctccctccctcctgttcataaggggggacccag

SEQ ID NO: 648984 - DNA, 196 bp, Homo sapiens
accaagattgaagtgccagaagcttagtgcggacacccgtatcggcatagcgcactacagcccagaactcctgggctcaagcgatcctcccacctcagcctcccgagtagctaggactacaggcgtgtaccaccaccccccgctaaattgaaacatcttttttgtacagatgggcgacagagcgagactccatctc

SEQ ID NO: 648985 - DNA, 147 bp, Homo sapiens
aggatccgcccggtaatttgcctttgggaatctcaaaccactggtgcggctctgcccaggtatagcatggcaagtgttgaaagcagggggtcgtgtcacttcccactccagcagcctcagccagttactgataggagatagtccccc

SEQ ID NO: 648986 - DNA, 458 bp, Homo sapiens
ggatataggcatgcagtgtgaaataagcacatcatggagaatggggtatccatcccctcaagcatttatcctttgtgatacaaaaattcaattaccctcttttagttaagtatcttttctaatgcctttaattaaaaaaactttattttgaagtaatttaaaacttcaaaataagcaagaaaagagcaagaataacacagagaactccctatatcccagattaaccaattttcaatgttatttttgtcatatttggggtatggggagatctttttgttgtttttttaagagtcagagtctatcttatcttgcccaggctggtctcaaatgtctggcctcacatgctcctcctgcctcagcctcctgagtagctgcgattataggcatgagccatcatgcccagcttttttttttttgagacggagtcttgctctgttgcccaggctggaggtcgacgc

SEQ ID NO: 648987 - DNA, 193 bp, Homo sapiens
  misc_feature (39)..(39): n is a, c, g, or t
  misc_feature (43)..(44): n is a, c, g, or t
ggcactaaagcctttaataatacgagatgaaatgcaacngtgnnatgacaagtaagtgagcctgacctggcattgcctcgcctcaccgctggctttgaccagggtatgatctttaacttttctgagctgatttgatcgtggtctttacacacaggtggtcgttcctgtttggacactgttttatttgtttgac

SEQ ID NO: 648988 - DNA, 621 bp, Homo sapiens
ggaattacaggtgtgagccaccacacctggcctgtattttctctatctcttctctattattttcttgcttctgctaattattatttccctgcttctgctagctttgggtttagtttgctcttctttttctagatccttaagatgtaagttaggttattaatttgagatcattcttcttttttggtggtggtattggttctttttttaaatttaaatttttatttttattttactttatgttctgagatacatgtgcagaatgtgcaggtttgttacatagctgtacatgtgccatggtggtttgctgtaccgatcaacccgtcatctaggttttaagcccctcatgcattaggtatttctcctgatgctctccctccccttgctcctcacacccaattggaccaatctatcaccctatagaaagactaatgttagtattagttacattgaaacattctccttcgcataagcccgcgtcagattaaaacacctgaactgccatttacaagccccatttttacaatccaacaacacaggcttatttaccctcactggtgaccccacaccaggcgtgcttcttaaggaagggttaatcactgtgcgccgttttcacccgctggc

SEQ ID NO: 648989 - DNA, 772 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggtaagaagtgtgggttttgcttggtaaattgatcacaagtccgccagatgtattgattgtactaggtttgaaggtgtattaggtcttatgggataacagctccataaggatatggtgttagtatataggtccctacatccttacaagagatgt

SEQ ID NO: 648990 - DNA, 339 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (266)..(266): n is a, c, g, or t
  misc_feature (296)..(296): n is a, c, g, or t
  misc_feature (304)..(304): n is a, c, g, or t
  misc_feature (309)..(309): n is a, c, g, or t
  misc_feature (320)..(321): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaactctaagnttctagagtctcaggagtgagccagtctcnaaggaagnaattnagattgcaagnncagcccttatgagaatga

SEQ ID NO: 648991 - DNA, 141 bp, Homo sapiens
cttaaaaaggaccaccacggaaagagaatggttcacgggaagagaatcataagccccatgtctgacgcggtaaggagtgatgaaaacaggcggctgtcccctgtctcctgtatgaggcacgatggctcacctggggtatcc

SEQ ID NO: 648992 - DNA, 392 bp, Homo sapiens
acatactctatatcttcatcatctatatatcatctataccatgaaataaacatttatagacaataaacatcatctcaagaggaataacacttgattttctaaaaggatgtcttaacatcatctgtgttttggaatcctggattattttctcctttgctaatatcgatggaggcctaaggattttctccacttcttgctatatttttcttcttccgatctctgatcccagtgaagatcaggatgacaatgccaaccactatcactcccatcacaactcctaaaacaatcagccatattgaaacaggtggctggttaggaggtccaagtgttggctgtatccccagaaactctaggctgtcgtcattcagacggaaagcctcattgatacggct

SEQ ID NO: 648993 - DNA, 1980 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1788)..(1789): n is a, c, g, or t
  misc_feature (1796)..(1796): n is a, c, g, or t
  misc_feature (1799)..(1800): n is a, c, g, or t
  misc_feature (1821)..(1823): n is a, c, g, or t
  misc_feature (1827)..(1827): n is a, c, g, or t
  misc_feature (1839)..(1839): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 648994 - DNA, 581 bp, Homo sapiens
  misc_feature (304)..(304): n is a, c, g, or t
  misc_feature (316)..(316): n is a, c, g, or t
  misc_feature (376)..(376): n is a, c, g, or t
  misc_feature (404)..(404): n is a, c, g, or t
  misc_feature (437)..(439): n is a, c, g, or t
  misc_feature (441)..(441): n is a, c, g, or t
  misc_feature (448)..(448): n is a, c, g, or t
  misc_feature (473)..(473): n is a, c, g, or t
  misc_feature (476)..(476): n is a, c, g, or t
  misc_feature (493)..(493): n is a, c, g, or t
atattttaagaactgaaaccgacccaggcagcttgagggcccattattctttatattgtttgtcttagcacacgctagcaaagatagatgcctaggactttccttggctattggagtttatagaaaaaaagttcttagttgcaggttagtcctccaccagtttaatccacgcttttttccgggttagggagaaaaccaatacgttaatccttaatatgatatgggaatgtatggccagggttataaagttttgtcggtttattaaagaactgagcattcactcttcagctagggggcttgatgntcattcagcccnctatcacctagaaagactaagacctaatgtgttaactctgtctccaaaaaggaaaacccngtatattagatttgatagatccctctgncgagctcacctccggcgtagtaacatgttatgnnngnaattttnaaacccgcaagacgctctctctttnctngccggggttccttcaanaccttctccttacgtcctcttcccctactcttaggatccctctatcacttgacgcaattcctttttaaccttttcagagtatgttaag

SEQ ID NO: 648995 - DNA, 143 bp, Homo sapiens
tgacttctgctctgagagtcagatctgctcagagtggtcagtcctctaagacagtggctggaattctcctcccaaagcactttcaaggaagacttactgatctaagagcaaactggctctccagggtaacagcacaagtacag

SEQ ID NO: 648996 - DNA, 1928 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1736)..(1737): n is a, c, g, or t
  misc_feature (1744)..(1744): n is a, c, g, or t
  misc_feature (1747)..(1748): n is a, c, g, or t
  misc_feature (1769)..(1771): n is a, c, g, or t
  misc_feature (1775)..(1775): n is a, c, g, or t
  misc_feature (1787)..(1787): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 648997 - DNA, 1985 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (709)..(711): n is a, c, g, or t
  misc_feature (716)..(716): n is a, c, g, or t
  misc_feature (1793)..(1794): n is a, c, g, or t
  misc_feature (1801)..(1801): n is a, c, g, or t
  misc_feature (1804)..(1805): n is a, c, g, or t
  misc_feature (1826)..(1828): n is a, c, g, or t
  misc_feature (1832)..(1832): n is a, c, g, or t
  misc_feature (1844)..(1844): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagannnagganatagaggaagatgaagaaggatgaggaggaaggaggaagatgtgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 648998 - DNA, 1198 bp, Homo sapiens
agagtattagaagttgtgtcgtctgttgttgttcgtgctggtgttttggcgtattaattttgtttagtgtgatgtgttgtattgtatttgtggattttatgttggtgtgtgtttgttttgtgtgtgtgtagagtttgtagttgtgggaaatatattttgtggtaggtttatagtgctgttgggctcttagtctggagtatgagatgttgaggtgtttaatgatatgggatggtgtgttggtagtagtaagtggcgtagtagtgtgtaactagctgtttgtatgaggttgtgtaagtcgtttagtaggcgaaaatggttggtgaaagctgtattttattttgcttgtgtccatgtttgagttttgcggaattctgtatggctgggagaaagatagagtactgcgtgtatcatttgtgtggaagctatgtattgaatgtggtactgtaattgttaagtaatcggtgaaaaattctttaaaggaggttggttgagcatctgacgaggtggatggggtcattgcatggtgtcatgtgctgtgagatgttcaaggtgatggaccaaggtagcccatcggagttcgcggagcacggaagcttagttacctagtggaagtcagaggtactctaggtataatgccttccgtcggtgtccgtgggacgtctgccagaagtgatccagatcagacacctctaggataagagctctcctagagccatggaacccgtttcgtgttttgcggtcctgcattgtgcagttctgttggaatgctatgtttggccaagagtggggactgaggactaagctctgatcttctattatcgttgcccaaattccttgccaaaagatctggggagtcatgccactacaaaccatagagttctcagtcagatgagttttatttaatcctgtatatcatgacctgtggtctgccacaatcgcctttatgcttataacctgaacattgccttgctaatggatgccaggtctttagacaaatctcaaccaagctgtcaacaagagaaatgttgtaaagttgtaccgagtagcctggaagccccccgctttaagttgtcctgcctttctaaaccaaacgaatgtaatttcgttaaatgtatttgattgatgtctcatgccttcctaaaatatgataaaaccaagctgaccccagccatcttgggataactgccggaaggtgctt

SEQ ID NO: 648999 - DNA, 1952 bp, Homo sapiens
  misc_feature (23)..(24): n is a, c, g, or t
  misc_feature (1760)..(1761): n is a, c, g, or t
  misc_feature (1768)..(1768): n is a, c, g, or t
  misc_feature (1771)..(1772): n is a, c, g, or t
  misc_feature (1793)..(1795): n is a, c, g, or t
  misc_feature (1799)..(1799): n is a, c, g, or t
  misc_feature (1811)..(1811): n is a, c, g, or t
ttatggatatgtcgaccacgcgnncgagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 649000 - DNA, 156 bp, Homo sapiens
tgtgaactggtatgtgggtgaaggcatggaggagggtgagtgctcctaggcccgcgaggatatggctggccagtagaaggattatgatgaggtggcgcatcggctcctatgaggacgaggatgagggagaagaataaagcagctgcctggagccta

SEQ ID NO: 649001 - DNA, 103 bp, Homo sapiens
agacaaggtgggaccgatggtataattgagttcatagaaagacagtgagccgaggtcatgccattgcactccaccctgggcaacaagagagaaactctgtctc

SEQ ID NO: 649002 - DNA, 366 bp, Homo sapiens
  misc_feature (160)..(160): n is a, c, g, or t
gtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccncgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttca

SEQ ID NO: 649003 - DNA, 1283 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1256)..(1257): n is a, c, g, or t
  misc_feature (1261)..(1261): n is a, c, g, or t
  misc_feature (1265)..(1265): n is a, c, g, or t
  misc_feature (1270)..(1270): n is a, c, g, or t
  misc_feature (1272)..(1272): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattannaaanaaanaaaananaaaaaaaaaaa

SEQ ID NO: 649004 - DNA, 817 bp, Homo sapiens
ccaccccaccccaccccaccgcgcgggatcactgcgctgcggcgaggacgacggcgaggcgacccggccctgcgcaccagggcgcgatggctgaccatgacccagagttggaggccatcaggcagaggcgagtgcaagagctaatgggacagcgtggtggtgcggcaagcccacaaaatgcagggcaacaaaaggctcaggaagatgcaaagcaggaagctgaggaacgccgacagatgatgctttctcagatactatcttctgaagctagagaaagactctcccgcatagctttggtcaagcctgataaagcaagaggagtggaggatgttctgctgagagctgcacaaactggtggaatatctgaaaaaggtgtctgacagaacaggcttatctcacttctggagcaaatcaacagccacacaagcaaacaaaaccaaagtgacgattcagaggcgtcgcaacgtccttgacgacgatgactagttggtaagcttgatgtacgagcgaatgggtgcagcggcatttggtgcttgattcaacaaccgtcagaacctgacaaactatttgattggtcttgggttgtatatgatctggatataatttggtggggtaacatttgataacagttggatgttcgattttaccccttgaaacttctctgcgacacctttggaattgttgtgcgtcaattttatcaacgtcctattcagcataattgttaatctgccaccggttcctccttgtgcaatggtgatgtctgtctcaggttgctcctagagttcttcatgttgccacaaaaaaaaagacaagaaaa

SEQ ID NO: 649005 - DNA, 1874 bp, Homo sapiens
  misc_feature (5)..(5): n is a, c, g, or t
  misc_feature (7)..(7): n is a, c, g, or t
  misc_feature (10)..(11): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaaggaagaggaggaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaagaggggggggggcgcgaaaataatatctctccggagggggagcgaccacatactaacaccacgccacctactttttttatataaaagagaggtggcgctctctcctatctagatggtcgtctctatatataaaggaagagacagaaggggcgtcggtcgtttttatcaaaacacacgtttggagggtgaaagaacactcgttggtggtggtactattatttttttaggagagagcacatcactcttattggttaggttgggtgtgagtaacaaaataagattgttgggagacacaacaccttcctttctgtatagcgataatatatttaatagagagacgccagcatgagtgggtggaccgtatatataagtactattacatttaggagcatggatattatctgtgttggtattattaacaacaagtgcactgtataaaaaaattcgggggcgtggtagtgagtgagaagtttgttcctaccctgcagttatagtgttatcttctcagaacgatt

SEQ ID NO: 649006 - DNA, 277 bp, Homo sapiens
ctaaagctggctccacaacacacagagagatcttctctagttataggtaattctttggacatcatggatcgtatcttccacaagaaccaatctcagggtaaagtcacctgagaaacaaaacttattatataacacagaataagttcacttattgaattatatttttcaaaatgaaagccattttttttctaaagtgtatttcaaggtattctggctccaagagatgctcctgagtagttctgcagtgaagaagtctgttgaaatttttacccacctt

SEQ ID NO: 649007 - DNA, 2003 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1811)..(1812): n is a, c, g, or t
  misc_feature (1819)..(1819): n is a, c, g, or t
  misc_feature (1822)..(1823): n is a, c, g, or t
  misc_feature (1844)..(1846): n is a, c, g, or t
  misc_feature (1850)..(1850): n is a, c, g, or t
  misc_feature (1862)..(1862): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgctcggaagtgcgtttctaagttagaattacaactttttttaatgagctattgagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 649008 - DNA, 442 bp, Homo sapiens
tgccccctaccacccccgaccccaccaaactggtttttcaggcatacttcagaaggcccttggccgagaggagggcccattcagtcggttggggggcttagaatgttatttttggtttacatgaaccttgtccagggccacacacccctgagtgcagagtgggcactgtccccctggtcgtggctgccgcgaagtctggcctttaggctgtgctcacagataaatcgcattttttttacttccacaaaaaacgtggacacacactcctgcaaaaacaaacacacaaaaacgcatactgacttcagaacaatagaaccatattagaataccaattcatgtttatagaaaaaaaattgtctgctaaaaaaaattatccctgttaagagtcctaaggtgtatttgggaaatctttaaatgctgtggaatagaaaagtggaaccta

SEQ ID NO: 649009 - DNA, 553 bp, Homo sapiens
ccccccccccccccccccaggagcggtcgagaacccaacatcggcaaatatcacaaaccgcaaacgcaagccgcaaacgattccgctatcggagaggggagaaggaatcggagctagatgctttagtagaaatagtagtggtaatacgtggcaggtatattcaggcgtaggtcgggtcatagggatagttaagtcgagtaaggataggcttttgtagttcagatcggggtattgtcctgcctctggctctatcttttgtcgcgttgcgtcccgttcgcgagatggtggtgtcgggttccgtcggcatgaggggtttccgggggtcccccggagcttcgggtttgctggggacgcccttctccgattcccccgtggtcgcgcgtacgcagcgacgtcgcgagggaggagacttgtcgacagaatagggggctcccggatccttcgggtaaggtcccggccggccctcttgcggacgaagtttctcctccaaattcgcccctaattttcctccaagggggggctaagttgcattagttggtttttctaccgggct

SEQ ID NO: 649010 - DNA, 1982 bp, Homo sapiens
  misc_feature (5)..(5): n is a, c, g, or t
  misc_feature (7)..(7): n is a, c, g, or t
  misc_feature (10)..(11): n is a, c, g, or t
  misc_feature (1790)..(1791): n is a, c, g, or t
  misc_feature (1798)..(1798): n is a, c, g, or t
  misc_feature (1801)..(1802): n is a, c, g, or t
  misc_feature (1823)..(1825): n is a, c, g, or t
  misc_feature (1829)..(1829): n is a, c, g, or t
  misc_feature (1841)..(1841): n is a, c, g, or t
gacananggnnaggtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagcttgtccaggctgaaaaaagccacgaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaagttgcagctgtttggtggacattctgaatgcttctaagtaaatacaattttttttattaagtatggtggtcctttccataggtctgaaatttttcttctggaggggaagctagtctttggctttggcccattttggaattcacatgaatttattacaggggtttatcctttcatatagttagctaataaaaagctttggtctacacacccggcatatcataatggggggtaaagtcaagtggagatagtttccatccataactggaacttccaaaatctggatcagttaagaaaatttcacatagcccatttacttttacaaactggaagagtaatcaatctactcaaagcatgggattatagaatcaaaccttttggaaagtctgtccttgaaggactaatagaaaagtttgtcctaccctttacatgaggactctattctttaactcccattaccatgtaatggcagtatattgtgcagtccccacattaaagaagacctgagaatgtatccccaaaagggtgagttaaaatacaagatgccatattaaattttggtggacataagtctcgctgaagactatgaaatgcnngctatanganngtctttcccatttatctaaannntggnctgtcaggaaangagacttccttacaagtatttcaatcacgtgggccagctttcaaacaaaaatgccctcaaaaaggtatattcccaatataggttgcccttaaaatccagtgaaggagaaaagacattggtcccgtgattaatatgaaatca

SEQ ID NO: 649011 - DNA, 673 bp, Homo sapiens
  misc_feature (46)..(46): n is a, c, g, or t
  misc_feature (104)..(104): n is a, c, g, or t
  misc_feature (193)..(193): n is a, c, g, or t
  misc_feature (237)..(237): n is a, c, g, or t
  misc_feature (247)..(247): n is a, c, g, or t
  misc_feature (249)..(249): n is a, c, g, or t
  misc_feature (270)..(271): n is a, c, g, or t
  misc_feature (341)..(341): n is a, c, g, or t
  misc_feature (344)..(344): n is a, c, g, or t
  misc_feature (380)..(380): n is a, c, g, or t
  misc_feature (386)..(387): n is a, c, g, or t
  misc_feature (403)..(404): n is a, c, g, or t
  misc_feature (420)..(420): n is a, c, g, or t
  misc_feature (459)..(459): n is a, c, g, or t
  misc_feature (462)..(462): n is a, c, g, or t
  misc_feature (468)..(468): n is a, c, g, or t
  misc_feature (470)..(470): n is a, c, g, or t
  misc_feature (476)..(476): n is a, c, g, or t
  misc_feature (486)..(486): n is a, c, g, or t
  misc_feature (498)..(498): n is a, c, g, or t
  misc_feature (506)..(506): n is a, c, g, or t
  misc_feature (508)..(508): n is a, c, g, or t
  misc_feature (512)..(512): n is a, c, g, or t
  misc_feature (529)..(529): n is a, c, g, or t
  misc_feature (551)..(551): n is a, c, g, or t
  misc_feature (566)..(566): n is a, c, g, or t
  misc_feature (579)..(579): n is a, c, g, or t
  misc_feature (629)..(629): n is a, c, g, or t
  misc_feature (641)..(641): n is a, c, g, or t
  misc_feature (648)..(648): n is a, c, g, or t
attgaaaaagtacatttatatcacaaagcatcaaccaccataattncaaatacatttgctggaatgtgtacatctacactaaatactaaaaacaaaccaatttncatttctacacagaaatattaaccgtcctgatcagtagtgatagatattttgtacattttcttaaaaaaaaaaaaaaaaaaggaaacantattttaaaccaaaaacaaaattaagatcttcatcaagtcgtcncgccccccananatttaacaaagcgctctcttnnccccccccccccccgcccgcccccccccccccctcgcccccccccccccccacccccccccccccgcgcnccngcggcctcgccgcgccggcccccccccgcgcgcggnttggtnnggggataagagggggnntgtggtctataatacncagcccaggctgccactataatctggctgaccacctggnggngccccngngggggngggggctgcntgggccatgttncttgtggngntctnccgcagagccttggtanaatcaacctgtccagctggggntggaattctgctganctccttgtccatnagtttgagttgtagttggtgcacctgcaggggctgctggtggtggctgtncttgctgttganaaaagtnagcgtaataagcagcccaagctgct

SEQ ID NO: 649012 - DNA, 436 bp, Homo sapiens
cagagaggtacgagacgtcatctgaggtcacacagcagtgtacatcgccggaccagatctaatacaggggtgcttttctcatgcttcagggagagtacctggaatgagtgctgagtcctgtggctttcagcccagaatagtggaaactctacccttggtaggctaccttcttccagctgaccatgtgattcgtgaataggtgtcagacaaacttttagaacacaagaagtgttctattcaacacgtctcttctttgtggcatcaagggataatgtggtgtgtgggggccccaatcctttgctcctactctctgagcttcgggtagacaaaacaggattgattgtgtctctttcaccagttagtgtgatgactgctttcacaatcttgtcgcaaaaaccaagccactatgggatgcctccaaggtcattggctgatg

SEQ ID NO: 649013 - DNA, 443 bp, Homo sapiens
  misc_feature (75)..(75): n is a, c, g, or t
  misc_feature (109)..(109): n is a, c, g, or t
  misc_feature (112)..(112): n is a, c, g, or t
tcctatctgtaggttcatgcatccaggagcatatgcaagatactgaaacagttccgtcactacaaaagatctccngtgttgttcttctggtaaactaaatatctacccnctnttctatcacctcccctccctctctcattcctagctcctggcaaccactaatctgttcctccatttaaaaaatgttctaatttgaaaaatgttatatacataggattatacttttaaatatataaccttttgggatttgcttttttcacttagtataattccctggagattcattcaagttgttgcctgtatcagtagtttattcctttctgttgctgagttgtattcaatagtacagctgtatcacagtttatttaaccattcacttgttgaaggacatctgtgctgattccagtttttggctattacaaataaagcttttatgaacgtta

SEQ ID NO: 649014 - DNA, 173 bp, Homo sapiens
cccggtgtgggggtgatctaaaacactctttacgccggcttctattgacttgaggtttaatcgtgtgaccgcggtggctggcacgagattgatcaaccctggggttagtatagcttagtttaactttcgtttattgcttaaggttaatcactgttgtttgtgtaggtatcact

SEQ ID NO: 649015 - DNA, 178 bp, Homo sapiens
cagagatgatgccactgcactccagcctgggcgacagagcaagacttcatctcaaaaaaaaaaaaaaaaagctgttgaattcgggcagcgcttttaaattcccgggcccgggtgttttggtaacttcggggggcacccggggtgtcgtgccctttcaaagggcccgtgcaattaaccc

SEQ ID NO: 649016 - DNA, 229 bp, Homo sapiens
  misc_feature (220)..(220): n is a, c, g, or t
tctgtgacattgtattttcacaaagcacgactggacgtttcacaatgaagaccagcgagatgctggacactcatgaaagaaaaaaatatcaagttccggcatggtctaagggagacgttacatgttttcacagggacaaacacggaccaggaaatcgaaggaaagtctttagagccccattttgggtagggagggcaacacatccctttaacctcacggnaaggggaga

SEQ ID NO: 649017 - DNA, 720 bp, Homo sapiens
  misc_feature (305)..(305): n is a, c, g, or t
  misc_feature (307)..(307): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (325)..(325): n is a, c, g, or t
  misc_feature (327)..(328): n is a, c, g, or t
  misc_feature (330)..(330): n is a, c, g, or t
  misc_feature (335)..(336): n is a, c, g, or t
  misc_feature (377)..(377): n is a, c, g, or t
ggaaaaaaaaaaaaaatagcacaagaattaattgtcagtcctgggtgtaattaagtacgaggctgtcacttaccactggattccctggagttaggcggcaaagacataagcagctggacactagccagtgctgctccctcttctcacagcggaccacgtctccttgcttgggagcccatcgtcctggctccgtgtggcctcgctgggtctcggggaagcagaggactgttcacttcgctgtggctgaataatgcctgtgagtcgtgccctagacacccacgactcgcagggtccatggttccggngncngtnaanctgcttgctngnnangtgcnngcccatgctgcgggactgtgtgctcagccttcttgcggacngtaaagaagctaagtggaagagtgtttcctcctctggccgtaaagcagctgtccccgccctactccggaccgccccaaagactccatgggatggacctgacgtcatgccgaatcccatgccccttcccttgggcctgctgtggtgctggacatcatgtgacacgacggacaccaggatgaccatcagggcctacgggaggcccggggcgcttgcgaccgatgaacgtttggctgcctctccttccggcagccttatgctggctttgtcttaacactggaatcaagcactgtgcaaacgcgctggcgtccccttcttgagccaccagcggaactgcccatcgcc

SEQ ID NO: 649018 - DNA, 512 bp, Homo sapiens
ggaatgagccttcattttgctggagtagggggtagcaccgacctcaggcacctggctgtgggaaatcagttggggggctggggggttttgtcttaaagggctttatatcagaacttagctaataatcaccccttgtacatgtcctgtgtgctgccagttcctgagcctttggtgagttccacagggtgacacaggtttcttgttgacctttcctgttgttggtctaacattcagctttctcagggctgttgggacagtgactcctcacccacctctcttccagcttccaaaatttggtggccctttttctttcctgttctctttgtctttgtggatttataactgaaaaagtagctctagtgacatttcagtagaattcaggagggaaaaaagttcttatgttcaattcactatctttaccccaaatttccttaatctttatatctgagatattagtgaattaagtacatctgagggataaataaatgtttctcaaatgtttactaaattga

SEQ ID NO: 649019 - DNA, 633 bp, Homo sapiens
  misc_feature (207)..(208): n is a, c, g, or t
gggctagacctgaaaagggacgtgtgtccgtggagtcgttgtaagagggttcattcaaagcttcttgcctaaaggcgcagctcctcaggtttgaggacggagcctccaccctgtacgagtccaatccactctggggtcacttggccggcacctgtgggctttatggaaaggaccaccaggaggcagccctggtgcacatggtgaatnncggggtggaggacctccgcggcaaaaaggtctccctcatttccaccaattatgaggggggcaaggatgattatgtgaaggccctgcccgggcaattgaacccttttgagaccctgttgtcccaaaaccagggaggcaagcccttcattgtgggagaccagatttccttcgctgactacaccctgctggacttgctgttgatccatggggtcctagcccctggcggccgggaggggttccccctgctttcagcaaatgtggggggcctcagcgcccggcccaagttcaaggcctttttggcctcccctgagtaggtgcacctccccatcaatggcaacgggaaacagtgagggttggggggactttgaggggggggcagggtttgccttcctttttccaggcccaataaaatttttaagagagcta

SEQ ID NO: 649020 - DNA, 299 bp, Homo sapiens
aaccatgaggttgcaggttcgagatccccgacctcgctctgtgggttgaggatccagtgttgccgtgagctgtggtgttggtcacagacgaggctcagatcccgagttgctgtggctctggcgtagactggcagctcgaacatgcggtccatactcagtttatctgtcgcctctcttatgattataatgacaaggaggctacagcctgcatagactcacaaagccatttactttgtttttcataaagtcttaccgaagtatagttgatttatgaggttgtgacaccgcatgtgcgcttg

SEQ ID NO: 649021 - DNA, 152 bp, Homo sapiens
  misc_feature (126)..(126): n is a, c, g, or t
tctgaggatcctcttgcttgggacggcgctggtagctggagcggcatcggagcatgcggataagagcacttcggctggtgtcccacaaaggcaccagtggcacctgcggtcatgccaatgaacagnctttagcagaaagccagcgccgagta

SEQ ID NO: 649022 - DNA, 947 bp, Homo sapiens
ggcgtcagccgggttcgcagtgcagcagtcggcctctcccactgcagtcctcctcgtccgccttaccgtaccgtcgtcgatgtgtcgggtggagtagcatctactggtagtgtggtgcgtcgatgaagatcctggtagccttgcttggagcaggcgtgacgccgcttgaggatgcgcgcgtgtgcacccatgcagacgcgtagctggaccacgagatggaagctgatgggagaccagctgaatgcctgacggtagcttctctgaacagacgcatgcagcatggttgacggaagagttggatcggtgcccaggagcgtctggcggacagctttgtgcgaagctgcgtggcaacgctgcacgaatgccagtagcatgatgagtgacgagaggcgttgacatagtccattgcagcagtcgagcccttaatgaagatgcaatgaatgcttggccctttcatgggagcatccaagcttgtacacgattgcacatcgcactattgcttgaagccatgcctgagcgttcccctagtgcatgagggtgtgcccgtacaggcttgtgttcattcgttggacgacgcggaccctggaacacgttgcacgcagtgcatcggggcttgatgcttcttcgagaaatggggccgaagagttccggaccaaggcgtggggagagcaacaagagtttaaagacttagagtgggcgctccagacgcgtttggaaaatgccgtttaatatggcggcttgtgcagacaggggaaattagcaggtagcgttccgacagtacacgtgtaaggcacacggaattttcgacgcgaaacgacggaattcactatgggtccctttttccctgactgcaatgcgttggacacggcgagggcgttgtagaagatccgagggctgaggtaatggggtgagtagggttcaggttgaggtaaaaattgtagggaaac

SEQ ID NO: 649023 - DNA, 202 bp, Homo sapiens
  misc_feature (187)..(187): n is a, c, g, or t
  misc_feature (190)..(190): n is a, c, g, or t
tcttggacacattttctcgagcttcctgacctgctgtaatttggattgactgctctctataccttgggcatagctgtcatcctgtggtctccattcaccatcatctcggtgactacttttcatctttcccttgtgtttcttggattccatgttgccttccttctcaggttattccctcttatctaanggngtctttggtctg

SEQ ID NO: 649024 - DNA, 298 bp, Homo sapiens
cttaacccacagcatctatccatcatgatcctcagaatgacagcttccttagattctgtaccctaattgcctatctctatgctgcagacctagttagtggctccagcaaatatcagataaaagtagtactacttgatgtccagatatcatacaatccagcatagctcatatgatggactatgcattgggtcacggaacctcagggctctatggtaaactagtggaataaccttataagaatctctccatcttcatagctattattatccacgcgtcagtatagataggggatcctcta

SEQ ID NO: 649025 - DNA, 277 bp, Homo sapiens
ggacatcctacgccaacgtgaagcagtggctgcagagagattgaccgctatgcccgcgggaacgtcaataagctcctggatgggcaacaagagcgcactcaccaccaaagaaggtggtggacaacaacacagccaaggagtatgcagactcactgggcatccccttctaggagacgagacgccaagcatgccaccaatgtcgaaccgagcagttcatgaacatggctgctgcttggggcatgttagcgatgcacatagcggggttccaaacatgatg

SEQ ID NO: 649026 - DNA, 758 bp, Homo sapiens
  misc_feature (16)..(16): n is a, c, g, or t
gggagcggtggtgcanaggtcccaggaaggtggcgtcagcatctgcagtctgctgtcgactgttgtcgtgagcctccccacactccccatggagaagctggtggctctactgagccccaagggcctcggctggtcctggggcctgtgaagatgtgtccagtgtgcccgtatgaccaagactttcgcgagcttccggtcagagtgtgaggctgaggtgggctggaacctgacctatagcagggctggggtgtctgtctgggtgcagggcttgtggagatggatcgggacgctgcacaaggatcaatgtgccggatggactggtgcttgtgatgttgccagcctgagacactctacgactgttccttacaagtgacatttgatgtaccgcaatgaaatgggacagcaacgtcattgagacttttgaccatcgcccgcgttgacagtcaacgctgacgtggggctattactcctggaggtgtcccaaggcccttaagagaccgtgatgtcattcaccctccgggtccgtggctccccattgggcgctgattacgtcattatgagctactcagttcaagctatcccagatacccacctcggaaagacttggtccgaagctgtgtccatccagagggggaactcatccagagaaagggccaagagctgggtctaccctacttgccgtgttgcccagggccttaccgggggtgggagaaatttccgtcggtccggctgaaagttaggggccacccgtgggaaac

SEQ ID NO: 649027 - DNA, 920 bp, Homo sapiens
cgtctgacttctcggtcccttttactatatggctccccggtcgcattatgtggccccatcttgtacaacttatggttcctcgcgtcggcaagtccggttgccttcccgggctcacagatttgcgcagttaaccgggcacatggtgactctttttcaaggtaattctgctcccccccccgtgcccgtttggtcccacggactagaccgccgttgttttggttaaaaagacagagagttgtgttccctccctataaagggcccctttgtgtaccacaatccgggagagtcctttggtctttaaatcttattgcgggcccccccccccgccacgctttttgggtggtattgaaaataccatttccttagatgtgggtcgtgcagcgggccacaacccttatgggccctttttaaacgtggaccgttgttgagtgcgcccccattatggaaagtctctttgggggcggccccaatccccaccctcttaatggtttgatggcgtctgttctcccgtcttgtctgtgtgatcacccgcaaccgcctgggttcttctcccccccccgggacgtgtcgctagaccccaggaagttggagaccagttggttactaaattggccgcaaaagatccgcgttctcttttataaaaaaattgtgccatttgcgtttttggaataaattgaatcccttctttctaaatacctcgccttttataaagagcctacgaatgtaaattatggaaggataatcccaagacgctctgttattaaatacaactaagttattcgcccgagaatataagaattaagcgccacctaacctccttagttattaatacctaattttttaatcctcccccctttttatgaaaaaaaaaccttgttttttaatttcgttggaaaaaaccaattttaaagggaaaaaaa

SEQ ID NO: 649028 - DNA, 227 bp, Homo sapiens
cgtcatatgtgtgccatagtgctaatcaaaagaaaagtcactctgtgaggtgaatgcacacatcacaaagaagtttctcagaatgcttctttcttgtctttatgtggagatatttccttttccattcagaacctcgtagcagtgttctgtaatcctgtgtgagggacaaacactcagaatccagccactgtgtactggagtcctatctgtgggcacacattatggag

SEQ ID NO: 649029 - DNA, 302 bp, Homo sapiens
tatgtatcccaacacactgtaatatagtggatctatacgtgcaagaccataactcagacactggcctcaactaggaccacagtcacgacgatcacaggtctatgcagagacaacccacaaacccttcatcaccagcaacaactccaaccccgtgcaggatgaggatgctgtagccttaacctgtgaacctgagattcagaacacaacctacctgtggtgggtaaataatcagagcctcccggtcagtcccaggctgcagctgtccaatgacaacaggactccttcactctactcagtgtcac

SEQ ID NO: 649030 - DNA, 174 bp, Homo sapiens
aaagtaaagtcagtggaaccattgttgtttgagagttcagtaagactcaaagcacaagtgctgcggtctagcctcttcaagaattttatttaaggccgtgcacggggaaacccccttggaatcccagcactttcggaggccgcggggcgcggatcaccccccggtacatgcaag

SEQ ID NO: 649031 - DNA, 101 bp, Homo sapiens
aggtgggagctgaatgccatgaccacctactagcaatatcagtcgcccacatcgtctcctcccatgggtaggaggaagtttctgccacctcccctcctgag

SEQ ID NO: 649032 - DNA, 1638 bp, Homo sapiens
tgttgttctggtcacaggatttttggcgttgctagatgggtgtaacacctgtgctccgctcatggattgttgtgaccctattcaataattaaatctttggctttggtggttttttgtgcaccaacaacacgacccccaaccgctgtggtggcaaaccacacatgtttggttttaatacacccggctataatgtgtggtttgaaaccacccgtggtgataaactatttttatactgttggtgggtagttttgattagccccccccgctagttcttcccccccgctgcgggctttgtaatatgtttgctgggaaaactgttggtgggattatgataataaattgtctgggggaaatttttccttggtccattatagagatgttgtgtctcggccgtaagacccggcttttaatttgtggccttggtgtgctatagaaagagcctcttgggcccaccatgttcataatgtcccccacatcacacgggctgtgccccccactcgtgaatttctggaaatttttttgtggggggggtaaacaccaccttggtccgagacttccacacaggtggttggtgccctgattttggttgtgaaaatttgtgtttgtggtaaaaatctttggtgctcaacagcgcttggttgttgtccccttcccacacagctgagatttctgtagatttccccacgcataatatgggggagaatccttggacccacacattgtagatatgtgtgagagaatatttgtgaagaagggacacagggtgccacatataagatattgtggtgcggtttcgatgaaaagtgtgtgccctcatatgtagatagtctacgtccacacagcgcctttaaaaaagcgagatatattagcccacacacttgtgcgcgctatatttgtgagagtttataaaggtgtgtgtgtctgttgatatctctttatactgtggagaaataccccacaatggtttgtgtgacaaagaagatctctatattctgcccggggagaggttccacaatactccacggggtgtgtcaacgacgcaacaatagggggtgtataatagggcgcgtataatgtgtagtatggcgcccactttttgcagagtagattattgagatgttgtctttcctctctgagggcccctctgctccccactagtgttgtatactcctctctctccaatattggctctcggggtgattgtttaacacacacagcgctgtgtattatcacacccgcacagagatagtgtatataaggagtatgacattgagagcgttttgtctccacagctctccacacagagataaatgtgcgcacaagagttacaccccctctgtgtgtgtacacactctccacagagaaggagactctcatatataagacgcctctgtggagactcacagtggagagcttctaggcttcgtagaaaattttaaaaactaccacacagtggagttaaactcgaggcccttaaggtttcactgccacaggacacctcggagtcacccgctttgctttgagttcttcttcacaataatgtgaaatttgggctcccccagaatccaagcctatagcttggtttaaagcttgccatctgagctcttggacccaattaaattaactattgtagtgtga

SEQ ID NO: 649033 - DNA, 104 bp, Homo sapiens
ccgggccgtacccatatccgcagcaggtctccaaggacaaacgggccctcaaatttatcaagaaaagggtggggacgcacatccgcgccaagaggaagcgggag

SEQ ID NO: 649034 - DNA, 854 bp, Homo sapiens
gttctgctccggggcgcgctgtcgctcgtgagttcccatgaggcctgtcgggcaccgtaaccagcttgccgcgtacaccggcaccggcgcctgcggactccgcaggaccccgcgcccgcgccgcgctatgctgtggctgctggtgggcgttgctggccctggggctcgctgtctttgcgctgctggacgtctggtacctggtgcgccttccgtgcgcctgtgctgcgcgcgcgcctgctgcagccggcgtccgtgacctgctagctgagcagcgcttcccgggccggtgcgtgccctcggacttggacctgctgctgcacatgaacaaggcgcgctacctgcgcgatggccagattttgcgcgcgtcgcgcacctgacccgctgcggtgtgctcgggccgctgaggggaggttgcggggcgcacacggtgctggcgggcctcgtgcgcggcgccaccgccagtcggtggcttgtggagcccttcgaggtgcgcaccctgcctgcttggggctgggacgaccgggcgttctacctggaggcgcggctttgtcagcctgcgggaacggcttcgtgtgcgcgctgcttgcgctttccgggcgaggaacctcgcgtgggcacctcaccacagagcgcgtcgtgcaagcaccttgttgccaagtgcagtgttggagcccccgtgagcttgccccgcttgatcttgcagccactgggtctcctacaaaggaggccgcagcaagtttctccgattggagagttgggctcagtggtgtgccccaagacccattggccggcactttaacggttgcctgggcccatcttggtctgtgggcttgccccagtgggggttcgccaac

SEQ ID NO: 649035 - DNA, 340 bp, Homo sapiens
ggaggtgtggtgctccattgtcaactcaggcatggcagtcctggccatgagtttgaatcccagccgctcagcggctgcgaggtgaaatcactcaatcctctggcccttgctctccttctctgtacaatcggatagacttagtatttgctttatgggatggttgtgagaatccaatgagacagacattcagtgagcaccgtacacgtgccaggcacagtgtcagacagccagggctagtgtcatcaattgctcatttttttgttgttgttgcagcacggcgtctcgctctgtcgctcaggctgtagtgcagtggcacgatctcggctcactgcaagttctg

SEQ ID NO: 649036 - DNA, 185 bp, Homo sapiens
  misc_feature (162)..(162): n is a, c, g, or t
tagccccaggcttacctatgctcggtgatgtggggatgtacggatacatttcccagacactatacatgatcgcagttaatcgccataagaagtggtcgctcaggacggtcgaattccgggtgcatcatcatcatgatcgtcgcatcgatcgcctctctactntgtgtctctccacgatagtagta

SEQ ID NO: 649037 - DNA, 450 bp, Homo sapiens
  misc_feature (87)..(87): n is a, c, g, or t
  misc_feature (275)..(275): n is a, c, g, or t
gaccccttttactctggataagggcagaaacggttccccttcccttatttgtaaagttacccgctggtagctttcattatttttgcnaccctccttttatttgtatttaaatgttttaggccacctaagaaccaatgtaaaagtaaagatgcaggaaaaatgaattgcttggtattccttacttcatgtatatcaagcccagcagtaaaaccaaaacccctggatttaacttttttttaggatttttgcttttgtgattttttttttttgaaacntgcctaacatgcatgtgctgtaaaaatagttaacagggaaataacttgagatgatggctagctttgtttaatgtcttatgaaattttcatgaaccatcccagcataattgttaagaacccgtgtattaaattcatgtaagtggaataaaagttttatgaatggaaaaaaaaaaaa

SEQ ID NO: 649038 - DNA, 1245 bp, Homo sapiens
ctcgtgggagttgcagcatgtgacatcaccacggtgatgtggcgaatgctggccacggtgagtgtggtgtgcccctggtgacattgcgcagccaaggatgtgctgcaagggtgctctggcctgcgtggctgcctggtcccacgatggcactgcgtgcccagtggtcttgtgttgctggagacgtgtgcccacatgtgtgacttgtgtgactgctgtatgccactacaccgctcagcccctaggtgtgcttgggcttgtgcatgacaggtacatgcatccatgggtgatgtcaatggtgcaattgggtgctgacgaccaagacctatgtggcgatggctgtgtgctgtgcgtgctgtgatgttgacagttgaacgctactcaaggtggacggtgacgtgattgcgttgcaggtgcatgcgggcgttggacgagaagctgccattgcatgtggctgtgctagatgctgtggtgatgtgcaacaatgtgcctttccaatggaatgcccctgttgtgcccaaatgtgcccgtgggccgttctgcctggggtgccggtggctggaactgtggaatcgcccgtggtgaattcccgtggttgccccttcaacgacggtatctagagtggctttgggaatggaacggatgtggcacaaagagttcatcccggacgaccttggggagaggattgtgacatggtttgccgccgacagctagtgcatttgaccccgacatgcgtgcccaagtgaacgggccctaggggtccatgggatagaggaaaccggttgagagccatagccaaggtgcaccatttgaaccaattggtggataccctgggatggatgcacacgtgtacggaaagggttcaccacagcaaatgaaactcggccgaccgtgttcccgggagcccatttccccttgtacaaaacaacccccttattaagcggccttgggactgggtgagtcccgtgtcctgtggtccaaagaaacagcacggggggcatcgttgagtataagcgtttgtaaccatttatcacttcgccgagtcgtggcagattcggaggacggctgaccttattggggccattgcaccccgttccttggggtggacgtccgcacaggaagagcccactagtcaagcgattggtcacctctacaaaatgggcttggcttaacgccgcagcgcttacagaaatgtccgtttgtgtgacgcttgttgtcgaaaattacccgtgtgaccgattgaaacga

SEQ ID NO: 649039 - DNA, 366 bp, Homo sapiens
gatccccgttcttacagcgatatatgcaataatctagtgtacaacccatagagtgaccagagttttgaacagaccttatagagttgagccataatcttatgtcttcagactacctgtcaatcggggtacctgaatggtgaatactacccggtatcgagtattctgacttctgttcattgatagtgattgagaatcttcctttcctgtgattttaattgactgacctagaaagaaatcccagtcctttgactttactaaatgctatccctgtggtacgtgctatataccacaaataataccaagatgtgcttatatacgaatttcaccaatatgtgtacacttctgtccttcagctccccagtccaa

SEQ ID NO: 649040 - DNA, 252 bp, Homo sapiens
actgaacaacgtaaggtcttgactgacacttacaagttggatgaatctgaaataaagttggtattgtttgaagcagcccaacaatttcgaacatgctacaagaccgtcgtttgactgacaaggccttgaagtacatgactgacaacaacgtcgatcttcgcctaggcgccatggtcactggtgttgacgaaaatggcgtgatttttaaggatgactcaacttcgccaactcggttcctcattaggacaacta

SEQ ID NO: 649041 - DNA, 420 bp, Homo sapiens
agtggtgcacccgggctgcacgagttcggcacgaggggggttccagctgtcttttgcactatgcccacaggtgaagagttccaaagatccctgagcatgctgcccatgatgctgccaggcatggctgctgtgccccagatgtttggtggtgggggacatctcagtgcacccatgtgaaccacctggacttgcactgctccggcgtgtctatcaagcacaacgagtggtacggcagtgactggactgcggaagacaagccgagtggccctgatgtgtctgaacctgcaataactactataaggcctgtggcttttaacccatttctcatcccaagagtatcttctggactcatttacccatccatgttcctctcccctgggatgggcatgggtctgtcagccatgcagcgccagacctctg

SEQ ID NO: 649042 - DNA, 157 bp, Homo sapiens
gcagtcaaggaggctgtcaggctctctgtagatgtacggctggtattaccaactgcttttccatgtccgcatcacacatagcatctgacgacttgcctgagtccatatcgtggatgctgcgcgtccacttacgcgtcatactcgacgcggctcttac

SEQ ID NO: 649043 - DNA, 268 bp, Homo sapiens
  misc_feature (82)..(82): n is a, c, g, or t
  misc_feature (238)..(238): n is a, c, g, or t
atcagtactacggcgggtaggctaggattgtgggggcatgaatgaagcgaacagattttcgttcatttttgggtcctcaggntttgttataattttttatttttattgggctttggtgagggaggtaggtggtagtttgtgtttaatcaatttttaggtcgggtggatgaggaaataaggtggttaaggagttatgggggggtaaattaattggggttggggggcccaataaacgggncaatttccttaattggggggggttttatgg

SEQ ID NO: 649044 - DNA, 335 bp, Homo sapiens
ggcgtgttttggtttttgagatggatctcactctgtcacccagcctggagtgcatgtggtgcgatcctcgggctcactgctaccgtgcacctcccaggttcaagcatgtcgtcctgcctcagcctccacgagtaggatgggcagttacaggcacccaccacgatgcccagcgaagggtgtgtactaatagtagagaagggctgtccagacatgtcgaggtcatggctgatcgttcgaattctcatagaccagcacagtgataaggcgaaaatgccagtcgctaacactctgtgtgcaatgaaaacacgaaacttcgatgtgacaaaaacaatcca

SEQ ID NO: 649045 - DNA, 283 bp, Homo sapiens
  misc_feature (254)..(254): n is a, c, g, or t
tatagcacgacatgatatggttgatagagttaacttctgctgcaggaatgtacatatcttgatgtttttctgccttgctgtggagtggatgctggcaatgttgatcactatgatcagacccaaaccagggctatgcaccaaaaagaggctcacctgtaccactgaacttacggactcatgtaacacagatactgactgcacggaactccataacagctacttttacggctgtcaaaacaagagcatggattccncttttctgcagaagaagtgcatggatccc

SEQ ID NO: 649046 - DNA, 831 bp, Homo sapiens
ctcccataaatcatgaatgttcctcatggcatctggaatggtgaattctttttagaagttttccagtttactttgctgaggtccataagaggactcactgtctatgacaactatagccttacaaattgtatttcttaaataattggacttgaaagtcaaaatactccttgatccacaggctgcagaagggatgttgtgtcagcaggcatgaacactactttaaccttgtacatcttcatcagagttcttgggttatcaagtgtcttgtaaataagcagtaatattttcaaagaaatcttttattctgagcagtaggtctcaacagtgggcttaaaatatctagtaaaccatgctgtaaatagatgtgctggcacccaggcttctttgttccatttatagagcacagggaggctagatttagcataatttttcagggcccattcttggaatggaaatgagcattggcttcaacttaaagtcaccagctgcattagctcctaacaagagagtcagcctgttctttgaagctttgaaggcaggcattgacttcttctctctagctatgaaagccctagatggcatcttcttcccatagaaggctgtttcatctacaatgaaaatcttttgtttcatgtaatcaccttcatcaatcatcttagctgagtctcctggataccttgctgcagcttccccatcagctctccttcaccttgcacttttatgattatgttatcggagacaacttctttctttcaacctcttgaaccaaaccctggttagcttcctcacttccccctcagcttcatggaatgaaagagttaggtcttcctc

SEQ ID NO: 649047 - DNA, 174 bp, Homo sapiens
gggctggccatgctactctaatttaattcaggtcaaaacaaccacgctgctttctccagttaagggcaattcacgccagagtgatggagctttcatttaaacccagtcttggcatacccaggacgaagtacacttgcctccttctctgagtgtgcactaccaacaggactcaaa

SEQ ID NO: 649048 - DNA, 99 bp, Homo sapiens
cttttctgcagattttgctgtcgaccaaagattcttgagctggggtctatagaggtgagtaccggtagacttcaggggatgtctgtgactttacgttga

SEQ ID NO: 649049 - DNA, 109 bp, Homo sapiens
atgtacgcgctgctgctgcgcctgctctgcgtgacccggggggggttttggggactcctctacgacgtcgcgctgcctggcctgcacgcttggacctggcctgtcgttt

SEQ ID NO: 649050 - DNA, 1189 bp, Homo sapiens
ggcggatggaatgaatgcaggggctgggggaatgagtagaaaacagttgtctgtgcgagtgactcatgatatcatatcgttgcatctggttagactagtgactgctagtgctagttgtgcagctgaaatcatatagcatcaattgatcaactcttagagacattcacgtgggtgtgccgaggagcggagttactcatcatgtcctcaagatcatctcgaagatcatcctcgtgatataaaagggctgaagcagggtagataggaaagttcagggtggccaagtgacatttagtaaaactactagtttgatcacgttgtccgaagatcgtgggtgggaattgtacccatggggttcccctacaggtaaacttaccaaaaacatttttgtggacaggcaaaagtggatgttgacgttggtggccactcgttgaggactttagatgaagaatttgggcgtagttacccaaaatgacgaaatgcaaaatggatcaaggtgtagacatatttcagttggatacccaataggttgcgaaagcgcaatttacatatatatcacaccatatttatgggatttattaaaagcctatgggtgagaaattgtatagaattgtgtgcttgcaaatggttatactttaaatggagaggatgtagataacaaaatttgtaggtagagtcagacgagagagatcaatgagttggaaattaaggagccattaggagaagattagcgtttgattggactgggaggatgggtatataaaaacaccgcaagataatgaggaggttctactaaggcaactcccgaacacccagatgagaggggcctaaacagagcattgtaccacctgggtgataaactcccatcaccgcatggtgtagtaacctcggagagtactagggggatgtggtcgcaaaagagcaaaggaatgtgaaaaacattgcagggttgtagaaaatgcaattacgcaaaaattgtggagtacccaaattacgcgatggaatgtattgtgaagaactatggggcaaggcacaagtaatagaacgcaaatagaataatgaatgtggcgtgtgagaaagcaattcatatgtagtggggaaacatttacattaagtgtgatatttgatgtgatgtaattgaggcaccagttactaacatatgagagtaggaacttctcacagtggaaaaagg

SEQ ID NO: 649051 - DNA, 110 bp, Homo sapiens
aatcgtgtcagcagtttgtatgtttagtgggggtaatgaagtattgcaaattcattgggttttcctcaaattcgtgtaataaaaataaaaacccgacaagattgggccat

SEQ ID NO: 649052 - DNA, 102 bp, Homo sapiens
ccgggagggttggattcttttttttttttctgtttaacagaaaatgggctgtctgtcatttacctacttctttccccctaaataaaagaattcttccgttta

SEQ ID NO: 649053 - DNA, 176 bp, Homo sapiens
  misc_feature (176)..(176): n is a, c, g, or t
agcgtaccaaaaagggaagccagtcgaggacaggtgagaaagccagctgactttattgctctgggggcagggggctcaggagctcttggtggggcgggtccgcttcctcttcaccacaccaagagctcctgagccccctgcccccagagcaataaagtcagctggctttctcaccn

SEQ ID NO: 649054 - DNA, 533 bp, Homo sapiens
  misc_feature (12)..(12): n is a, c, g, or t
  misc_feature (35)..(35): n is a, c, g, or t
  misc_feature (533)..(533): n is a, c, g, or t
gtggattttttngaagaacattaataaactaaaantttcaaaaaaaaagttcccgctgcgaagggagccgccgccatgtctgcggatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccn

SEQ ID NO: 649055 - DNA, 729 bp, Homo sapiens
cggactggtggctggtctgcaggttgactgcgtcaatgcgagcaggctgcaggtagtgctgagccacctgaggggtccggccgattccggctggatgcctgcatgccgcgccttgccctgagcggtgcccctggcagtgccatcgttgctcgcgggacgatggtggtggtgctacgtgtgcgtgctagcgatgtgccagtctgccgggacgtgagccagtgcgcgggttcaaagggactacataccccgacaatgcttctcatcggcaagtccatgacctgcggttctcaaggacgtgaatctgaggccggaacagactggtcggacatctgtgttcggaaatgtgctgcatgcgctgtgggaccggggacagatcatggtcccgagatcgccacaggtcactgagtatgacgatacccggagactgatgccgtattgatcgcatctgtcaaataggacgaggtgtactcctctgtgggctagcagtgcacgtgtcccaggagatacgccacggctgtgcaactcagcaaagatggtgtccgtcacatcatacgaattatgtacactaggcccattgatgcggcagtggcaatggaccgcagttgtactcccttgggcattagaacaagaaaggtgaagcccccatcgcactatgtataacgcttttcgctaggctttgacattgggacgcacagggggacctcagttcgcaacagcaaacagagatag

SEQ ID NO: 649056 - DNA, 366 bp, Homo sapiens
ggtactctgatcaagtattattcatgatggtacaaaaccatgatggatgggtaagaaaaaaaaaatctattccaattgcaagacagtccaatggatttttaatgtaataataactcaagaagttaatggatgtagttctagattccactttgcttttaaacattaacaagctatatatttgttgagtttgggtatagtatccaagaataatattcacaatggcctgaaaagctgttaaaataatctccccatttccaactacctatctctggtagaccagattttctgcatatactttaactaaagcatcagaatagacaggaacgtggaagctgagaacccagctgtcattactggatcagagta

SEQ ID NO: 649057 - DNA, 834 bp, Homo sapiens
  misc_feature (42)..(43): n is a, c, g, or t
  misc_feature (644)..(644): n is a, c, g, or t
  misc_feature (646)..(646): n is a, c, g, or t
  misc_feature (679)..(679): n is a, c, g, or t
  misc_feature (682)..(682): n is a, c, g, or t
  misc_feature (687)..(688): n is a, c, g, or t
  misc_feature (691)..(691): n is a, c, g, or t
gattccaggcagcttagcgaatcgtggtgctgctctttccgnntcaggtcgccgctgcgaagggagccgccgccatgtctgcggatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccngnaaaaaaaaaaatgaaaaaagagaaataaagaanggngagannaancagggggcgcgacaacacgggtgaagcacaacgggcccaggggcacaaagggtccgaggaccccgtttggggacaccacgggggaaaatggcgggatcccatatggaggcccgagataatggcagagccgagtaaccggttag

SEQ ID NO: 649058 - DNA, 92 bp, Homo sapiens
  misc_feature (66)..(66): n is a, c, g, or t
gaccaacccacagtgccgcagacgcggtcagaaagctagcaccatcccggccctccgcctcctggnctgctctatttattcgatctggttct

SEQ ID NO: 649059 - DNA, 427 bp, Homo sapiens
agtgagaactaggataacagtgacttagagtttattaagaggtctaagaattaccatatgtaagtcgtcataatggcgggaaggtaggtgggattattagtgactcatattagagatgaggcggtattctagctgtcatgctacttcctcggtctatgctgttcttctcccttgtatcgagcgccggcttggaggctttcataaggatattctcctgagtcttcttaatagcttgaaagtttgaaagtgattccagaagtgggtctggggtatatctggaattagttttatatatagtataagatcggaatctagtcctatttggcccgatatatggaacgacatttatattcaacgcttaatctatggtcatgtctattctgctgcaactacggcagctatgagatctgtgtcagattcgcggtct

SEQ ID NO: 649060 - DNA, 261 bp, Homo sapiens
  misc_feature (206)..(206): n is a, c, g, or t
agcgtaccaaaaagggaagccagtcgaggacaggtgagaaagccagctgactttattgctctgggggcagggggctcaggagctcttggtggggcgggtccgcttcctcttcaccatcacaggcttctggctgcgcaggatggcgcttggcccgtgcggattggctgccaatgcgcaggtcggggcggtacttgttcttgcggatnatgtgtctgatgctgctgagcgtgcacgagcatttttgtgatgggtccccattaa

SEQ ID NO: 649061 - DNA, 782 bp, Homo sapiens
  misc_feature (19)..(19): n is a, c, g, or t
  misc_feature (101)..(101): n is a, c, g, or t
  misc_feature (106)..(106): n is a, c, g, or t
  misc_feature (196)..(196): n is a, c, g, or t
  misc_feature (214)..(215): n is a, c, g, or t
  misc_feature (237)..(237): n is a, c, g, or t
  misc_feature (243)..(243): n is a, c, g, or t
  misc_feature (262)..(262): n is a, c, g, or t
  misc_feature (270)..(270): n is a, c, g, or t
  misc_feature (306)..(306): n is a, c, g, or t
  misc_feature (313)..(313): n is a, c, g, or t
  misc_feature (327)..(328): n is a, c, g, or t
  misc_feature (332)..(332): n is a, c, g, or t
  misc_feature (353)..(353): n is a, c, g, or t
  misc_feature (377)..(378): n is a, c, g, or t
  misc_feature (381)..(381): n is a, c, g, or t
  misc_feature (385)..(385): n is a, c, g, or t
  misc_feature (399)..(399): n is a, c, g, or t
agcggataggccgagcagngaggcccagctccctgaaacaacagtaacctacccctgtgggtcatcatcatgccctccgacctggccaagaagaaggcagncaaanaagaaggaggctgccaaagctcgacagcggcccagaaaaggacatgaagaaaatggagatgttgtcacagaaccacaggtggcagagatngaatgacggccaatggcnngagagaccacagaagtagattngctgancaaggagctagaggacttngagatgangaaagctgctgctcgagctgtcactggcgtcctggnctctcancccaacagtactgnntgtncacatcatcaacctctcactnacctttcatggtcaagagctgctnnagntganaccaaactggaatnaaactcaggccgtgcgttcatggcctcacttggtttaaatggaattggacaagtccatgctgctctctgctattgggaagcgtgaagtgcccatccctgaacacatcgacatctaccatctgactcgagagatgccccctagtgacaagacacccttgcattgtgtgatggaagtcgacacagagcgggccatgctggcataaacgaggcagagcggctggctcatgaggatgcggactgtggagaagctcatggagctctacgatgcgcctggaggatgctggatgccgaccacgctcgcagatggagggctcgcggatcttgcatggactggggttcaccgcttggcatgcacgcaagaggctgaatgcttccgtgtgggc

SEQ ID NO: 649062 - DNA, 189 bp, Homo sapiens
  misc_feature (189)..(189): n is a, c, g, or t
tgggggacaaacattcagaccccagcagcaggcttttggaatcctatgtgagtgagagtgcctggagcctacccaacctgacgcccccaaagccctcacagggtttgacctcccagcatgcacccgccccaccaagagctcctgagccccctgcccccagagcaataaagtcagctggctttctcaccn

SEQ ID NO: 649063 - DNA, 650 bp, Homo sapiens
tggcgcccatttggcacagcacagttcttctaaactttctttatatgtccccaggaacacctttttgttaaccctgccgatctctcccaaaaattgttgggccccccccgtgacagcttgagcacccgcttcctaaatttcccttctcgtaagtccttgaatgcaacaggatgctttctgttcactctcccctgacctcctctgtccccgaattatacccggcaaactccccccccggaagagtcaattcgtagttcaaacgcccatttggacttcgcctatttgttttacaacagtggacccggtgacactacggtgctactgcctgggggcaccctccactgcccgcgttaactatgagggtatacaatgatgcctgcttttacagttattgtttatgatcctcggtaaccagaactatcgtcagtaaagtagtagatctttgcaataaatgggtgtatctacagtgcatcagtttataaggaatatcatgtgccaaacaccgcgggcttcctatttgcaatcacaatatactttcttcttcgatcgaatacggattctttctgtaacaaccacaccaccaactcaactacacatctatgttcaaacaccacttcccattttcccccccatcattaatacaaacaaac

SEQ ID NO: 649064 - DNA, 152 bp, Homo sapiens
  misc_feature (152)..(152): n is a, c, g, or t
gtcccggtgagtttcagggagcgtcccttaggtttccggggggggggttgaacctccctagccccagttttcccatcccaggagacccgccccaccaagagctcctgagccccctgcccccagagcaataaagtcagctggctttctcaccn

SEQ ID NO: 649065 - DNA, 722 bp, Homo sapiens
  misc_feature (42)..(43): n is a, c, g, or t
  misc_feature (532)..(532): n is a, c, g, or t
  misc_feature (534)..(534): n is a, c, g, or t
  misc_feature (567)..(567): n is a, c, g, or t
  misc_feature (570)..(570): n is a, c, g, or t
  misc_feature (575)..(576): n is a, c, g, or t
  misc_feature (579)..(579): n is a, c, g, or t
gattccaggcagcttagcgaatcgtggtgctgctctttccgnntcaggtcgccgctgcgaagggagccgccgccatgtctgcggatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccngnaaaaaaaaaaatgaaaaaagagaaataaagaanggngagannaancagggggcgcgacaacacgggtgaagcacaacgggcccaggggcacaaagggtccgaggaccccgtttggggacaccacgggggaaaatggcgggatcccatatggaggcccgagataatggcagagccgagtaaccggttag

SEQ ID NO: 649066 - DNA, 162 bp, Homo sapiens
ccttttcggggtgtcccgccatgcgcacattctttgttcccggggcccatcccgcccctggtctcccggccgcgttctatattcgcttatattgcctaggttcccagatggcccctgctgaaggaaccccctgtttcccaatctatatcataaaaggatcca

SEQ ID NO: 649067 - DNA, 383 bp, Homo sapiens
tagtcaccagtatgtgggtgatggcgccatgcatatctggtgcaagtgaagtcgcagctggattagtgacggaaatgcaggttacacttctcacaatggtaaggtttctctcctgtgtggattcgcaggtgtgctcttcagagtctgaaggtgccggaaacagggtggcacagaattacacagggatagggcttctcaccagatgtggatatgcacatgggcacgggtgtgcagccacctgtacaactctggctccgcaggtgtcgcatttgtaaggcttctctccagagctgaatctgaggtgtgagtaaacaggttggctgaccggttgagctgagccgcacaagatgtcgcgaggaataggggtatcacagcggggtgga

SEQ ID NO: 649068 - DNA, 136 bp, Homo sapiens
gacatccagattgccattgacctggctggagaagagcagcatgccccgcccctgagttcctggccagcagcccccctgacaacaatgtcccctgatgaagccaccgtggctgaccagtgagtcagaggatgacctg

SEQ ID NO: 649069 - DNA, 273 bp, Homo sapiens
gggaaagctgacgctgcggaccagggcacgacagagaggaccgtggatgagacgcggtagagcgtgcggacttcaggggagtccgacacagaggcagctcacagagagccaggctggtcgctaggcgagaagagtcatcaggagaacaagtgtcaagtaacagagccttgctagcaagcacggcggtgcatccattgtgctagccatgagtgagcaggatgaatcgaccgagtacacttagacgtgcagagctcaagaggctcaacatccact

SEQ ID NO: 649070 - DNA, 145 bp, Homo sapiens
tatggttaaatagtgtacctttgtgtttgtttgccacattttctttaccattttctgtgtgatgaacaccttagattgtggttccactattgtttagctatgtgcaaattagtactattaataaatttaggagtgtgcagatagg

SEQ ID NO: 649071 - DNA, 227 bp, Homo sapiens
gacctcattccttttgaattttttcagggcaaagaaaccaaaaccggcccatgcggtttctgtggggtccagttcagacagcacccccccttaaagggtgtggccccccgggggtcccccagcatcctgtgagcatttccccggggaagctgagcccgtgaagctccctggttttgttccaagggtattcctggtgctgaataaagggtgttgctgtccaggctgca

SEQ ID NO: 649072 - DNA, 419 bp, Homo sapiens
  misc_feature (352)..(352): n is a, c, g, or t
  misc_feature (356)..(356): n is a, c, g, or t
  misc_feature (365)..(365): n is a, c, g, or t
aagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgcccctgtactccagcctgggcaacagcgagactccatctcaaaaaaaaaggaaatgtgtatcaagaacatgattatccaggggtattttttaattcagatcatccaactgattatataaaagagttggctttaaaatgtttgcaaatgtctttttttttttaaaactggaagaaaaaanattntgttgtgtntcaaacagggcttaggatgtctttcccagagcttattaaaaagatgaaacctga

SEQ ID NO: 649073 - DNA, 324 bp, Homo sapiens
cgtggtcgcccagcacctctgtagcgtacgtacccttcgctacttaccactctgatgacacgtctagggaaatgggcatcaaatatgtatcctgtcgaacttttcctcatgggcgcagctgtacgaggaagggtctctttctgctttcccaagggaaacatcagaaatcacttcactcccgtttctgcaagttcaaaagccaatgaaatctttgaggcatatataggtgttagtaccttgtccactatccacccctaaggcaccgggatctatctctagaataggaagtccctcattcactgtccatagcctttttctgctgtt

SEQ ID NO: 649074 - DNA, 937 bp, Homo sapiens
gcccatgcaacgtgttgcgacctgcgtccgacaagatgtcttgccgacgtacgtgtccgttgttgattcgcctcttccttctgggagtcatacccgcacggggtgacagacccacttgtgtgctcgtggtactagaatattttgccccacaaaggagtttggtggtgccgccccgccgcttttgcgagttttgtcggtcccccacagaagccgtgtagtgtcccgcggcgggctttgtaacaccgccgcccctttgaaagttggggacaccacagtgctcaagagaccgatagtgcaatcctgggccatagtaagtgtgtcgtgttcgccggttatccctaatatacggggcgtgggtcctacgacataagaacaggtgtgcccccactcaagcgagtggttttaagtatgcttggggccgcgccttgtgcagcaccgcagtgcccccccctccgcctggggcctatttttgccgctaagttgggcgggggcccccttgcattgactgctccccgtttgccatgggcgtggaacgagcccgcgcttggccgctgccccgctctgggtttagttccctcgtattgtgaagaggcttcttgttggctgcgacacgccatgtgctctccagcttcggcacagctgttatttgcgctattagcggtttttaggccacccacttgctgcccttttgcggtctcgagaacatactcgccttttcaaaggcccctatttttagattgacgttttgtacaatgtgcccacaattgtgtttgaatagagcagacgcgttttgtataaatggcaattagacctagcgttattcctccactcagtcatcttgttaagcatcttcacgcgggggacatctgcacaacctcgtgctccgggtgatcatcaaacaaacattataaatccgtcgacggcgttctacataaca

SEQ ID NO: 649075 - DNA, 245 bp, Homo sapiens
cagcacagcacggcacagacagcacagacaggacagcactgcacagcacaacacagcacagacagcacagcacagacagcacagaacagcacagacagcacagcacagcacagcacagcacctaacagtctcacactgcagtacacaggacagcacctaacacagtctcacactgtagtacacaggacagcacctaacacacagtttcacactgtagtacacaggacagcacctaacgtcgacgc

SEQ ID NO: 649076 - DNA, 1672 bp, Homo sapiens
  misc_feature (461)..(461): n is a, c, g, or t
ggtcgcatcggggccagtggtgcgtgactaggcagaccacgtgcatagactgcaggcgctcatatggcagactcatgcccgtacgggactgctaagttacctcgggcccaccgtccaactacatgaggcgtgggttgacgaatttcacgcgtagcaacagtacatccgaggggtacctatatccatgatagcactcaccgcggtgaggcgccgcaccgttacgcgtggcgacgcagacgcaatgactattctaaggacgacacgtattgatccagtgttccctcatctgggcgacgcgtatcgtggtacggaagatgtaagatggatatgtaatacttcagaccctctgggaaggactctggcaggtcgtgtcgtctacgggactgtgtgatctgaggtaccggtggacctaagcataccaggtgcggtatggcgcacctctaaacgcacccgcgcatagncttggcgcaggagcgaaggcggcgaacacgcgcgcgaagcaagggggcagatcagacgagctcgggcggtgaggacttgcaccgctatacgtaatacgcgtgggcctgcgtcggctagataacaacaggtcaccgcaagtgtaccgttcgacgagtacacgcgagagtgttagtgcagaaacttccacctccgtggaagggctcccactcgcaactcacgcggcgtaacaccttagaaagacgaacagcgaaaccacttgaggagacctcacacagtaagaatatccaagtggccaagcgtggcttgtcaattgagcaagattatgtatacccggggggggtccttgcgtattggatttcagcaccgcgtgccccgtgacccacattgccctcgtcctggggatggtcatcctctttgggaaggctgctttgcaccgctttgtccattcccaagtcgttttggcggggaacccgcggtggggtaacctaaccgccggggcggtacaacagcggcgagatagactgtcttttcggttgaggcgcgctatacccacgtggcgtgtttttccccacttcgtgggaaccgtttgccaccctggttgctcattcatcaggttagtgggcgtgcggttccgacaaaggcgttcttatccccggtccaagcgcctataggttctctcgttccttttctaaggttcgccggttcctattgtattaccctacctttgtcagaccttcttttggcgaggtcgcccacgttacccagcttgggcgctaccttgggggcgttgcacggagaagggccaccggcgtcgcggcgcttgttagtgtatctttggggccacatatttgttgccacacggcacaactggttggggtttggcgaacctagagcttgtgtccgtgggggcaacttgggttcggtcccctaggtctcgtatactttggacactcccaagggcgggacacttagcacccagagcagtaatagcaaaagcccacaacccatatataactcgacacagccaccagagaataacaagagcccgagagcggagtgggggcgcgagacgaaaacacaaggggggatagcagcagaagagagggcgcgacagaggagacgacatcataaaaaacggaagccaggtggaggcacaccgtcgtatcttcgtggttgcgcgcaccgtgggagacagcactgagagaggcgg

SEQ ID NO: 649077 - DNA, 860 bp, Homo sapiens
attcaaattaatcttcacctataaatgttaacattgttttttatttaatgaagaggtttaaagagaaagagttatgtatatttatgtagtatgtaattataattaataatccctttataaattaattactatttgaataaaatgatgaaacctagaaaagtggtttttcatcaatatgttgttctctgtgttgcaaagtgataaactgtaggccttttttagtctaaactagttattcatactatgatgtatcacttattacactgaagctttgactttcttagaggtcacattctttataaaatggcttaatttgcttttacagcatgatttatattgagaaaatttagtttggtgaaaaataaaaaatattttcatgagaataattttgtgtgtaaagattgagctaaaggagggagaagagtaggatttgcattaatatctacaatgcatgaaaaaatggaagtggtatcttagagaaggaaattggaaatcatgaattttaaattgcatagtttatcagttaggtagcctgacaatctaaactagaaattttttgatcaggcaccatctggtgaaacaacacctatttataccagcatctgtgctatgtactatcacatctaccttgagagtctcttatcttagatccaagtaccgaacttggtcgtctgttaaccaaaagcctttgtggaggtttacctgccataaatggggcgccccgcgaaaacgttctgaaaaggccgagtttgctttagtcgaggggaacaccggatttgggatgtgccgtttaggtccctccccggaaggggggttccccagataaacggggagcgcgtgggaggacccttttggggtga

SEQ ID NO: 649078 - DNA, 183 bp, Homo sapiens
tagtctgccggcgagctagcaaatgagaccttgataggatttcgggagaattcttgaccatcaaagcagtccatagctgactttagctgaaggttggtcagcaaaggagatcgttgcctctcccttcagcttgtcagtgtccctgtcggtgtacgaattactcatggtgccatcgggaggggg

SEQ ID NO: 649079 - DNA, 1117 bp, Homo sapiens
tgtctaccgcactaaatagaacctaataatacgcatcatagtcttcgctctacctcagccaattagagcctcgccagtatgaggcatcctcgatcccacatcctcgtgagcctgcacttcggtcgtccacatcctcatagtcgtccacggtagtcactgtcctcatcactatactgcttagccgactcaacaatacgacacggcccatcatccagtcgcagatacgataaatctcttatgtgtctgaaggtcacatctccgcaacatctttcaaccgccacatatgatcaggccttcttatgtaatgcaatttcatcggtgcaccgtccttcgcataaaccatcgagcgtgagcgccctcatataatttgagcctctattgggtcagtaaatctcatcatgatgctgtagataaaccgacgttctatcctgtcctctgaatatgatcactcatcactacctttgaccagtgcaatcagagcataaggtcagtccacgggcgcgactaactctacttctacattaatggagccaacaagtacatattggaggcttcactaatccgacactcataataacaatctgtagaaaagcctctatttctaaaaactgaagataaatagcagggacgtgcatagcttcagttaacgaccttgatcccaccaattcatccctcacttactttccatcattccacgtatccatcctttgaccgttgttttttacctgctttaacacataagaagcaatccgacctccataatttcttgcaaccgaaaggcgggagtcaaacaagcccctagtgaattggctcccatttccgataaaatccacctttccacgcttaatagagcaattcaaaagaaggccctcggtttacttgctctggccatgctctcctttatgacatttaccgtatgtgtcaccagaccttcctggggaaccgaggaaggataacctagaccgagcggttaaaaaaccctgtgcacattaagccgagaatattcctcttcggcaaaaaatccgagcggcctagggaaaagaaggggcactgccggttaaaatagatggtcagggaatccagacattaggggggaatagtataacgcagcgcacat

SEQ ID NO: 649080 - DNA, 387 bp, Homo sapiens
gagcaggaacaacggccctgaagactgtccgggccatttgggttttttttgccactaatattagtattcattatgcatttctaaataacagtcattctgtttgtctttttaatgctttattcattattgacatttgtagttgagggatccgggggttcaatttattttgattttttttttggttgtttatttttgcttgttatgttaagcaaaaatcctgcaatgaaaggtactatatttgccagactctagacataagatattgtacataaagagaattttttttgcctttaaatagataaaagtatctatcagataaaaatcaggttgtaagttatattgaagacaatttgatacataataaaagattataacagtaaaaaacaa

SEQ ID NO: 649081 - DNA, 294 bp, Homo sapiens
gtcatcacctcaccccacaagatcgtgggtcccgaatcgaacgaccttgtgctgcaattgcgcaagcgcggagtgacgcaggtgatcctggccggcatggccgccaacctgtgcgtcgaagggcacctgcgcgaactcctcgaacagggcttcgaggtggccgtggtcaaagacgccacggcgggtccacgtctgcccgaaggcgacggttacctggctgcgctggtgaactttcgatacctggccagcgcggtatggagcaccgtgcaggccgtcgccatcatcggcgggagt

SEQ ID NO: 649082 - DNA, 3542 bp, Homo sapiens
  misc_feature (3)..(3): n is a, c, g, or t
  misc_feature (6)..(6): n is a, c, g, or t
  misc_feature (20)..(21): n is a, c, g, or t
aantangctagtacgaggcnnggttaatcggcacgagggatctcctgtctcagcctcccaagtagctgggaccaccatgcccagctaattttgtattttttgtagagacagggtttctccatgttgcccaagttggtctcaaactcctgacctcaagtgatccacccaccttggcctcccaaactgctgggattacaggcgtgagccactctgcccggcctgtgcatattttcttcactgacgctgtttccaagtcacagaggccttcacacgtgtctgggagggttttgcccgggcacttgcaggggtggggtgggaggagcatttctacccgtggccccttcttctgcttaaacacacggcagatccagaaatttctctccagcagaatgcagcccctcaaggatgggggccttggttacatcggtttatatgtttaacttccacccagagcttggcgtttcaggggagcctgagttgaaggcacaaatgcgtgacagttcctgctctgccctttacaagctgtgtgaccttgggcaagttactgaacctctctgtgcctcagtcaatagggatgatgacggcaccccttgcagaccttttggaaggcttaactggatgagtcaccctaagcattcggagcagtgtgggtgggggcgctctgggtggaggagaccagctctaggcgagggtgccttggactccctcatggctgcctctctctccaggccccgccacctctgttcagccagctctgggagacttggcttgcctttggctattggagagtgtcaccccatctttaaagtgcaggaagtgaaggaatcctcctctctagtcctttgtttggaaactgagccagaagaccacagcaaactgctggggtcacacagctgctgggtcagtcacagagctgggggcaaccgtgggcatcctggtctatcgagtgggtcattgtggtggctgccgcctacctaaccaaacctggtcccacgggccagctctcactgtggggcagccagctggagggacggggccagcttgccccaccccgcccctcccctccacagcagagagtgccctggctccatggggcccagcacaagctctggaggccacaggagtgcctcccctccagggcctggcaaggctggctctctgcagggctggtcaggtcagctgccttgatttccctctcccaggggcctgatgtcatcattcaggggcagcctggggacttgagggaggatgcagttcccactgccttctcccgtcctcccctccccttcccttgcttctccttctccttcctgcttccacgtcctgaccccctggccctccccagcccggccccttagcctcccctccctcccggcccctcactccccccctaccagggctgccctgtgctagcgcctgcctgtgtgaatgtctaatctccaattttattcgctgggctccagcccatttgcataatccacacagtcaccctggttttaattgcccacaactctgcagaaagatcatgtggttaagtggtaaatcataattagataaataattggtttggccacagcaagctgcttttgttacacctgccatctgctggacccgttttttcttctggccagaacaatgcggttctgatgacagagcatgctgcttctctcttctgggggggccggagggggctgaatggaggggctcggaagcagtgcctggaaaattgcccggttgctggggtccgcgcctggcctgcgcttctttctctccaagcgggcacaccacacactcgccattcattacccggcttggttaatgcatcagagtggcaaatttgacttctttgcagaaaagggagggaggaaaggggcctggaggaggagggggaccagccagggctgcccaaggcctggcctgcctgccggttgtcggtggccccgatgggccagggcaggaggcctgctgtggagggcctgggcccgatccctggggggttggggggggggggcggaggggacaggcgggcaggggttggaaccgccagacctccctgccccaccgcggtcagcttctccatctgctctccaccgaagcctcctttattttccatgccccaggccccatctgtgagccctgagtctccaggggaattgtggctccctggctggacggtcgcctggccagggccttccttggggctgctggcctgcctttcatgctgtccttccagcaagctcttagctcctagactccaggaacggtttcaaattgtccttccttcactcgctccctcacgcatacacgcacacattcattcattcagcaaacgcccgtggagcctcttcctacatcagagtgcaggttcgaacttggtctccgtgggtcagatggccgctgtgggatgtgagcaagtttctcagcctctcagagcaggtttcttcctctgtaacacaggagtcattattgtccctgccttctgggcctattaggaggatcaaaggacagaatgtggataaagtctgtcgagtgacacctgcacgaaacacaggcccagtgtctgtggctggtgagtgcgtgactgctggtcatgcccgctcccggggagggcgccagcgccgctcaccttgggcatcattggaggcccacgaggctgtgctgaacatgctgaaggaagaggtaccagtgccatgggaagggcccaggaatgaggagccttggaaagaaaccagggggccaggggaacaggcagaggggcggtaaggaagggcaggttctctggggcctgcacaggccaggacgttcctgtctctgttgagttcggactggcaggttctctggagcccacacaggccaggacgttcctgtctctgttgagtacagaccggcaggttctctggggcccgcacaggctgggacattcctgtctctctcgagtacagaccagcacatggtcctgctctctggcccctgcatcccctccagactgcgttctggaagccctgcccaggcctcacacgctgccccaagggtctttattacctggggtcttctagcattttcctctggagaaactcaggaagcatcctttctctgcatcctttctctttgggggcccagcttctccttttcagtttgacagacacagcctgaatgcccaaggcccctctgcggagacttagagacttaggctggtggagagggttgtgcctcctggctgagaacccctcagggcagatagctggctcagagtcctcatggtcttgttgatcaggaaacactggtatgttccttcctgaaaaccctctgatgcctgttgaggagcctctaggacacgttccatgtggttgggactttgtaatgccagatcttttctgtgttttaacattcctccatccatcatctacccatctacctttcatctatttctctccctccctcccttccttcctcccatccactcacccacccattcattcatgcacctattcctctctctatccccacacccaggcattcactcatccacccaagcatctatc

SEQ ID NO: 649083 - DNA, 230 bp, Homo sapiens
ctgcacatgaaaaactactcaactatcgctaatcatcagagaaatgcaaaccaaaactacaatgaagtgccatttcacaccaatcagaatggctactattaaaaagttaaaaagaaaaaaacaagaaaacaagaaacaccagttgctggtgagactgcagagaaaaaaaacacccttgcacactactggtggtactataattcagccagtagtgtagcagtgtgctcccg

SEQ ID NO: 649084 - DNA, 465 bp, Homo sapiens
gctggtgctgattagtcacagattctttttactgaatgcaaacgaaggctcatatctatctacagccaagccctccttagtgtaggtggcttaataagagtcaggagaagaaggtatatgcccagagagctatacccctgactgataatcctggcaacggcaggttgatatatttttctttttgggtcctcatgggaacacaggaatgcacttcttacatgcggtgagatcatgagcacagcctttccatcttcttttattcatcctgccttgcaagggacacatgacaatagccaaaggaaattacatccagaaatccaaaggtgaataggtgataactgtgggcctacttcccattttatgagatgcacggtcttcactagcacaattggatcttaagcccaagagagctagatgctctagaagccgtgacctttcaatttctcctccaaatccaatatcagc

SEQ ID NO: 649085 - DNA, 3329 bp, Homo sapiens
  misc_feature (3)..(3): n is a, c, g, or t
  misc_feature (6)..(6): n is a, c, g, or t
  misc_feature (20)..(21): n is a, c, g, or t
aantangctagtacgaggcnnggttaatcggcacgagggatctcctgtctcagcctcccaagtagctgggaccaccatgcccagctaattttgtattttttgtagagacagggtttctccatgttgcccaagttggtctcaaactcctgacctcaagtgatccacccaccttggcctcccaaactgctgggattacaggcgtgagccactctgcccggcctgtgcatattttcttcactgacgctgtttccaagtcacagaggccttcacacgtgtctgggagggttttgcccgggcacttgcaggggtggggtgggaggagcatttctacccgtggccccttcttctgcttaaacacacggcagatccagaaatttctctccagcagaatgcagcccctcaaggatgggggccttggttacatcggtttatatgtttaacttccacccagagcttggcgtttcaggggagcctgagttgaaggcacaaatgcgtgacagttcctgctctgccctttacaagctgtgtgaccttgggcaagttactgaacctctctgtgcctcagtcaatagggatgatgacggcaccccttgcagaccttttggaaggcttaactggatgagtcaccctaagcattcggagcagtgtgggtgggggcgctctgggtggaggagaccagctctaggcgagggtgccttggactccctcatggctgcctctctctccaggccccgccacctctgttcagccagctctgggagacttggcttgcctttggctattggagagtgtcaccccatctttaaagtgcaggaagtgaaggaatcctcctctctagtcctttgtttggaaactgagccagaagaccacagcaaactgctggggtcacacagctgctgggtcagtcacagagctgggggcaaccgtgggcatcctggtctatcgagtgggtcattgtggtggctgccgcctacctaaccaaacctggtcccacgggccagctctcactgtggggcagccagctggagggacggggccagcttgccccaccccgcccctcccctccacagcagagagtgccctggctccatggggcccagcacaagctctggaggccacaggagtgcctcccctccagggcctggcaaggctggctctctgcagggctggtcaggtcagctgccttgatttccctctcccaggggcctgatgtcatcattcaggggcagcctggggacttgagggaggatgcagttcccactgccttctcccgtcctcccctccccttcccttgcttctccttctccttcctgcttccacgtcctgaccccctggccctccccagcccggccccttagcctcccctccctcccggcccctcactccccccctaccagggctgccctgtgctagcgcctgcctgtgtgaatgtctaatctccaattttattcgctgggctccagcccatttgcataatccacacagtcaccctggttttaattgcccacaactctgcagaaagatcatgtggttaagtggtaaatcataattagataaataattggtttggccacagcaagctgcttttgttacacctgccatctgctggacccgttttttcttctggccagaacaatgcggttctgatgacagagcatgctgcttctctcttctgggggggccggagggggctgaatggaggggctcggaagcagtgcctggaaaattgcccggttgctggggtccgcgcctggcctgcgcttctttctctccaagcgggcacaccacacactcgccattcattacccggcttggttaatgcatcagagtggcaaatttgacttctttgcagaaaagggagggaggaaaggggcctggaggaggagggggaccagccagggctgcccaaggcctggcctgcctgccggttgtcggtggccccgatgggccagggcaggaggcctgctgtggagggcctgggcccgatccctggggggttggggggggggggcggaggggacaggcgggcaggggttggaaccgccagacctccctgccccaccgcggtcagcttctccatctgctctccaccgaagcctcctttattttccatgccccaggccccatctgtgagccctgagtctccaggggaattgtggctccctggctggacggtcgcctggccagggccttccttggggctgctggcctgcctttcatgctgtccttccagcaagctcttagctcctagactccaggaacggtttcaaattgtccttccttcactcgctccctcacgcatacacgcacacattcattcattcagcaaacgcccgtggagcctcttcctacatcagagtgcaggttcgaacttggtctccgtgggtcagatggccgctgtgggatgtgagcaagtttctcagcctctcagagcaggtttcttcctctgtaacacaggagtcattattgtccctgccttctgggcctattaggaggatcaaaggacagaatgtggataaagtctgtcgagtgacacctgcacgaaacacaggcccagtgtctgtggctggtgagtgcgtgactgctggtcatgcccgctcccggggagggcgccagcgccgctcaccttgggcatcattggaggcccacgaggctgtgctgaacatgctgaaggaagaggtaccagtgccatgggaagggcccaggaatgaggagccttggaaagaaaccagggggccaggggaacaggcagaggggcggtaaggaagggcaggttctctggggcctgcacaggccaggacgttcctgtctctgttgagttcggactggcaggttctctggagcccacacaggccaggacgttcctgtctctgttgagtacagaccggcaggttctctggggcccgcacaggctgggacattcctgtctctctcgagtacagaccagcacatggtcctgctctctggcccctgcatcccctccagactgcgttctggaagccctgcccaggcctcacacgctgccccaagggtctttattacctggggtcttctagcattttcctctggagaaactcaggaagcatcctttctctgcatcctttctctttgggagcttgctggaaggacagcatgaaaggcaggccagcagccccaaggaaggccctggcaggcgaccgtccagccagggagccacaattcccctggagactcagggctcacagatggggcctggggcatggaaaataaaggaggcttcggtggagagcagatggagaagctgaccgcggtggggcagggaggtctggcggttccaacccctgcccgcc

SEQ ID NO: 649086 - DNA, 270 bp, Homo sapiens
cgtgttattgagctggcatgtgacggttcaacggaaaaggaaggatatagcgatggcgtcgtgcagatgcagcacgtcgcacacagacatggtggaaactttgtgcatgcacgtcacaacccgagatgcaggcaaaacggacgtcacgggccatgtcgacgtcacacatattaaattgtcaccacaagaccggccgggcgaaaatgggcaattcacacaagacggtgatgatgtcacacacagacacagtgacaacacacaccatgacaa

SEQ ID NO: 649087 - DNA, 450 bp, Homo sapiens
ccatatcgcagggggagctttgaaggaaaaaagagaggtgaggtaactagcctccactactggacattctgattcagtaggcctggattaaagcctagaaatatatgcccagcagttttaagaagccattgatctggccaggcgcggtgactcatgcctgtaatcccagcacttcgggaggctgaggcgggcacatcacttgaggtcaggagttcgagactagcctgaccaacatggtgaaaacccatctctcctaaaaatacaagaaaaaaattagccaggcgtggtggtatgcgcctgtaatctcaactgcttgggaggctgaagcagaagaaccccttgagccccggaggcagagattgcagtgagcagaagtcacaccactgcactccagcatgggtgacagagcaagactccatctcaaaaaaaaattaaattaaaataaaaaga

SEQ ID NO: 649088 - DNA, 274 bp, Homo sapiens
aaagcagaagaagtctttggccttcacaaatgtcatagaaacaaagatgcagcccacgggaaaaagctggccaaaaaaaaaacaactacccaggtttatataggtggcgcttttaacatttgaaaggacaattgcactgaggtcaaagccagttggtgagcttgtctggcatacctttgcgaatgcacccctgggcacacttggcccaacccacagggcagcaggagcagcagctcttcttgcaggaggagcatttgcactctttgcctcgtgc

SEQ ID NO: 649089 - DNA, 1501 bp, Homo sapiens
  misc_feature (303)..(303): n is a, c, g, or t
  misc_feature (481)..(481): n is a, c, g, or t
  misc_feature (725)..(725): n is a, c, g, or t
tggcttcaaaaagctttattcccattgggcccaaggcttgtaaggataggttaaaaaagctgtgccttattgggcttggagggagaggctttaggcaaaaccccttatttactttgtgcagaggggccctttcagaaagtctcgcgtgggcctcagaaaggcctcttatagctcggtgcttgaaaagtgtgacccttttcgaaagagagaattctctcgcccagagcccagagcctctcgcggggccccaccccgagcctgtgtgtggaagggtgtggtctagcaggtgtgtgtctcccaccncaaatcttctctgtgtgaaaataagagcttctcaacttctcctctcaactcttgagagagaaaggtgtgaggtctctctccagagagaaggtctcacacaagagagactgttggggcgctcaccgtgtggcggcgacaaagataccccccagggggccatgtagaaagatctcacaanagagggcgcccgttggttctcaaagctatatattctctctcccaggggggcccagtgtgggcagggcatttcacatagtgcggcgtctcagggggggtgtttttaacccccccacctctcactctcttctcaggcctgtgggctatttctgtgagaaagtgtctcctgtgggagaagaagaagcgcgggtgtcccggcgcccacacgcggctcttgggatatattggggggcatctccttctcnagggggagagacgcgctctcctggtttatgccccctcttcgggagcggcagtatctctcccctctcggggtggcccaaagagtttttcccgcggagaaaaaagacagtggtgggggtctcacaacgcgccctttttccccaaaagaagggccccaactctcttcaaattgccggcgcgggactgccacaataatattaaagaagaggaccccccagagagaggagagaagaggataaaggtgtgtatcagggagaggggaccccctgagcacagggttacacccaccaatgtttggtgaccccgagaggatcgttgtgtttgacacgcggggagttgagcctcttcacaaacggtgtgccgggggtgggaaacaactaaacgattacccggtggaaaccggaaaaaactttgtgggggggaaggccctcccagatgagggcatcatgggtggtcttatgcgcccacacagacaagaaggggggggcccattaaaaccccccaacacaaaaacaaaaacgccgtgggcgtccccatgtggtgcagggggtcccccccccaacaaaaacacccgcagagaaaaaatgtgtggtcccccccagaaaaaaaaatatttggtgacccccccgcggggatgatgatttgttgacccaaacacagcgggagggaaaggagaaaccaactccgctcggaaagggagagaggaccacatcacagaagaggtcttgtgtagtagagacagaagaagtgtctcccgcgcgagagaagatctaagttc

SEQ ID NO: 649090 - DNA, 341 bp, Homo sapiens
atatgacgtggaaggggagtgagcagacactcgggaggtgtcttgagattatcatccgctgagggtggaaaggagagtgagcagacactcggaaggtgtcttgaaattatcatccgctgagggtggcaggggtgtgagcagacactcaggaggtgtcttgagattatcatccgctgtagcggtggaaggggagtgagcacacactcgtggaagtgtctggagattatcatccgcttagggtggaaggggagtaaggacacactcggaaggtgtcttgaggctcagggcgttatgagttatcagaatgttgttgagttgcaggaggtggctgttggcccatc

SEQ ID NO: 649091 - DNA, 491 bp, Homo sapiens
  misc_feature (290)..(290): n is a, c, g, or t
  misc_feature (337)..(337): n is a, c, g, or t
  misc_feature (365)..(365): n is a, c, g, or t
  misc_feature (390)..(390): n is a, c, g, or t
  misc_feature (465)..(465): n is a, c, g, or t
  misc_feature (478)..(478): n is a, c, g, or t
cagtacaatcataacagatcacatatatgcttctccaagaaataacttgattccaaaacaagtaaaaggtcattcctatatagattcacggttttaattttttcctattttatcatgctctccttgtatcacaccctctcattgtttcttcaaattcaaaatttgtaatatttttgttttgagacggagtctcactctgttgcccaggctggagttcagtggcatgatcttggctcactgcaacctccgcctcctgggttcgggtggttctcctgccttagcctttggantagctgggagtacaggcacacaccaccacgcctggctaatttaaagncttattgtggttttaaagttgatttgancaaatgcagcctttatgactcattnaaatgtatcacttctagagacccatctgagattgatactcagaatgtttactaatggtaatagaaagtaaaggtnaccctagcaacancaaaaaaagcaaa

SEQ ID NO: 649092 - DNA, 366 bp, Homo sapiens
  misc_feature (165)..(165): n is a, c, g, or t
  misc_feature (212)..(212): n is a, c, g, or t
  misc_feature (240)..(240): n is a, c, g, or t
  misc_feature (265)..(265): n is a, c, g, or t
  misc_feature (340)..(340): n is a, c, g, or t
  misc_feature (353)..(353): n is a, c, g, or t
tttgaaacatagtcatttttggctgggcgtggtggctcacacctgtgatcccagcactttgggagcccgaggtgggtggatcacctgaggtcaggagttcaagaccagcttgaccaacatggtgaaaccccgtctgtgctgaaaatgcaaaattagcctttggantagctgggagtacaggcacacaccaccacgcctggctaatttaaagncttattgtggttttaaagttgatttgancaaatgcagcctttatgactcattnaaatgtatcacttctagagacccatctgagattgatactcagaatgtttactaatggtaatagaaagtaaaggtnaccctagcaacancaaaaaaagcaaa

SEQ ID NO: 649093 - DNA, 678 bp, Homo sapiens
ggccatgatctcagctcactgaaacctccaactcccgggtttcaagcgattcccctgcctcagcctcctgagtagtatgggactacaggcgtattcaccatgcccggctaattttttttattttagtagaaacggggtttcaccatgttggccaggatggtctcaatctcctgacctcgtgactcgctcgcctcagcctctgaaagtgctgggattacaggtgtgagccactgcgcctggcctatatgaattttatatttacctgctcccttcaccaggagatcatgctgctgtgatgtcgagttttcttaacagcataaggaagacttgccctcttgccctatcaaagagaatagttttggaggggagaagtgggaccaaaaaagatgcagttttcatttgtattgggaaatgtgaaaataaaattgacaactcttttagttaaaaacaacaacaaaaaaggaaacgagatgtggggctgccacacgcaatatcgtgcattaaaaggatcttctactctggatgaaaatatctttgctgatgccagaccaacctaacacaaagaccttttggttttttaatgtgactgtgttttattttacaatgtgtaattcactttagaagggcaaagtacctgtctggggaagactatttaatttcctgtatttatttagaata

SEQ ID NO: 649094 - DNA, 365 bp, Homo sapiens
tgagccgagatcacaccattgcactctagcctggtgaaggagcaagactccatctcaaaaaaaaaaaaaaagggagggaaggaaaatccccctttcgggggggccaaaaattaaaaaccattgttcctcccccacggtttttaaaaaatactttttaagggccaaatttgggggttttggccttaagggaggatttggaaaaggggttggaattaaaagttttgtggaagggtttaaaaccataaactttcttaaccctccagaaggttttttttttccaggcccaagaggtttttaaacccccggcccattttacccaaaggtttccctaaggccttttaataataaaccggtccccggcctca

SEQ ID NO: 649095 - DNA, 626 bp, Homo sapiens
gtggaactggagatgctaaagccaagataagaaggcttaggcaggaatgggaggaaaagactgagcagttgtgggatgtaaacaagaattgagcaaatggaaatagaactcaaaaggctggcaacaagagaacatgaagttggctttcggagtgctcgctctgccagaatgtaccgagatgaattagatcgcacttcgagagaaagcagtcagagtcgataagcttgaaagtgaagtcagcagatataaagagagatacatgatatcgaattttatcaggcaagagtggaggaacttaacaagaagacaatcaagttttattgagaaacaaaaaccagtgtgggaagaccaactagagggaactcgtgctcgtgctgataaattacatggacttagacaaagagaccttacaagctgaaagctaaacttcatgatatggaaatggaacggagatatggctagaaccaacagatgtgacgaattactggaagacacatatgacttctggacactggcacagaaacaaagtatggatgaatcatcacatctctggtgggaactggaacagatatccagaatagtgaactttccgaagcacccagaaatcctgggcatgaggtgcatga

SEQ ID NO: 649096 - DNA, 592 bp, Homo sapiens
  misc_feature (237)..(237): n is a, c, g, or t
  misc_feature (481)..(481): n is a, c, g, or t
  misc_feature (581)..(581): n is a, c, g, or t
gctcttccagctccaccggcggcgcagcagggaaaggcgaaggcgaaggcggatcgtggagattcagccgtgaagcaagtgcagatagatggccttgtggtattcacgataatcatcacattatcaagaagaaggacaaggaactgaagcttgtgtcacggagtgcgttctgggatctggtgtgtagaagagtcggacttgagagattaccaagcgtgctttccgtttcacctcagncagcactcagaggagtgactgactgagcatcttgcatgagagatccaagtagtcacgatggagagatgattgcggatgccttcgacatgtaaacattgagtcactcttcacgtgaggctggtatcaggtccacattagctatggcgtcattgcgttacccagggacacatacctgagacatctcaggtttacgttaccgagtcattgcccattggagagaaatcgtgtccgagttctcgatttntcaatgaattcgcgcgaataagagaaacctggccacgaaggagacttcttcatctttctaccttaaaatgcgcttatttacgaagggaaaccttgggaancttccctttaa

SEQ ID NO: 649097 - DNA, 206 bp, Homo sapiens
acatctagagatccccacccgatctccattctggttacttggcatggtccctacatttaactaaacaagcaataataggtgtgaggtgatgtaaacctggctttcattcagatgcacaagcaaattctaattaggcccaccctctgttgaggttaactggtgtcttgtagtctactacaataaaggcagatccgatgggtaccgag

SEQ ID NO: 649098 - DNA, 769 bp, Homo sapiens
ggaaactgcgatatctactaaaaccgaacatacatatatatataccatgacctcacaatgccactcctacatgtatacctcccagaagtgcatgcctatgcataccaagggaagtgtgcaaaatgtgcattgtggcagtattaataatagtcaaagctggaaacagcctagatatctttctgcagtaaaatggatcagtaaatcgtggtattacatacaatagaaaaacaaaaagactacagctacttgcaactgcatggaagaatattacaaacgtaatattaagggaaccaagtcaaacataaaagggcgaaacagtatgattccatttatataaagagcaaatctagaaaacctaatctattgtgttagggatggatagttaggtgtaaactataaacaaaaagaaggattcgattattctgaacatttgaattgggctgggagtggtgtctgaagcctgtaatctcagtacttcggaaggctggagagggaggattgcttgagcccaggagtttgagacaacttgggcaacatgatgagacctcatctctaataaaagtaaagagctgaatgtggtggcatgtgctgtggtctcagctattcggaaagctgaggtggctggattggttgagcctgggatgtcaaggctgcagtgagctatgttcctggcagtggatcaagctgggcaatagaagacactgggaaaaaagaagaagacaaaaaaaaaacatttggcgggattgggccggagaatttttagaaacat

SEQ ID NO: 649099 - DNA, 394 bp, Homo sapiens
gtccttgcagagacagctcgtactgacgaagtgcatgcgctgaatgatgtacacggcagtcgttgaacacccggacggatattctcagtgtcacacagaggcagagtataaatgaagaggtagcagtagtgacgcccatctccactggcagtgctgatcctcagaaactacatctcgaatgaagtacttagcccgggtcatgcgtgggtcctctccgggctcgggagtagcatcctcaggagtagtgtagcgagcaaatactggaaagtagtcctcaaatctacgatttcccagcaaggactttctcagcgagcagatcttgcttgtagaggaacaggatcacagagatggtgcgcagccatctgttgttccagatgctcttgaagaggttcag

SEQ ID NO: 649100 - DNA, 111 bp, Homo sapiens
gatccggcacgagggcagaatccaaacccagacttttaaccccacatgctgtactgctactcctcatgtatcacaacgtgttactcattaattcacagtgtctccccagcg

SEQ ID NO: 649101 - DNA, 361 bp, Homo sapiens
tgaatactaccacataagtagtcacctttaacaattctggtgaaagtgggccgggcgtggtgctcatgcctgtaatcccagcactttgggaggctgaggcaggcagatcacaaggtcaagagttcaagaccagcctggccaacatggtgaaaccctgtctctattaaaaatagaaaaattagccgggcgtggtgcggacgcctgtaatctcagctactcaggaggctgaggcaggagaatagattgaacccgggaggtggagtttgcagcgagccgagattgtgccattgcactccagcctgggtgacagagcaagactcagtctggggaaaaaaaaatcatggggaaagtcactctcacc

SEQ ID NO: 649102 - DNA, 288 bp, Homo sapiens
ccatgaatacggatgcatgtttttttttggtttggtttttggtccagcctattttcttgttgtcccgtgttctttctaatgctggactgtctatgtttttcaatatgttaacaagtgtttagattctacaatatttgggtcataatcaattttatcaagaacagaattaatggccttcttgaagatggatcgtttactttttaacttcttaagttctttattttcagccatcatcaataaaaatattaatcgcctacttgaattcggactataggactacacatttaa

SEQ ID NO: 649103 - DNA, 195 bp, Homo sapiens
aactagcgtaagtaataggaataggacctgcggtgctatttattgtctaggtttgacggtaacttgagcagccatacatatacgcagtggacgtgccgcggcggcgattcagtacttcgcgcacgcttagaaggctgcaaattctctgcgaccgggctgcaacgtcgggagccacgagcgtaaagcgatttgcca

SEQ ID NO: 649104 - DNA, 315 bp, Homo sapiens
ctcatcacttagctctagacctgggtctcgacccgcctgtgcactgggtcctggactttctgacgggccgccccaggtggtgagggtaggtaacaacatctccaccccgctgatcctcaacactgagccccacaagggtgcgttctcagccctctcctgtactccctgttccataatgactgcgtggcaatgcactgcctccaactcaatcatcaagtttgcagacaacactacagtagtaggcttgattaccaacaacgacgagatggcctttcagggaggaggtgagggccctgggagtttggggcgttaaga

SEQ ID NO: 649105 - DNA, 307 bp, Homo sapiens
cgcgatggaagccacctcccacccgactttgagggcctccagacggtcagccagtggctgcggaccctgagcggcatgtcggcgtcagatgagctggcgactcacagtgcgcagagctgtcgacctgagcagctacacgcttcaaccgtcctgatcctgacccgggcactagcccttgcacagaagggcagagtctgaggcgatggctcctggtcccctgtccgccacacaggccgtggtcatccacacaactcactgtctgcagctgcctgtctggtgtctgtctttggtgtcagaactttggggg

SEQ ID NO: 649106 - DNA, 236 bp, Homo sapiens
  misc_feature (2)..(2): n is a, c, g, or t
tngtatgggggcagatcctcatggatagattaaccccctccctggtggggtgagttctctgttccaatgagagctggtgttaaaaagagcctggcacctcccttcctttctcttccttttcttgccatgtgatctctgcacacacaagctcccctttgctttccaccatgagtggaagcaggtgtgaggccctcatcagatgcagatgcccaatcttggacttggcaaccattcag

SEQ ID NO: 649107 - DNA, 138 bp, Homo sapiens
ctgtccctctctcacggaagaatgaataaacaaacttggtgctttcatttttttcttcttcttctttgagacagagtttccctcctgtcacccaggctggagtgcaatggcacgatctcggcttactgcaacctccgc

SEQ ID NO: 649108 - DNA, 573 bp, Homo sapiens
tgccaattgacgtgatcgcgtctctaccccgagattttcggagccctactgtcgcgttcccggggccccgttggcgcccggtcccaaaatctggggttgtcccccgtgtacaccccgggattatctgacacgcccttccgtgtgccggctttgaaggaactttttcgcgtcggacaactccgcccggtcttaccgtgtgcctttccccccgcgtgggatttgggacccgatcgcccagagactttctaacctactccctattaccacctattcaatggagggttttgcgtatccgcaacttgcccccccccctgcgggtctcctaggcaaggtcgtcgtcccccctgtggtcttacccgcctccacttttgtccccgcatttattaccactctttcttaagattataatatgctgccgcccacccaccttatcggggttccaccctctcctcgctctttttctgctaaaacttttcttgggagaacactttttttctagcaccctcctgtgccgcgcatcaattcatcgttatacaaaaagaataaaacagcaccaacaaatagatcaaacaa

SEQ ID NO: 649109 - DNA, 114 bp, Homo sapiens
aatgttggccccatcctatgaaattagagcagtggggaacaaaaacaggcagaaattcatgtgtgaggtatcaggtgaaatggttataatatacactgtcatgggtcctacgtt

SEQ ID NO: 649110 - DNA, 798 bp, Homo sapiens
gcgccgggcggaggccctggacgtgcgggggcctctcctgggtcggcggccgcagcgcctcggccctgccctctagctcccgcgttcgctcctgccttcttggctctcggggcacagcgcgcggcccggtccggagcagggcggacatgagcgccaagcagagcggctggacgcgctcacgggcacgcgcgcgtactcggctcggatctaccttccagtagcagcggagtggccaagggaccgggaccagagccgggggccgggggccgcgccgggggaggtcccggccaggtgcccaggctcaccagcccgtggggccgcggggccccgcagctgtttcctcgggggggcgtggcgtcgggggcctatcgcggcgcagtcctctttcagcatcccgaacagcagcagcggccgtaggaatcgcaggactcggtgcacagcagccctgaggatggggggcggcggaccggcggtgggctgagccccgggggcgtcctggtgatcggtccttacagtcacctctcaccgcgcatgttgaggtacggaccctctcaaagcgccgcgcccggtcataccgcggtgccgtgggcgtggccgacggaatttaccgtctcctaaaatcatcgccggaccggaggtgctacggcaagcggcggttcaacgggaaaaacggctaaaccggggggagcgggaacacggtggtcaaatagcgcccccgggccaaagagtatacgggggcggaagcttaaacccaagaccggggtgcaaacaaggtaaacacacaaggcacacaaccaa

SEQ ID NO: 649111 - DNA, 492 bp, Homo sapiens
tctagaggatcccgaggagatagcaggagacatatcatcaaacataaccattaaaatgtagtggtttgcttggctgtaatttgcaatagtatttcattgaggacaaagggtaatgcatcaagtgatagcttaggttagctgatgtctgttttaactggccgtcatattacaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttc

SEQ ID NO: 649112 - DNA, 663 bp, Homo sapiens
  misc_feature (187)..(187): n is a, c, g, or t
  misc_feature (215)..(215): n is a, c, g, or t
  misc_feature (253)..(253): n is a, c, g, or t
  misc_feature (255)..(257): n is a, c, g, or t
  misc_feature (293)..(293): n is a, c, g, or t
  misc_feature (486)..(487): n is a, c, g, or t
  misc_feature (536)..(536): n is a, c, g, or t
  misc_feature (654)..(654): n is a, c, g, or t
ccgcagcattttaccaatagaaaggggccgcctatggatcaaatcaaaaatatcacccgctgcacaccttttaccaaggcattcccgccaacccactatcacctttcaacacctctcggccgtgattgattctcccactacctccctgtccaacttatccaaacgtttttattggtgggacgcgccnatacccccacacccaatttttcacatanaatctttcacctcgtttaggctacttacccttcacaancnnntccatcatccctaaaaaaaatattaactggtgcgtncatgataaggtgcgccaacttccgatatttctctaagacctcgcccctgccattgtacgatttcttgcggagtcctccgccccattgggcaggtctccacacatccccgatttacctatatcccttttattaacgccccttccctatctgaatctgggcggctccacccgctctttttccctgatccaggctnnaaaagccgccccaccctttaaaaaggccgccttaccccattcttatccntatataaaaccctctttacaaagtcttataataaagcctaaacatatccaaccctctatatattgtaactcggcgaggaggtgcttattttacaaaagcgcctcttgcaaactcttcnatcccctct

SEQ ID NO: 649113 - DNA, 184 bp, Homo sapiens
ctagtcaccctcacaagagtcccagcgcttaccagccaaggacgagggcccaaggctcagggaggagcgagttgctgtcccgcagccacacggccgcccggctgggcctctcaggtggccccgtgtgccccccggtcgtggccccgataccaggtggtgttaagagactccaccctctcgcagg

SEQ ID NO: 649114 - DNA, 433 bp, Homo sapiens
  misc_feature (1)..(1): n is a, c, g, or t
ntttgctatacaaagctctaaatatgactactatgtcgtatctgtgggagcgatcaagccttatggaccggatgggtgatcataaaatggccatggatggtataggcgtatttaaaaccttttggtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaatggtgctggaaaaaaaaaacttcagaagagggcacctcagaagagaataaggctcctgagaatgtaatctgcactatacctgatggcg

SEQ ID NO: 649115 - DNA, 362 bp, Homo sapiens
  misc_feature (356)..(357): n is a, c, g, or t
  misc_feature (359)..(359): n is a, c, g, or t
tcatccttaaaagaactcatggaacccttaaacattgcagcccagatttcccttggaggtctccttattacagaaagccgtagacccatgtgcagtggcacacgcctgtaatccccagcactttgggagggtgaggtggaaggattgcttgagcccagaagtttaagaccagcctgggcaacatggtaagacttcatctttacaaaaaaaattaaaaattagccaggcatggtggcatgcacttgcagtcccaggtactcaggaggctgaggctagaggatagcttgggctctggattttgaggttacagtgagccatggtagcaccactgcactctagctgggtgacagggtgannanctg

SEQ ID NO: 649116 - DNA, 173 bp, Homo sapiens
ccgcttctgcttctgcctcctgcttctgctctgcttcctgcttctgccccaggtcttggtgaggtttttaccatcacaagtgatgatacaatctggcttggccattgcgcccgtgcttcctgcttctgccgtctcttcaggttcttcttcgggctcttcttccacctttgcat

SEQ ID NO: 649117 - DNA, 141 bp, Homo sapiens
tatcatcctccttcaggcaactggtggtcccccgctcacgggaggtcaccatattgatgccgcacttcgtgcgtataccgatcggatagcgcactacagccagaactcctggacacacgcgatcctccagactcagcctcc

SEQ ID NO: 649118 - DNA, 311 bp, Homo sapiens
  misc_feature (44)..(44): n is a, c, g, or t
  misc_feature (126)..(126): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (309)..(309): n is a, c, g, or t
ttggaagctgtgtcgcctgcaccaggttcccacggctcgtgtancggtgcgcttctggtgttcgctgcctacagccgacacgtcgagcttcgtgcccctagagttgcgcgtcacagcagcctccgnctaccggattatcaccgtgtcatccacatcaatgaagtagtgctcctagacgcccccgtggtgngntngggcgcggttggctgacgagagcggccacgtagtttggcgctggctcccgccgcctgagacacccatgacgtcttcacatccgctacgaggtgggacgtcttcggccggcaacgnca

SEQ ID NO: 649119 - DNA, 323 bp, Homo sapiens
  misc_feature (35)..(35): n is a, c, g, or t
aatccactttgtctaaatcttttgaagtcagactnttgtctcttctctttccctatggcctcttataatggctattctatataatatcctgctataaactctgacttttataagttgcaaacttgtagtcctgtaatggaacagatggcttgggtttatagggccagttctattgttgggtttgtgaactagttattagacttcattgccgtttttccattctgactttttttcttgtcttccttgggtgagaattcgtcttactttaaaactttttttatcccatggaatattttttgtctaaggtataggtataaaaaaaa

SEQ ID NO: 649120 - DNA, 134 bp, Homo sapiens
  misc_feature (117)..(117): n is a, c, g, or t
ccctgtacttaggttagtcattaccagcacagaaattgtaaccctgaatacttactttcatggactacactcaacttcttaacttctctggctactctaaggaaaagctaaagagantatgtggtaaggaataa

SEQ ID NO: 649121 - DNA, 685 bp, Homo sapiens
gcaacgcgctggaggcgggagtgatctgcgagcgaaacctacaccatgtgaggccgggctgggcttggcggggccgtggagatggaggtggacagtttagctgaataacggtcgaaatggggtgtttttatagctgagggtagagttcctcgggcaaaagtaatgtttttccttctggggtatttgagatcgggcttggggcctcgctcggatcttgagttccggagaggggacagctttattccataacgggcatgagactctccgaggtcctgagtcttgtggaaaggaaccataaagggaaagctgagtctgatggcacatgcctggaatcccaggcctcgagaggctgatgcaggaggttcgctagttggccttggccagcttcatagcgagaccgcttccaaaagtaatagtaattttaaatggaagtggtcttatgaataaagagcttggcggggaaggaagaactgttagaaatagtgaaaagtatgggacgtaaccaggataaattagagaacctaactagagactgtcagagtagcagggtactacagtggtttggtgcgtgtttattcattgagcatatactatgtagactgttgtaagttaagacacatggtaaataaaaggtccttgctccaagggggtgggggaatctccctggtgcttgtaaaaagagtgg

SEQ ID NO: 649122 - DNA, 109 bp, Homo sapiens
gcgttgaggtgatctagaggatcccgaaaattaccaagctgtggcacgtgcatgtgtccagctactagggaggctgagatgggagagttacttgtaacccaggaaatgg

SEQ ID NO: 649123 - DNA, 178 bp, Homo sapiens
tttttttgcttgcggtgtgcagggatggcgcggatatccgtgcgagtggtgcggcacagccggcgatcaatagtgcgccgagcgcgcgctactcgactcgcctgatcggccaggctgccgtgcgtctgcgcgcagggatgccacggttttgctcaccgtatcgttgtgctcgccggag

SEQ ID NO: 649124 - DNA, 238 bp, Homo sapiens
gaaaagtttgatgtgacaacagtccggtccagatctgacgaagacggaactcgctggcatcaggcgccgacaattcctgttgtatttcccagtcaagcgacagcgccacctgcgctttgccgccgaccggaagatcgatgcgacgggccgcacttgccagacccggtggcggcggtggattttcgtcgctcagccggatgaatgcaggagccgagggagctcccgccatcccgccttg

SEQ ID NO: 649125 - DNA, 250 bp, Homo sapiens
aaatagtttcagagtataggtctagcacatccctgtcaaaagtatcccttaattttatgctattataaatggtgtcataaaatttccttttttccattgtttgttagccagtatatagcaaatacaactgcatttttctcatcatagcactttgtcatcctgagcctctcctcccttgctttgcaaaattgaatttcaaaagagcaggaacctgcaaaatttcaagcaagcaggcaactggccaagttcc

SEQ ID NO: 649126 - DNA, 136 bp, Homo sapiens
taacattgcggatgcggttgcttgcgtgaggaaactacttcatggcagcttctgtggcaacgagggtttatttttttggttatgaactggaataataacgctagcatgtttatttctatggcctactcatggtaaa

SEQ ID NO: 649127 - DNA, 926 bp, Homo sapiens
  misc_feature (197)..(197): n is a, c, g, or t
gatttttgtttctttccaagccaaaaataaggcctggcaccatggctcaggcctgtaatcctcaccctcctgagattagcctgtggcattactgtgtgtgttccacccccagcactgctgtataatttaatatttttaagcgttgatgaaaggcggttctcatccatggttggccacgtgctaggtctagaattccntgtagccttcgatgtgagtctgcaccagctcgttgggttctcccagaaaggtgttggggaattagcaggcatgacgccactcgttgcccatggctgtacacattacctgttaagagcgttacctctcagaggtctagattaacgagaaaaagccccatttgctcccattcctttttccatagttccttgaaaggatcctcattcctccgaaagaagaaatttcacgcgctatcacgattatgtttatcttaagctatcgtggtatcgattttacatggcctttcaggttttttgggggttatacaagggttttcgtagcattaagtatcgattaatcacaggccgatctaattttgcgagacgggttgttttgtcaagcttatacctattttaaagacagggtagaagaatctcgtgttgagtgggttctcaacatgtttcttgcataatattataatttgggggtgagattcattgttagccgtgttttttgcagtagctggtgattcaatactgtgttaatgttcacatctgcgagtggagattaatcttaaggtcgcgttaactatttgaccatttttgcatacaactggttgtggttctatgagaaggttaaaggactctttaagtgtagggagctgttgtatggcagcattcatggtattgcttccccaaaacaggtcccaagattaaattttgggtcaacaacttttgtttgtggaaagaaac

SEQ ID NO: 649128 - DNA, 707 bp, Homo sapiens
gctgcccaggggcattattcgaattcacctggtggctgctgcgagggctgagttccaaggacaaatatgtgaagggcctgattgagggcaagtcagacccatatgcacttgtgcgtttgggtacccagacatactgcagtcgtgtcattgatgaagaactcgaacccacagtggggagaatgacttatgagtgtcgatggtacacgaggtcccagggctaggacgattagaagtggaggtgtacgacaaggatccagaatacagatgacttcactcgggcagaatgaagctggatgtagaggaaggtgtaacacggctatcgtgctcggatgatctaggttccctctataaggtgggcaagggccatacgttgcactctgaggctagaagtgggatgtcacatttggtcaggatgcagagaaagctgggagcaggttgctagcaagtggtaattggggagtctccgtctcgaccagatcccgccgtcagcgtgccatcattagttgtctacctggatcgggcccagagagcttgcctatggtgacctctgaattgtacccaccacagctgaagaacggggaacaaggaaccccaaccctatggtacaactgtcaaatacaggactgagactcaggagagcaaggctgtctaccagtaccaaactgcccagtgtgggaaggaagcgtacccaggactccgtacgaaga

SEQ ID NO: 649129 - DNA, 837 bp, Homo sapiens
tgaaaaaaagtcatggaggccagggggtgggtcttgaaaaccagtcttgggggggtccaatccctcccttttttgttctcaaatttataattgttatccgggtcactccaaatgtggtgggtaaggggggggggcatccccataatatatagtctccactcccagggtttaggtggggggcttctctcatactaattaggacttttccgctctcaaagcgaaggcttctcaaactcagtgaaaactattaaattataccggctgttagaaaaatgaatgaccctacagatgaataaggagtgatccatggtgggtgttatgtgccattcggggatagcccgagaataaggttgcggggacatccgcggaaatggcccgaaaaaagttgttgttgtggggcaacaaaagtttaaatttatccgccccaagtaacattagtcacgtaggcagaaagtgcatttttggggcataggttttggggtcataggggtgatacccgtagacaaatggggggcaaactcgagaggaaagtagaaaccccccgctagtgtagtggcaaaaataacagcctccttagatggaaaggcacataggggggacaagttgacgctaccacacgatagtaagcgggcccgtgaaacaacacaacggtacaaaaatgaagagagattgggcaaaataccaggtggcccggttcaggccaccctagggggtaccacgacagagaattccaagggcccaaaagacctggcgagaacacatacatatggctccgagaaagtgggcacaacagcaaaaataaaagccggtgggaaagcaaaaaacatgagacagcag

SEQ ID NO: 649130 - DNA, 237 bp, Homo sapiens
gccggcggtcgtctacaggatcccagttcggtccccactcttaggtatgtatacgtaatctgtccctaagtaagttcttccgctcctttgtatcttcctttcgtgtctttcctcctacctttgtctctggtgtttgggacttttttttttttttttttttttttttttttttttttttttttttttttttttttttttttttttttttttttttggggggggggggggggggggggg

SEQ ID NO: 649131 - DNA, 150 bp, Homo sapiens
ggggacggaagagaggggatcatgggacagggaaacagtagttatattagtagtattgtgggtaatagataaatttgggtgtctaacctgggtacgagcccattagctgccaagagggaataaggaataaatttcaaaaaaggtacactt

SEQ ID NO: 649132 - DNA, 1726 bp, Homo sapiens
taaaacttgaccaattaattcaaaaaattcaaattctcggttgggcaaagtattatccgggggcagagagttgggcgatcaattcatgtcattgggcaacgcaatccactatttacctcacaacggaaatcggcctgggggtcagtactcctcgagaggcaacaggcaaaactttttaaacaccacattgttagctagtgtgtgggaggggtgacataactcaataacaatatttgtgcacagaggtgtcactaaaaacaacacaaccgagctttattacaacccagagggcacacaaaatagtgcgtaagtgcgtaatataactccctttagattcgacatttaaacgcctcaaaccgacacacttttaagagttacctataaatgtgtgcgtgccagagcagacatgtggcgccctagtgcgtgccgagcgaggggtgtgcacgcgtgtgcagaaattaacaataacacacacccgagagacgagtgcgaaacgtcccctctctatcaaaagagaaacggtggtattaccactctataagtctacaagacacgcgaccatatccaacgacagacatgtgggttgctatatgcaacgcgtctcacacaaagcgtggtctccgtgaagacacccagtgggcggagagaaagaaagacaagtgttatacactctcactatttctcacgacgaggggcgtcagacaacgtctccgcggagaaccccccattatgacaaaacatctgccgcgggaacaactacatcgcggggctgacaccgggaaacaggccgtgactattagacaccccgcgggctacaaagcgtaccaaacacacggggggaggagcctcacaacagcgacacttttgtctcgccgggggcgaacacccagcacggtacacaaagggggggccacaaagttacccctccagaaggcggggcactctaaaaaacacgtcgggccagttagaaacaggggcgcagaaccaaacacaaggctactcaccacaaacaggggcggcaaattcgcaaaacatagatatgacacaccacaatcttgggactcaacgacgcgccaaacgcataaatacagaggcggccagggaccatatgtatacgacaacaaccacagatactaacacaatccaacagctgactatcgtagacacacgagaaggggcatcaggagaaccacacatagaacaatcggaggacatacaccaaccgcgccaaaattacgccaaatgatgttagtaaggagcgtgttacacaacacggaccgaacaccgcacccgtgggtaggcggcatattacataacgacctgtataagacgctcagctgggaaaagcccgacacactgatggcgcgcaacaaggtgcggaaacagcaacgaagaggaacaacaccacaccggcgcactagaccgacgggccgctcggtggaccactcaaagtgacacgaaacacatggctacagactatgtgttgcgcaagtataaccaagcactcagtctgggaaacatgccctgacgtatgtgaacacacagagccagcgcgagcgaccacaagagcacagcaggcgcagctgctcaccgagcacaaaagtaaggcgccagcaacacacataaacgtaggccaggagtaccgacattgtggaagagacaccgataaacaacgtagaagaccaacaacgcaacgagaacacacaggagaagcagggtacagcga

SEQ ID NO: 649133 - DNA, 270 bp, Homo sapiens
gtctgttttattttaaaaaacaaacaagcccacagtggagcctgtcccctccaggagggggttaagggcccccccttcctctatcacccccggaaacctttggttttgccctggaagacacccggaatttttggacattgacaagcccttttccttcctccctccccgggaggtggtttttgttttactccccccctttttgatccatgtaaatcatattatgtgagaaatcatttgcctgaaaaaagactttgtggggatttttgggga

SEQ ID NO: 649134 - DNA, 621 bp, Homo sapiens
gctgtatctagaggatacccagctttccgattaggtacgaacactcagttaaataagaatttcagataaaaaacaaataattgtccgggataagtatgtcgccaatactgcacacaacaacactttaaaaaagcccccttggagtttctgttgcagtggaaacaaatctgactaggaaccatgagattgtgggtttgatccctggccttgctcagtgggttaaggatccggcgttgccgtgagctgtggtgtacggctcagatcccgcgttgctatggctgttgtgtaggctggcagttgtatctctgatttgacccctagcctgggaacatccatatgccatgggtgcagccctaaacaaacaaaccaaaaaaccctagaaaaaacaccttatgtactattactatttttctttttcagacccacctacagcacatggaagttccaaagccagggatcaaatctgacctacgccatggccacaggagcgctggatcctttaatccaccatgctgggccagggattgaaacggcgcctccacagagacaagccagatcattaacccactgcactacagcaagaactccccacccttattgaaagaatataaaatctgaatc

SEQ ID NO: 649135 - DNA, 291 bp, Homo sapiens
  misc_feature (13)..(13): n is a, c, g, or t
  misc_feature (81)..(81): n is a, c, g, or t
  misc_feature (114)..(114): n is a, c, g, or t
  misc_feature (242)..(242): n is a, c, g, or t
ttttgtatttttnagtggagacgggccttcaccacgctagccaggatggtctcgatctcctgacctcgagatccgcctgcntcggcttcccaaagtgctgggaccacagatgtnagccactgcactcagcccagagccatgctcttgaccacaatgctattaacagaaactagtttattacattaccaaaaattgtaatacaattacactgggaggatggggaaggaagcatgtcaggggtnggagtatagattttcctataattcctacaaccagaagtcaaatagatgt

SEQ ID NO: 649136 - DNA, 570 bp, Homo sapiens
  misc_feature (280)..(280): n is a, c, g, or t
ggcccctgtggccaaggaccagttgtggttacccgtatcattgtgtgggacatcatggccttcaatggcatcatccatgttttggacaagccccctcttggcacccccacagccccaagttgttggcgcctaaagccccacctgtgtcggcaggcgtgggggctgtgctttcccctgaaacacttcttggtttggtggccggagctttttacctccgtgcccaaggcaagcccacgggctttggtttttttgccttccaggcggaaaatgatgtttatgncgatttttccccgtggcaaaaagggaccaacccccccttggtttttgtccccaaccctttttttggcaacgaccccttttttgaacccttcgatgactccctgttggaggaggatttcccttacccccaaaggttcctcccattcaatttacgaggctggggtttaaaacaaaacgcatgcccagggaggagcccccttttttttcttttttgggtggatggggcagaaggggtttagggcctttcccaaccaataaaggtgccctcaccggatttgggccttttcccca

SEQ ID NO: 649137 - DNA, 324 bp, Homo sapiens
cctctgatcagggtgagcatcacactcaaactacgccccgatcggcgcactgcgaggagtagcccagacaatctgatatgaggtcatcctaggcattcatcctacctatcaagcattactaataagtggctcctttagacctcgccagccgtgtagtcatcacagacatagaacaccgctgattactccgtgctcaatcatgaccgctggccgtaatatgatttatctccacagctagcagagagcaggcgaacccccttcgaccttgccgaaggggagtccgaactagtctgaggcttcaaaatcgaatacgccgcaggcccc

SEQ ID NO: 649138 - DNA, 843 bp, Homo sapiens
  misc_feature (591)..(591): n is a, c, g, or t
  misc_feature (828)..(828): n is a, c, g, or t
agcggattgcagactgcgagagtcagacggagctatgtacgccctcttcctcctggccaggctcctgggccggcggctctaggccggcccggtccttggagctgaaacgaatgcaccaggggctcgggagctgtggtgccaagaactgtcgaacgacaggcgtccgaactgcggaggctaagtgaagcacgtgccttgcagaccgtatgggagactaaggccaagcagggtgaacattgcccttgcgcctggcgagcgatactgcgaaagaccgttcgtcactcgtccagtctgcgtggatcatcgcgtgcagaggcaccaatggccacatgaacggcaggcaggatccagttgctctgtacgttggcaggaaggacactgctgacgtggctctccgcaacacccgcagacgagtgatcctgcgttcgatgcagaaggagatcagctggcacttcgctatcatcccctggtcgatgccgtggacgagtcattgaacaggagataatgaggcgcgtcctggcgggatggtgctagtcatctggcttctcatagcttctagcagagtcctcgtgcgcagaagagcaaccgtangcagaagctgaaatcgagccagaagagcatggctgtgagtccgaatacaggatcccaaggatgctaggacctagtgagatgaaggctgggatggactccctttcagtgggtcaagaagtcccaatcatctcattccgtctagtccatcagggacggggccgccgtaatgcaatgccctccagccagaaaggaataatgggggacagttgagcgcaggacatgcaatacagcattggntgactgacactccag

SEQ ID NO: 649139 - DNA, 269 bp, Homo sapiens
acaggcttgtgaccaacatacacggacagtgggtctggaatggtgtactgctgcaacatggggtgtgccgatggttgacttggatttaagtgaatctgcgtgtcatacatatgtgtaaatgtctgcgatgatctgtaaatgtgtcagcctgtgtattgaatagtgctgtaggctaaacagagaggtgggtatttttagatacccgtgtagccttcgctttagacatagtcattcctgcaataaaaaagtggatcccgcattcccctcca

SEQ ID NO: 649140 - DNA, 228 bp, Homo sapiens
  misc_feature (35)..(35): n is a, c, g, or t
  misc_feature (85)..(85): n is a, c, g, or t
  misc_feature (106)..(106): n is a, c, g, or t
  misc_feature (159)..(159): n is a, c, g, or t
  misc_feature (221)..(221): n is a, c, g, or t
atttctggcaatttctacagaaacaagttgaagtncctggctttcctcgcaacgatgaacacacccttccgaggccctacacttncgggccccagcgcatcttctngcggaccgtgcgaggtatgcttccccacaaaacaagcgagggcaggttctctnggacctcttaaggtgtttttacgggattccaccgccttacggacaagaaaaagcggatggtngtttctt

SEQ ID NO: 649141 - DNA, 506 bp, Homo sapiens
actcatttttattgatagattagttttcttagtgatttttgtatcttttattttgtaagtacaaaaaacgtatcagaaaatgataaaaccttgttcaaatccttgtttgtattgtttaccaggcgatgagatcgggtttcaacaattttagcaacgccacttttcctaacgggtaacacaccaagataaatggcgtcagagcgtcttttttatgcacagaaaaaccagtagaacacattaattaatattataactacatagcatttacttgggttgaaatggtgaaaccttacctggaactgcttattgaagcatagaaataggtgcacagtggaacccaaaaagtttatcggcaactttaccttcagtgtcttgataataaggcaaacgctagggtcaattgaagaagaatttctgttaggtaaattaatagtgtcattggtattagtagaatattacccgtcgaaatagaaccaactatcgtctatcgactaatattcatactg

SEQ ID NO: 649142 - DNA, 408 bp, Homo sapiens
ggtgacatgcagctcgtctctgatgcctcgctgtagatgttcagacgtgttggagtttcttccttctggtggatttgtggtctcactggcttcaggagtgaagctgcagactttcacagtgagtattacacctcttaaggcagcgcgtctggagttactcattcctcccatgggttcatggtctcggtggcctcaggattgaggctgcagagtttcacgaagagtgttacagctcataaactcagtgtgtaccccaagaatgagcagcagcaagttatctcaaaggtcaaaaaaacaaaagtcccatagcgtgagcgtggaagagaacctgagccagttgccactactagcgcaggcagcctgtttttattcccttttctgaccccacccaaatcctgctgatgggcc

SEQ ID NO: 649143 - DNA, 170 bp, Homo sapiens
tcgagccggtcctgctgtggtcagaataggccgaggtaaacactcctggttcagcatgactcagtgagtttggagcacacatgcacaattctactcattatgtaacctggttgtgtaagatcatacttggctctcagccactattatgtgttaggagcgggggaggaggt

SEQ ID NO: 649144 - DNA, 198 bp, Homo sapiens
ctgggcaacattttcaaagctcatctctatgaaagaatacaaaaaattaaccgggcgtggtgatgcacgtcctgtggtcccagctacttgggaggctgaggtgagaggatcgcttgagcttgggtgaggtgaggctgcagtgagtcctgatcatgctgctgcactcaatcttggacaacagagcaagaccctgtctca

SEQ ID NO: 649145 - DNA, 285 bp, Homo sapiens
aatcgggctgggagtcatatctgactttaatcatagtccgtccactgatagtcaagagaccatggtcaatgatattaaacctctttgaccctcagtctcatgcagactaccatacagaatgagtacaagaattcaatcgacactgattataaagcactttgcatagtatctgagacatggggagtaagtgctcagcaaatggggactatccaatgatgatggtggcttctaaacgctaatccaagcctcaccccactactaggcctcctcctaatgttagagata

SEQ ID NO: 649146 - DNA, 720 bp, Homo sapiens
aaaaaaataaaaaaaaaaaaaaaataaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaacctgggggccggcttggcccaagcggcttttagattggggaaggttttggctggggcccgaatttggggctaattggccaatttccccttatggggggcggtttaaaattcaatggccggagttttaaaaaggccgaactgggaaaacccggggggtacccaatttaaacggcttggaggaaaatccccttttcccaagtgggggaaattccaaaaggccccgaccggttggcctttccaaaaattggccaaccttaatgggcaagggaaattgtgaggcgtaaatttttggtaaaattcggggtaaaattttggtaaaccaagttattttttaacccaatggcccaaattgggaaaatccctttataattaaaaggattccccggagaagggttggacggttgttcaagtttgaaacaaggaccccttataaagaacggggccttcaacgggaaaaggcaaccggtattagggcctaggcccatttaggggaccattcccctaataggtttatggggccagggtcccgaaggccctatttggaacttaaggggacccccgtttaaagagtttacggaaaggccggaaacgggcggagggg

SEQ ID NO: 649147 - DNA, 345 bp, Homo sapiens
tgtagcaggccagagcaggcccagctggtttcaagcctggtagccggtctagctgtctttgaaatcactgccttgtaattttctaaaaacaggtactgagtataaaacaatataaaacaatatgagaaggagtctctcttccctcaagagtgtatgacttagctgcccaggatgatcttgaactcctgacctcacgcaatataatttcttcccgactacagcctcccaaagtgctgggcattaccatcctgctccactaagccgagccaggcctagtcttatttttctagaataagactaatacctcagaaaaagacccctacatcactcagaaacgtaactatt

SEQ ID NO: 649148 - DNA, 203 bp, Homo sapiens
ggcgaagtgtgaagctatgaacattgctggtttgaattttttacagtgcagaaatgtaaaatgaaaaaggatatttccgtttcacgagtgttaccgacgaagtcatagataattgtcgtttgttccttccagcattgtaggcatatacttactttaatcaagtaatgtgttaacacgctgacaccgtgtggttgcgtgtgaca

SEQ ID NO: 649149 - DNA, 900 bp, Homo sapiens
  misc_feature (159)..(159): n is a, c, g, or t
  misc_feature (202)..(202): n is a, c, g, or t
  misc_feature (223)..(223): n is a, c, g, or t
  misc_feature (236)..(236): n is a, c, g, or t
  misc_feature (246)..(246): n is a, c, g, or t
  misc_feature (258)..(258): n is a, c, g, or t
  misc_feature (262)..(262): n is a, c, g, or t
  misc_feature (273)..(273): n is a, c, g, or t
  misc_feature (282)..(282): n is a, c, g, or t
  misc_feature (287)..(287): n is a, c, g, or t
ggcaggtttcgggcttcaggacaattcgtgatggcgggggctggttccgccgctgtatcgggggcaggaccccggtggcggggcccacaggccggaccttttcgccgaagggctgctggagttcctgcgacccgctgtgcagcagctcgactctcacgnacacgccgtcagagagagccaggtagagctccgggaccaaatngacaacctagccacagaactntgccgcataaatnagggtcaganggtggccctggntctngacccctattntaagagctncttantgcccggcgacgccgtggtctggtaacaccatcctaacagaatgctcaggaccggacttgagacggctaaaccacagttgtgtgccaggaaacagccgcagggagaggcaatgctggtctgcgggaattaccccccctggctcccccaggcaataacagatgagcctatggacttcagtaagctcaagtactgttccccagcctgcttgtttcaacagactatgcaaggatcctaggagaccagtccccaatagaccttcaggacttaaaaggggagcgtaacgtttgttggacgcactccgtttacccaatttatgtagggggcccaggagacttaacagagcagaatgagtccaaggactacattaatatggtctggttctgtcacaaatgagctgagctctacttttctaggcgtacgtgggttacttctcagaatagtaaccgaggcgcttgatgtaatgccggtaatgggcggcagagcctcccgtatctcatctggaacgggtggagcgcagaagatactgccctttgcgggtaccgcggggcttatcataaaaaaagggcgagataggcgggaagttttatcctcgttttgttatattgtagatat

SEQ ID NO: 649150 - DNA, 417 bp, Homo sapiens
taaatctagaagtattatagaatactcattgaactaattctactattgaggaatttgtaagagtctaacataggcttagctacagtgaagtatgcattgcttttgaagacgagaaaagtgctagaataaatcagattacagagaaaatttgttgttacaaccaagtgatttccagctgatgtatctcatattttttacaacaaacattatagaggtgtcatttatttacaataaaatgttcctactttacatatacaattcagtgagttatgataaattgatatacccatgtaaccaacactccagtcaagcttcagaatatttccatcaccccagaaggttctcttgtatacctgctcagtcagttcctttcactcccaattgttggcagccattgctaggaactctatcactata

SEQ ID NO: 649151 - DNA, 180 bp, Homo sapiens
acaaagcctataaaataaaaaattataacaaaccctgagaaccaaaatgaacgaaaatctgttcgcttcattcattgcccccacaatcctagtgcctaccctgccgcacgtactgcatcattctaattatcccccgcatattgactgagcaggatggagggtaccgagcatcgaaattcg

SEQ ID NO: 649152 - DNA, 134 bp, Homo sapiens
agttatctagagatcccgccgtgtagcgctcaaggtcggcaaaactcttgattatccggcggcggggacggattgtctcgttcacaccagctctgccagacacaggcgcagaggggcggggctccctcaagctg

SEQ ID NO: 649153 - DNA, 170 bp, Homo sapiens
aggttgattccagtttacgcagtgagatgtggaggcggtagtggagtgggggtgtagagggcagtgcagtctgcttatattcatgcaatccaggattgcatcagctaggccattcaaagtggggcaacatgcatcagcaagggtccacttcaggcagccgtgccaggtgg

SEQ ID NO: 649154 - DNA, 144 bp, Homo sapiens
tttagaggatcactccctagcgctagggtccctctggtcttaataaagggctctgggcatcccactctcaagtccacccgactcttgccccctacctgccaggccccgaccttgaaggcccctcttcgtgccccagcactgcct

SEQ ID NO: 649155 - DNA, 274 bp, Homo sapiens
  misc_feature (254)..(254): n is a, c, g, or t
cccaatgtgccatggggaccctgagaagagtgacacaatccaaaacatgcaggagagaataaggtgtcaggtaaggcattcaagagggatttgcacctgagctatgtttttaagaatgaatagaagtaagccaaagacaatgggccttccatgaaacttttgcccttgggaaaagcaagagtccctggggagcaagtgcatttcaaggaaagctgttacagttcccagcattaaaggattcgggtgttgagttnaaggtccccagggagattag

SEQ ID NO: 649156 - DNA, 1031 bp, Homo sapiens
  misc_feature (1031)..(1031): n is a, c, g, or t
tacaggaagtctcactctgtggccctggctgaatgcagggcgcgatcttggttcacttcaacctccacctcctgggttcaagcaattctcctgcctcagcctcctgagtagctgggactgcaggtgtgagccactacacccggctaatttttgtatttttagtagagatggggtttcgccatgtgggcaggctggtcttgaactcctgacctcaagtgatctgctgtctttagactcctgaagtgctgggattacaggtgtaagccaccttgctcggcccaaggaagaatttcttaattaaagatgtatacaatacgctaaaggattaaaaatttacacactacacaaaaattaaattctacttatcaatggtcaacattttaaaaagaaatagaacgggaggaaaacacaagaatgctgagaagcagtagtctatggcatcacaagcgtcacaagagcagcatgcttgaagaaagaggaggttgccatctgtgttcaacgtggctgagaggtggagtaagaagacagcaaagtgtgcagtggatgtggagatgcaaggcacacaggcaagcataacaagagcagcttcaacagagtaggaggaaacccagggcagtgcctggacagtgctcctctttctcctcacccttccagaaagtgccagcctcccactgcctgatgccccatcacttgcatattcatacctaccctaaaatactggattggagcggagggtctttagcggtagtccggaccgggacacggtcggctattgaactggtggttatttaaggtggttgggccaggcttgtgcactttcatcatttgtctggaattcttctccctgggaacatggagagaagagcctcattacatgtggcggggccccgcaaaataacaacagggggggggcgtaagatatcccggggggcgactgcaggcagacgtctttgagaagggtcccagaggggtcttatagcgagcgcggggcacatggcgaaagaccgcgctcttaagcgccaacatctgtn

SEQ ID NO: 649157 - DNA, 297 bp, Homo sapiens
gcgcagagaagcggcggccaggcccaggcacagttggaaaaagcaaagacaaagcccgttgcatttgcggttcggacaaatgtcagctacagtgcggcccatgagatgatgtctcagtgcctggcatggccatctcattcgaagcaaaagatttactcgcatgttaaggcaaaatttacaatgcctggtggatagggcgcttggtaaaagaggctgtgaatcggcttcattccaagcccagtcaactagaaacatgaggctccacatgaccagtgcgccagcaaggcaattctctca

SEQ ID NO: 649158 - DNA, 221 bp, Homo sapiens
caaggtcgcaccattgcactccagcctgggcaacaagagcgaaacttcatcgctaataataataataataataataataataataataataatagtaataatgcttaaggttgacaatcattggtccatcaaggttggagagaggtgttatttgcatttgcagttttcttgctgccttatcacttagggcagtatacagagggtgacgcagattatgtact

SEQ ID NO: 649159 - DNA, 506 bp, Homo sapiens
tgagtaacctggtaatccagctatcgccagtacagacgtccgtaaacgagccctacagaatagagttctgtatatgtcgactgagcgggtgcgtgattgtggctaaatattcgggatctcaacaagagactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttacaattcagacaaggcccacagaataagattttccatgcatttgcacatacgtatattctttttccatccacttgcacaatatcattaccatcacttttgcatcattcctcagctactactcacattcatataagggtgtctgtaaacatttttaagacaggttgggatgtcact

SEQ ID NO: 649160 - DNA, 373 bp, Homo sapiens
taacaggcttgagaagcccggtttgaagaacataagattgaaaaggatatggcgaaggccacccagctgctgaaggaggccgagaaagaatctgggtaccggtcagcatccacagccatacatcttccctgactctccggggggcacctcctatgagagatacgatggctacaaggtcccagatgggtgcttagatgactggcatccttctgagaaggcaaggtatccggattacttggccaagagagaacggtgtaagaaacggcggagggaaagcggggaccgagaggtgaagcagctgcaggaggaaacgccaccgggtggtcctttaactgaagcttggccccctgcccgaagggagggcgctgtaggt

SEQ ID NO: 649161 - DNA, 971 bp, Homo sapiens
tgggacaatttttaaaaatgttgtataacaaagcttctttaaaaaaaatgctcagcacatttaacctcaaacgtggaagtgacaagacgtttaggattgacatgtttggggcaaaaggcttgttgcctaggctttttataaaaaagtgggtacactcaagtgcctcatttataacaacgtggcataaaatcccacataatgggctaataaaaacagatacaaatacagaacatttaaagtaataacaattcaagtgtgcgtgggctttttacaacagaggggggtgataaggaaagaaagtgaaaattcacgtgcaaaccagtcgtgcgtaaacgcatcgtgtaaaggttaacgggtttaaaaaaagaaaagaagaaaacagaagaaaaaataaacgtgaaatagggcgtgccaagtggctaccaacagaggtgggttgggctattacatttattgagctctacggaacaccttacaagggcggaaaagccactagtggtgttacaggcaattcacagagaaagccacttaccagaacaagcggtctcgagaaaaaagaaggctatcttgaatgtcattatttcaaacttttccagaaactttcaattttatttaaaagcctcatagctagcaaaatatacaggaaaatttaaaactaaaagagtgtaaattaaaaaattcaagttaaaaaagcaaaaaaaaagcgatcctttgcaggttaataaagctaaggagaaagaaaggagaaacgagcgaaccaggggggaatctcccaggaacctcccaagggggggcacgaagaatggagccatagtagcaggccccgtttcgcaatgaacggaaaagcccccaactaccggccttccgaaagggacaaggtgagacgcaaagagctggaatgcccccaatcggggagaaaaacccacaccgccccacaccgaaacacaacaagcgcacaacagccgtaacag

SEQ ID NO: 649162 - DNA, 160 bp, Homo sapiens
tatatatcatgctgaggagcagattaatcttatgatagacgtcgggataagtttaggcaggagcaggagatgtgataggatcatatttacaaggatgacttcgataataatataggagatgacttggagtgcgcagaacagccattaggtagggtaccga

SEQ ID NO: 649163 - DNA, 423 bp, Homo sapiens
cagtctgcagaggccagagagagcaggaaaggaaatggaaaggaacctcaccttcatgcttggggaaaaggagaaacctgtgttaatgtgtcttcccaacatcccactctcttcagcaatcgctggaacagccatgggccatccctgctgagtcaggaaagaagctgagggaagagtcgggattgaaaagcagcagacaagggaaatgtggacacaagcacatgaagagaacaccatgtgaacataaagatggccatctacgagccaaggagagaagcatggaatggatgcttccctcatagccttcagaagaaaccaactttgccaacaccttgatttcagacttctagcctccaaaactgtgagacaataaatttctgttgtttaagccacccagtgtgtagtattttgttatgggagccc

SEQ ID NO: 649164 - DNA, 170 bp, Homo sapiens
atagagatcaaagtaggtgtcggcactgtcaggacaagtctctaggactggggcattgccacacagaaggggcagtgtcttgacccgagatgatgttctacttaagtgcatctcattttccccaaaaacctgtcacctgcagacagaggcttggacaaggtagctcagga

SEQ ID NO: 649165 - DNA, 288 bp, Homo sapiens
  misc_feature (142)..(142): n is a, c, g, or t
  misc_feature (249)..(249): n is a, c, g, or t
  misc_feature (258)..(258): n is a, c, g, or t
ggactgacttcatagtttaaacgtcaagagaaggccgggctcagtggctcacgcctgtcatcccagcactttgggaggccgaggcgggcgggtcacgaggtcaagagatcgagaccatccgggccgacacggtgaaaccccngtctctattaaaagtataaagattagctgggcgtggtggcgggcacctgtagtcccagctactcgggaggctgaggcaggagtaggacccacactttttccctatcnttaattcantttgataaccaatattgacctaggtagtaa

SEQ ID NO: 649166 - DNA, 154 bp, Homo sapiens
attcgcggccgcgtcgactttttttgatatttttgttttaaaagagtcagctgaaagagcggaagaggggatttattatatggttgttacactcggacgcagataaagacagaaatagtccataatgtgacaggtccaggggagaggaccaaca

SEQ ID NO: 649167 - DNA, 470 bp, Homo sapiens
cgacccgtgttttttggtggggttttgtttttctactcgacgcacttctggtggggtggtgtggaatagaccacgctctccttcctaggcggcgcagcgccccctggatgcggactttcttttttgtttttgtggttgtgtgttggtgctgtggggctgaagacagcgcgctctttgtttgtgtggactactcgctgtgcgccccggcgtggtgggatggggaccgccccctcagagtggtggggtcggctcttctttggtgggggggttcttctgctcggtggacgactcggctgatttcccctctcctcaggatgagtgtgtgtctcttcgttgtgtgttgatgtccgatcccccctgcatggatttgtttgttcctccaccccctcctgtcttgcaacgaatagttttttttcccccccctttgtttcccccctccccccccctagataaccctctttttttttcta

SEQ ID NO: 649168 - DNA, 814 bp, Homo sapiens
  misc_feature (258)..(258): n is a, c, g, or t
ttttttaaattattattattttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggnctcccaaagtgctgggattacaggcgtgagccaccgcgcctggctattttttttttttttttaaattatagatggggtctctgtcagccaggctggattgcagtggcagcccccaactcctgagctcaggcagtcctcccaccacagcctaccaaagtgcctgggcctcccaaagtgctgagattacaggtgtgagccaccatgcccagcagatttttttctttatatttttttcttaaagaccagtgtgcttttctgggagaaagaagaaacagaagaacagacggaacgaagaagaagaaagaaaggacggcagacaggacgaagaagagccagctgtgataatacatggcaggtgactctctctacacacagtgcgtttatttgagccaaaagttatcttccccttttctgaagtatggcgcatcctatatagactgtctctgcatggtttattttcccccattaatattcccggggatcatttctttccatttacaaggcgtgccattccttttacccacacaaagggcgcgcccaaaaatcccggaggccg

SEQ ID NO: 649169 - DNA, 360 bp, Homo sapiens
  misc_feature (40)..(41): n is a, c, g, or t
ttgaggaggtggtgtctgattgcatagagcccaaacaggnnaaacgggattgatttgaccaggtgtgtcattcacatagcaaaaagactggccctccaagcctaaccttttattatacaaatgaggcttctacctggctgtgcatgacacctgcacatgtggggacaaagaaaagggagcaggaggctgggcgcagtggctcatgcctgtaatcccagcactttggtaggccgaggtgggcggatcacctgaggtcaggagttcgagaccagcctggccaacatggcgaaatcccgtctcaactaagaatgcaaagattagccgggcgtggtggtgtgcacctgcgattccagctgctca

SEQ ID NO: 649170 - DNA, 688 bp, Homo sapiens
  misc_feature (34)..(34): n is a, c, g, or t
  misc_feature (80)..(81): n is a, c, g, or t
  misc_feature (91)..(91): n is a, c, g, or t
  misc_feature (105)..(105): n is a, c, g, or t
  misc_feature (125)..(125): n is a, c, g, or t
  misc_feature (139)..(139): n is a, c, g, or t
  misc_feature (145)..(145): n is a, c, g, or t
  misc_feature (148)..(148): n is a, c, g, or t
  misc_feature (170)..(171): n is a, c, g, or t
  misc_feature (173)..(173): n is a, c, g, or t
  misc_feature (183)..(183): n is a, c, g, or t
  misc_feature (202)..(202): n is a, c, g, or t
  misc_feature (209)..(209): n is a, c, g, or t
  misc_feature (216)..(216): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (229)..(229): n is a, c, g, or t
  misc_feature (237)..(237): n is a, c, g, or t
  misc_feature (255)..(255): n is a, c, g, or t
  misc_feature (259)..(259): n is a, c, g, or t
  misc_feature (389)..(389): n is a, c, g, or t
  misc_feature (401)..(401): n is a, c, g, or t
  misc_feature (581)..(581): n is a, c, g, or t
  misc_feature (595)..(595): n is a, c, g, or t
  misc_feature (601)..(601): n is a, c, g, or t
  misc_feature (608)..(608): n is a, c, g, or t
  misc_feature (620)..(620): n is a, c, g, or t
  misc_feature (652)..(652): n is a, c, g, or t
agggtatgtggatgagaaatgacactaggaaggnacatcaaagccccagctacaaaaagaaagttatcaagccccaaatnnttggggagcntcccagtgcacctnagaaatggggagcaacgatngggaaggagcagantggagngcncacaaagggttaggggtctttnntntttttttttnttatttttttttattaaanacatttntttaaanatntntnttttcntttatgtntgggtgttttatatagantatnagctggccatatgagcactgtgtggagaggaaaaaggacagctaaggagtcttcccaagcatcctatttgtggcttcagagatctaaagggggacagatgctcaacactcccacccaaatgggtaaagtnaacccttcaggnctcaggtccttggcccgaacaacttggaagccccaaattctcttgatgattaactacaactcccaaaactcttggggtcggcaaaaggaaaaatgggtgttgtcaatcatcaaggatttatggaaaggagcccctcccctacaagctgtcccactttccctgaatctaggcagctggganaataggtgtagcangggganaagagcncagaaggaggcngcctcctgtgctgccccaccccgcatttgagnttgccctcccaggcccaaagcccacctgctgttgag

SEQ ID NO: 649171 - DNA, 989 bp, Homo sapiens
ccctgtacacgtatcctgaaaactggagggccttcatggctctcatcgtctgctcagtacgagccggggctcaggtccgcgtgctctccgtctgcaccccacttccattttggccaaaccaaacgcatccctgaatttctccgtaaatttcctgccggcaaggtcccaggcatttgagggtgatgagtggatatctgtgtgtttgatgagcaaacagccattgcctactatgtgatgcaatagaggatgctgcggggaagtacatccagaggcagcaatgccctaggtgtgatgcaatgtgggttgagtcttgcatgattcgcgatatagtgctccccaagtacagctgcctgggtgttccccaatcttgggcatcattgcaatcattaacaaactaggtcacttgaagaaatgcgaagaggaggaagtgagtgcggacattctggggtctgcgtggatagctcttacgtatgagagacgaggcactttgtctggtgggcgaactgagtgacattggctggacatcagagttgtctgcaccctgtgtggctctataagcaggttctagagccttctttccgcaggcctttcccaataccaaacggtggttcctcaccttgcattagccaggcccagtgccgggctgtctatgggggaagtgaccactgtgtgagaagaaggccactagatgctaagaagtagggagaccaacctaataaggacacactcaggaacgagagggtccacgggaagagaagcagaagccccagctgaagcggagggggggacacaggcggtgccctggtctgagagggatggttggactgtgagcgggcgcggtgggagccagggcaggaccttgctcactggccagagtacttggtgggggataagcgcgtccagaggcacccctggggcggcaattgaggctggaggcgtggcccggtacaaaaccgaaaaacaccaaggtaggagggcaagaaagaaac

SEQ ID NO: 649172 - DNA, 232 bp, Homo sapiens
tgaacctcagacatctcgtccaggaccgagtcaagggtacattagcgtccttatgccaaagaacatacagaaacggatgtgtaagcgcgcggacaatggaattcttcggagacttcgtgaagtactacagcctcatcacaatggtcttagctgcagcacaggcttcaaatagaaagccttccccgcaagatattgcacaggctgtccttaggaacttcagtggcacggatgc

SEQ ID NO: 649173 - DNA, 303 bp, Homo sapiens
aaaaataaaaaaattagcccccccctgtggtactaactattcaggaggctgaggcaaaaggattgcttaagcccaggagtccaaggccccagtgagctatgttccccccccagccccccagcctgggtgataaaaaaagaccctgtctttaaaaacccaaatgaaatgaaaaaaacttttttaaataaaaaaccaaaatccccctgtaactgctaactgaagtatacatccagggcaacttcaatttatgcttttgggttgcaaaactcacccttggcccaaataaacctttttcttccctta

SEQ ID NO: 649174 - DNA, 223 bp, Homo sapiens
aaagactacagtttaaaaacaaccagccgtattaagcggttactcttcaggtaccacctgctggtgttctcggcgtttaccttaagcgccggatttgtgaccaccggtttaggtaaacgtattgcctatctgctgattgggaaaatcggtaacaccacgctgggtctgggttacgttacggtattcctcgatctggtactggctccggcaacaccgtctaaca

SEQ ID NO: 649175 - DNA, 631 bp, Homo sapiens
taaatgcaacatacaaactttattgaacaaaagttaaacgtggttctcagttaaactcaaacgaggacacttaagaagaaaaaactgacgtggaagaaacttttatcttaaacatcttacagtaacctacttgcgagttgcattaaacgtgagctcgtgttgctggtgaaaaatacagctcatggcacaggttatggctgaaagatttggtacatttctcaagtattcactggaatactaacctttatatacactattatactattaaatttgaaaaagatttgacgatccccagaataaacttcatatttggtggactctttgggaagaaggtcgtctaaagaagaaagaatatggtggtcctggcctcatgaatcagtgtaatgaacccagcctaaactctgtgggacaccaagtctcctccactcctcttcagacttcagatgagtttaaggtacttgtctgggaaagtactctgggtaacataacatgccggtactcgaagggtaccgtcgaagtacttgtccgagtagtaaatctgcttgtgggccaacctgctaggcgcgctgcagaaaatgaaacgaagagcgcgaagagcgcgcccagcagacaaaacacgtccagccaggca

SEQ ID NO: 649176 - DNA, 104 bp, Homo sapiens
tcatacttatgcatccccgcagctacacacacacaaaacacaggacacgcattaacacagcagacacacgagcacccagcagacagacaaagtcacagcagtgc

SEQ ID NO: 649177 - DNA, 159 bp, Homo sapiens
gatcccgcgagttcgacccactgtcccgagactcacgcccagtcggatggcccgcgatcgacccgaactccagggcgccttgggcctttgtccatgggcccgcgctgtcaaaccatctgtcccgggccacacgcgctcgggaccgatagcacgtggagg

SEQ ID NO: 649178 - DNA, 834 bp, Homo sapiens
  misc_feature (301)..(302): n is a, c, g, or t
taaaactgggtatttaatcttggattctcccttcagccctcacccctggttctcatctttctggatcaaaatctttttctggcctctgtcccctttctcttcattcttcttatagcttccccctccaacccgtgggggggcagtgtggtttggtggaagaacgccaccaggcccgtgagatttacattcgtgctcctccttctccgtggacgcccagaggagggcagcaaaaggggggtggtgctcctccaaccccccagcacgtggaggaagagaacagggggggcctctattcctcaanntttccacccctctcccttttctctcccctgtgtcccccagaggacatgtggggcgcccacttctctggtgggtgtgtggcgcacaaggtggcgtctcccccgagatattgtggtctctacacaaccgtgagagaagtgtgtttaagagaacactctcacaagacacaaaaaattttttctcttattctcaacctctatcacaaatctctgtgtggtggcttcctccaacaagaaaaagaaatcaaaaaacaaagaaacataggaaaaaaaaccctccgcgcggcgggggcactctactaaataatgtcgtcacgcgcgggaggcgcgagcagaagaacagaacgtgcgtgctaatcgagacaagctgtgcgccactcgtgctgcaacatagcggtggtttctccgagaaccccacgcttcttctcttgtgcccctcacgggggggtaaaaaaaccttgccgggggccccccccaaaaggggggcgagcggcggcaaaaaacacctgaaaaaacccccggggtatcccggaat

SEQ ID NO: 649179 - DNA, 176 bp, Homo sapiens
gacagatccctaacagaatggtctggacttactaatcgagtaagcatagacaggttgtttaacgacgcatacgctcctgagttggctcatctggtaagcgtgggatagtgagtactagcgtgaatgggaaaaccgttgcacaagcaggcccaacccattaatgtacttgtccatct

SEQ ID NO: 649180 - DNA, 2333 bp, Homo sapiens
  misc_feature (1626)..(1626): n is a, c, g, or t
  misc_feature (1942)..(1942): n is a, c, g, or t
  misc_feature (2212)..(2212): n is a, c, g, or t
  misc_feature (2262)..(2262): n is a, c, g, or t
  misc_feature (2307)..(2307): n is a, c, g, or t
gggactcgccgcagatccgctggtactatgcgtccgctacgagtatgtcaatcgcattgccgccaggcacagctgtcattcattcctctacaggacagcagcgttctccgtcaatcaacttggaggactgcattacatgttccttcgcataacataacagggatggcctgcctctcttgtctctaacagaggcttgagacacctaacgaaacaccgtgctacaacgctcgtgagacaactaggctctgcactttaggactgctctctctgggctacacaactacaactcgcatgccacagaaggaacgaaggtcaagccgagcacgaccagcctctcgattcccgcccgtgaatatgccctgtacatggtcgcgcgcgaaggcaaccttcctgccatttgcgcgtacactctgcgactggccagagacaagcgcccattttcttacgaggattaaccccccgaccggtggcaaacaacgaaagcataaccccgccaaggccacaagtgggaacacggcgcacacgaccacacagcggaagccaaaacagcacgaaccgccaaatcttagaaaaaaagcctacaggccatgtacttcacagtaaagggcttaaggaaagcctggcattcgtggcgtggaccaatggaaaagaactacacaaagattttttactaggatatttcgaattggcacccggaaacatgctgtttataagtctttatgcgaagagctgtttgattaaacgttacatcttctggcaaagttgtgcaatgggaacataacgtctggggggtccaagaaatctagtgaaaacgttactaattgggggcaggcaacacaccacgccacatgattgggcccaacgcctcccaggctaacggcggccataccctcaatcgttgggcagtggggaaaccgttatttcacgcccacactccccatttattcaatctttgggcggtcacgtctttggccaaacggcccccggtaacggtataaatcccgcccatttggtgggccggcaaacccccagattgggcggcgttttttccccaccaaccaccgggggggaaaggaagaccgtaatgccggccataaaagggcgcccacaatcctagaactggaaaagtaaggcctccccggttggctcccacatcgagcaaaggtgccattacacgatttccgaacggggcactggcttgccccatagagttgggcaaacacccacaacgcgcggggacaaacttttcgtgggggccgaacagggacaaggttttcgaccacgtggttacatcaccaaaaaggccgggcgagaaacgtcacacgggggggcacccacacagcgagcaaaacggcgggttccacacttttgggaaacgcaacgagaggggtcaacaacggtgcaaagatacttaggccggggacacagtggcgaacatcacactgggcgggcgcccagggcaaaagaaaacgacagccccgaccacccccggatatcacgacaaagctagaacccgcatagtggggggcaaaaccgccgccccgaacagataaaagccgctcgccgaccactgtatgtgatcgaaacagtggccaaacacatcgataaacgaggggcgtgccatanacagctcgcctctatgtggtggacacagaatgtgttcattagatgagatagatatagggggggcagctattatccagctattatagttatccctagaagcatagctaaaacgtcatttaagaatgcgatttttgatagtgcgagcggacacaacgcacggacgaacgacaatagcaccgacatgaacgtttttgtggcgagaaagcatgtatgtatgaatgtaggggagtggggaccaaaaaccccgaaaacaagcgcactgtatgtagatacaagaagctaggggtaacaaagagcccccgcgtttatcagctcnagcaacatcacgtcctaatcatgtgtacagtaacacgctttattatcgcaccacaagagtgatgcgccacgaactacgtgagcgagtcgtgtgggagtgcgtcacacacacattacttcgaatcacaacgaagtgcgagcaaatacgacgtgacgcagctgatggaacgacagtacgacagccgtacacatcccacgacccggcagtatagtacataagagggctacagtgatttgccgcagtccacgagaagatggctaagatagaacngacattgttgtgaagtcaacccagccccacgcaaaacgatcgatttttanaacatcgactacagaggtcgtcaagaccacaaaactacgacatcngaggcggggtggtacaagctagcacc

SEQ ID NO: 649181 - DNA, 337 bp, Homo sapiens
tacaccggaaccagcggcggccagactgggccatcggggctgcccacaccctacacatatgcctcatataactatttgccttaaccgtataactactcacctgccacctaccctggaacccgacggcctgcgcagggggtccaggtgggccacacaggggccatgatggcagaagatacgggtggggacggaagatatccacaaaggagccacagctgacgccgtaccgaaaagaaaaaagatatgtatatatataggtatctatatacacgtatatatataaagagaattcaatcaaacaggggaaagctcacaacctgggccctgttctcaaggg

SEQ ID NO: 649182 - DNA, 2263 bp, Homo sapiens
gaataccttggaccttagggctactctagttgtaatgtattagtgagttatcactagagaagttccacagtttaatattatctatacctatatctatatatctacctatatagatagatatatgttagatgcttcaacaactagggtctacacttaatatactgacatctaaggatgcggccaagaaaagctgtaattaggctgaattttattgccaaagttgttcttttttcatttagtcctttaataaaagatgatcttcataaattacagaaagtttgcttaccctgtttgaccttttgcagaaaagaacaagagggaagacagaccttcaggctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcactttgggaggccaaggtaggaggatcgcttgagcccagggattcgggaccggcttgggtaacatggtaaaaccccatctctacaaaaaacagaaaaaattacctgggcatggtgtgtgtgccttgtggatccagctacttgggaggctgaagtgggaggatcgccactgcactccagaaactaaaaaaaaaaaaaaaaaaaccttcaaaaatatatctaagccagatgtgatggcatgggtctgcagtcccagctactcagagggctggggcaggaagatcgcttgagcccaagagtttgaggctgtagtatgctgtgcagtggcgcgatctcagcttactggaatctctgcattcccagttcaagtgattctcctgcctcggcctccctagtagtggggattgcaggcgcccgtcaccacatctagctaatttttgtatttttagtggagatggggtttcaccatgttggccagtctggtgtcgaactcctgagctcaggtgattcacttgccttggcctcccaaagtcctgggattacaggcgtgagccaccgtgcccaggtgcccccacctttttttttttttgaggcagagtctcactccatcgccattgcactccagcctggacaacaagagcaaaactccatttcaaaaaaaaaaaaaaaaatctgttaaaatttgatatagtaggcactgacaaaagaggtcaaatgcaggactgatttctaagcttgcaatctatctaaatgcagatgctaatttagagtgcataattattacacaagtacagacctaggttagggcttaaatttcattatgtgcaataaaaaggttaagtgatggttaagcaaggtgtagattatccttacctctcctaatgacatgggctcacattggcattcctttcatacttttacgtataaagtgggcagttgtttctgaatgactgttgctggagcctcaggcctgctttgtgcttggtgctttccagactttctcctttattcctatcaccatatacgtactcacaaaagagcagtgtaaaccaggtattacatttccacaagggaaagtagaaccaggaatagccacacgatacttaccgaaagcttcactttccctatagagaaagcaagcaacatgaatcttctgatttggggcccagcctgctgctgtatacagaggttggcattattggtgatagaaatgtctgataggagtcttttaattatactctggagtgtggaggtggagtgcaaggctgcttcctttattactgcaagtgttattttctattatctcaggtttcgttttgtgtaataaactgcttcttgtaaaaaaaaaaa

SEQ ID NO: 649183 - DNA, 225 bp, Homo sapiens
aacaacacggccgaacctgagttcaggttaggcggccaggcgggaagtgatgatcaaccgtaacccaggtccaaccctcccaggcactggcggggagacgcgcgcgcaacctccctccgagccgagggagcggcagctgaccttagctgccgtaatagttcgctccctgagctgagccttgaggtccgagttcatgtccggctccagaagagcctaaggagcaac

SEQ ID NO: 649184 - DNA, 133 bp, Homo sapiens
tccagaggatcccagaggcggaggaagacgaggaggaggaagataaagaggaggagctggaactggaactgctagagcgcctcctctgtgctgtccacctcctctgtgctgtccacctcctctgtgctgtcca

SEQ ID NO: 649185 - DNA, 428 bp, Homo sapiens
  misc_feature (396)..(396): n is a, c, g, or t
tcggaaggtgcaagtcgggggaaccgcgaagaagccgaggagcccggagcctcgcgtgacgctcctctctcagtccaaaagcggcttttggttcggcgcagagagacccgggggtctagcttttcctcgaaaagcgccgcccctcccttggccccgagaacagacaaagagcaccgcagggccgatcacgctgggggcgctgaggccggccatggtcatggaagtgggcaccctggacgctggaaggctgcgggcgctgctgggggagcgagcggcgcaatgcctgctgctggactgccgctccttcttcgctttgcaagacggccacatcgccggctctgtcaacgtgcgcttcagaccatcgtgcgcgccggccaagggcccatgggcctgganacatcgtgcccaacacgccgagtccgcggtcc

SEQ ID NO: 649186 - DNA, 145 bp, Homo sapiens
atcatttgcacgaatagtctgtgcaacaatattggtatgttttcttaacatagcagcgtgcagtctcagagagggtgacgatcacttcatgggcaagctggcgttgcatattgttgaggctagtgtcgccacacaactttagact

SEQ ID NO: 649187 - DNA, 802 bp, Homo sapiens
catggtggtgggcgcctataatcccagctattcgggaggctgaagcaggagaatgcttgaacctgggggacggaggttgcagtaagccaagatcgcaccacttcactccaggcctgggtgaagactgaaactccataactccatctcaaaaaaaaaacacagggcgccgtgttcatgcctgtaatcccagcacgtgggaggctgaggcggggaggtcacaaggtcaggagatcgagaccatcctgctaacacagtgaaaccccgtctctacttacaaatacaaaaaaaaattagccgggcatggtggtaggtgcctgtagtcccagctactcgggaggctgaggcagaagaatggcgtgaatccaggaggtggagggcggaggttgcagtgagccgagatcgtgtgccatgtgcactccagcctgggtgatggagtgagactctgtttcaaaaaaaaacaaaacaaaaaaaaaaaaagcgggacacaacaacaaacaaacacaaaaacattttgggggggcccgcccaaaaaagttttaaaacacctctgctgtggcgcggacgagcccaagtgggtaacacgaaaccgggtccaacagggttcccaagaagacaccggcgcaccagaaggggctggctccccccaaaaaaaccgggggggaagcggtgtttcacaacccacggggcgtgctggctacgggctaacaaaggggccaggagcagatatcgcgcccgtggctaggaaaacaaaagacacgacgcgaaacggaagagagaccagacagcagcgacaactagcgac

SEQ ID NO: 649188 - DNA, 1479 bp, Homo sapiens
  misc_feature (175)..(175): n is a, c, g, or t
cccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagngttcgctccagggccaggcctggagccagcgcccttacctgcccctggaaagtctgagaccactcggggcggggcggctgccggagggtgggctgcggctccgtggcgggttccagaggggcggagcaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttccaaaaaataatctagtaacacaag

SEQ ID NO: 649189 - DNA, 312 bp, Homo sapiens
gctcgcccgctctcgtgaactcaatcctttacactctgtgggccttctcgtccagtttatttatttagtagttactaaagtgcccagtcctgtactaaatgtgttttctatatcttctcaaattttctttccaaaattatatgcaataggttttaatattatcctctttgtgggagttcctgtcatggctcagtggttaacaaatctgactaggaaccatgaggttgtggattcgatccctggccttgctcaatgggttaaggatctggtggtgccatgagctgtggtgtaggttgcagactcagctcagat

SEQ ID NO: 649190 - DNA, 1357 bp, Homo sapiens
  misc_feature (175)..(175): n is a, c, g, or t
  misc_feature (1020)..(1020): n is a, c, g, or t
cccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagngttcgctccagggccaggcctggagccagcgcccttacctgcccctggaaagtctgagaccactcggggcggggcggctgccggagggtgggctgcggctccgtggcgggttccagaggggcggagcaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtgaggaggccgggggcggcgggagtgggggtgggggtgggcgccgcccctggtcgggccctcctctgcccacttgttgcttgcatcttttgggccaggtgtcccgctccaggaagcgttcagacccctcctgccatctccccactctccaaacacactcacacctttcgtattcattcaaggactatttcttgagcacctctagatgtgccgggaactgccaacagcagttggggtcccgcttccactcgcactcccgcaccccagacatcaggccactcacctcccccgctggcttcctcctcttctctcctctccccagccctttgcatatgctgttccctcctatttgaatgcccctccctccagtaccggcttgggaaacatctgtntccgcagttagctgtcacctctgggaggtcctttctggccagctggcaggcgccttgttagggccctcatacccacctgggcaggcttctgttaaagcatttggctccgtgtgtcttttgatcccctcgccctgccaggggactctggtgtctgaaggccagcatgagctctccacaggggacttgtatggggcagacatctgtaagtggctcttgagccactggggtgcctggggattgggggcatggcaagtagctgattcccccttcacctcaatcctctctcgccattggcaggtacaggccaaatgaacttgcagaaacgcaggtaagtccc

SEQ ID NO: 649191 - DNA, 1021 bp, Homo sapiens
  misc_feature (175)..(175): n is a, c, g, or t
cccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagngttcgctccagggccaggcctggagccagcgcccttacctgcccctggaaagtctgagaccactcggggcggggcggctgccggagggtgggctgcggctccgtggcgggttccagaggggcggagcaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttccaaaaaataatctagtaacacaag

SEQ ID NO: 649192 - DNA, 376 bp, Homo sapiens
  misc_feature (50)..(50): n is a, c, g, or t
  misc_feature (52)..(52): n is a, c, g, or t
  misc_feature (55)..(55): n is a, c, g, or t
  misc_feature (61)..(61): n is a, c, g, or t
  misc_feature (64)..(65): n is a, c, g, or t
  misc_feature (71)..(73): n is a, c, g, or t
  misc_feature (76)..(76): n is a, c, g, or t
  misc_feature (84)..(84): n is a, c, g, or t
  misc_feature (92)..(92): n is a, c, g, or t
  misc_feature (95)..(95): n is a, c, g, or t
  misc_feature (108)..(108): n is a, c, g, or t
  misc_feature (115)..(116): n is a, c, g, or t
  misc_feature (130)..(130): n is a, c, g, or t
  misc_feature (138)..(138): n is a, c, g, or t
  misc_feature (141)..(141): n is a, c, g, or t
  misc_feature (149)..(149): n is a, c, g, or t
  misc_feature (153)..(153): n is a, c, g, or t
  misc_feature (160)..(160): n is a, c, g, or t
  misc_feature (163)..(163): n is a, c, g, or t
  misc_feature (166)..(166): n is a, c, g, or t
  misc_feature (169)..(169): n is a, c, g, or t
  misc_feature (182)..(182): n is a, c, g, or t
  misc_feature (202)..(202): n is a, c, g, or t
  misc_feature (207)..(207): n is a, c, g, or t
  misc_feature (224)..(224): n is a, c, g, or t
  misc_feature (226)..(226): n is a, c, g, or t
  misc_feature (231)..(231): n is a, c, g, or t
  misc_feature (235)..(235): n is a, c, g, or t
  misc_feature (246)..(247): n is a, c, g, or t
  misc_feature (253)..(253): n is a, c, g, or t
  misc_feature (257)..(258): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (283)..(283): n is a, c, g, or t
  misc_feature (292)..(292): n is a, c, g, or t
  misc_feature (316)..(316): n is a, c, g, or t
  misc_feature (349)..(349): n is a, c, g, or t
aaagggtttgggaatatatttagagtatatttaatataaataatttatananagncggggntcnnggtatnnngcncagcctgntcttgaantcntgggctcaagcantcctccnnccttggcctcccanagtgcatnacntccatctntgtnccatccntcnggntgntaggtttcagaantatttctaaggtagttgaanccaanctgcctgtctctctcancncaccncccnctcacgtgccnntgctcncacnncaccgaantnccatnaagtgagtcnccaatgcgnctgtgagtcaccctgtaattgggnaaagttctgtcctgatagctcatacagccccgngcatttgtgctcctatatctattgccc

SEQ ID NO: 649193 - DNA, 299 bp, Homo sapiens
  misc_feature (65)..(65): n is a, c, g, or t
ccagccagctgatccccctggccaaggtaatgtagaagaggccatccccacatcatattcacatnttttaaatttcacaagcaatactttggaacaatggggttccaggccccaagaaatgatgggctagatgagggggagcaggaggctgacaatgaggtagacgaagaacgaggaaagaaggtggggggacggacagagggacggaggaagaacgacgggtgatggtgagggaaaggaagggactggacgactgaacgatgaggacagctgaagtccagctaacggggcaaggcggg

SEQ ID NO: 649194 - DNA, 238 bp, Homo sapiens
aatagcagaatatagtaataataattagcttaaaaaaataaacatataccaatataaagaacagcacaaagcagcagtgctcttcttggcttttctcgggcagactctggccatctgggggtaaagatgggcttgggcaatgttttgtagtttacaatcctgattggtatatgtaaaatgtaatgtgcaagcaccacgtggagacgcgcgggcacgggatgtaggattgcgttgcaag

SEQ ID NO: 649195 - DNA, 916 bp, Homo sapiens
tatacctcctgtgctgctttctgtagtcgtgttggttcctttgtttttttacttccctctccctttcgggtgacttttggttttctgttgtccggcttgtagttcttctccaggggactttgtgtttggtcatgctagtctgtatggtgtttcttgtgatcctacttgtgtgcctctgtgttttgtggtgcttggccagttgtgtgagtccctgtcaccccatccttttctggcattgggcaggtcagtgcacaatgaactggagaagcgcaggtgagtcccagtcctgcgctgacagcgccatgcccccaggggccactgccctctggccttccctcccctgccattcctgtggccggcataggtggggctggcactgccctccagacctcttccccacaggagggcccagttgaagcggtgcctggagcggctgaagcagcagatgcccctgggggccgactgtgcccggtacaccacgctgagcctgctgcgccgtgccaggatgcacatccaggtgaggccccccactgcgcccggactggcttgccctggtgtatggagggctgtgctatggaggggctggtgggactggggaacgagacctgaggtcagagctcaagaactgtgtgacttaggacagctctctgagcttttactttccagatccattaaatgggaagaaaagcagacaataactcagagggttgttgaggcttaaatgagttcactctataaatgttcactgttgctgttacagctgttatcacttagatcacagctgtgagaccttgggcaggttacttagcctgtctggactaaccttccctcctgtttgaggggaggcgatggctgttgaattcggccacccaggcctcgctaccaataccctggggggtttaaaactttggcacaa

SEQ ID NO: 649196 - DNA, 358 bp, Homo sapiens
aaaaacttgtaatttaccatggcaactgtagcagctacttggtactgtcgacatgcaaggatttaggcttgggactgcccttcatgctatacctctgcctggccatcctgctgaagcaccgcgaccacatcatgcgcaatgggctggattatcatgagctggaaatgcactttgaccgccttgtgagaaaacacacacctggggcgcgtactgacgccgggctagggctctctttgctgataacctgcagtcagaggtgtgggactcagaggagggggctgaggcccaagccgcatctatgatcaggctatctcaagccctcaatacggaccaacaagatctccatactttgacatga

SEQ ID NO: 649197 - DNA, 1452 bp, Homo sapiens
  misc_feature (175)..(175): n is a, c, g, or t
cccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagngttcgctccagggccaggcctggagccagcgcccttacctgcccctggaaagtctgagaccactcggggcggggcggctgccggagggtgggctgcggctccgtggcgggttccagaggggcggagcaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttccaaaaaataatctagtaacacaag

SEQ ID NO: 649198 - DNA, 221 bp, Homo sapiens
tcccgggtccagctggctattgtgcagagtcatgccatcactgggcactgcgaatgccatgactgaagaattaagagccacccctcaggcgcaggcccaggtgcagggtcgagctctttctaggatgttgtacgtcggaatagagtgctggccatctttccacgctgcttgccgtgcaaaggatgcagcctctgagtggtactcgagctcgaacttcagta

SEQ ID NO: 649199 - DNA, 179 bp, Homo sapiens
tttacaaaaataatttttaaaaaaagctgggcatgatgcatacctgtagttttaaatacttgggaagctgaggtgggaggatcccctgaacccaggaggttgaggctgcagtgagccataatcccccccctacaccccagcctgggcaacaaagtgagaccctgtttcaaattaatcca

SEQ ID NO: 649200 - DNA, 254 bp, Homo sapiens
  misc_feature (38)..(38): n is a, c, g, or t
  misc_feature (42)..(42): n is a, c, g, or t
gtcctgcgatgtgcgtgcatgtcacgactttgcacttngggncccgtttgtaaaatgaggattaaaatgatcccactgcacaacccggggttgctcccagaagggcagagggcagagggccgggggcaaggagagaagcaggagtgaagggtggagcccttgcctcaggggcaaccccattgccccatgactaactccttcatgcctgggagccgctggcagaagacagactcacatggcacgcgacatcgcca

SEQ ID NO: 649201 - DNA, 272 bp, Homo sapiens
catcgtggaaaaggggtgcctggtgatgtctgtctctttcctcctcttcctgcccatgcaaaggactagagcatctgtatcaaccccggaggttaagactgtggggtcctgtgtgctggtccatcaggttatggtgaggaggaggaagaaagccacagtataaggagacataaagttgggctgggcctctggcaggtgaacggttcttgaggtctttattgtctgatcagtaaacacctctgtgtgccagaagctgcgcctgggtgcggtga

SEQ ID NO: 649202 - DNA, 158 bp, Homo sapiens
cccaagatttcatcccagtactcagaaaccccccccatttaaaagttatgaattgtttatttttggaattttccatataatatttttgcccccagtttcccatggataactgaacccatgggaagtggaactgtggataaggcaggactcctgtaact

SEQ ID NO: 649203 - DNA, 138 bp, Homo sapiens
gaagggtctacatgagcaactgtagaggggagattcagtgtggtgggggactgagtgtggcaggcactccccagcagtgagggtctctctcctcctctgtgctgcctcctctgttaccctcgctctgtagctgtccag

SEQ ID NO: 649204 - DNA, 327 bp, Homo sapiens
tcacaaagtgctgttgattacaggcgtgagccaacacacccagccttgttcattaatttatttagataccgggtctagccgtgtcagccaggctggagagcagtggtgtgatcatggctcactgcagcctcaaactcctgggctcaagcaatcttcccatttcagcttccgaagtagctgggaccacaggtatgccccaccaggcccagctaattttttttcacttctttagagatgggagtcttgctatgttgctcatgctattcttgaactcctggcctcaaggaatccttctgtctcagtgtcccaagtcgaggcaaccggcag

SEQ ID NO: 649205 - DNA, 854 bp, Homo sapiens
ggtgggccatatccgaggcctctggacccgtcggcgcgattatccaacaagtgggggtgaacgtaatgtcaagggaaatagcaaattgaacttcacttagcccatatggaaaggttgatgtcatatcgcatcgctgcctgtttaacatggggctaattcctaagtggtgggcacctgggctttgtactggaacctggggacacctgatgccctgtcaccactagcgtatctaccgtattgacccattcttggaattgcctgacccaactgaggtactgattcggcgtgaccagtgtgtctagtaggcatgtgggcagtcatagtacgcaagtctcgtggaatcctcgtgagactgctcacctcttcgttatcagtggcatactccaacagttgattaggtcagtgagcgatgtatcgtatagttgacacactgtggggtgcacaatagatccatcgcaaggacgtacataatccctcctaggatatcattggccatcctgggtatggatgaactttctagaggaagagcaagttgaccgtgtcccgtgcacggaaaatacagcgtttcgttgtctcagccattccaggttgctgaggtcttcacaggtcataatgggcaagactggtacccctgaaggagaccatcaaaggattccagcagatatgttggcaggtagaatatgaccatctcccagaactaggccttctatatggtgggaccacattgaagaaagctgtggcaaaagatgataagctggctgaagagcattcattgtgaggggtctttgtcgtcatgtacatgtctctctcctcgcccctaacccaaaaagcttcatttttctgtgtagtcgtac

SEQ ID NO: 649206 - DNA, 336 bp, Homo sapiens
  misc_feature (266)..(266): n is a, c, g, or t
  misc_feature (268)..(268): n is a, c, g, or t
gagctactgagtgaaaccctaccttaaaaaaaaaaaagctgggggctggagttgccagcactcatagtaaaagctgtccacatcccataactctagacccaggccattcaacacactcttctgggctctgtgggcacctccatgccaaaagctgattcttagtcggtcattttctgagtagagtcgtaaaacatgttccctttcctggaagaggcagacctgcatatcactcagagctttctgcaattctgcaatctcttcctccntntgctgcaagttccactcaagtttatgctgggaaaaaaaaagagtagtatcgatgtcgagcgatcacgc

SEQ ID NO: 649207 - DNA, 267 bp, Homo sapiens
  misc_feature (105)..(105): n is a, c, g, or t
  misc_feature (109)..(109): n is a, c, g, or t
  misc_feature (122)..(122): n is a, c, g, or t
ttaacttttgtatatggtgagaagtaggagtccagtttcattcttctgcatatagatatccagttatcccagcactatttattgaataggaagtccttttcctanttcnatttttgtcaagnggatatccagttatcccagtgctatttattgaatatggagttctcttctcattgcttatttttgtcaactttgtagaagatcagttcattgtaggcgtgctaccttatttctggcttctccagcctgttcccacgctctatgtgt

SEQ ID NO: 649208 - DNA, 759 bp, Homo sapiens
  misc_feature (536)..(536): n is a, c, g, or t
  misc_feature (701)..(701): n is a, c, g, or t
acttcataaccagaatgtctgttggctagagctgtcacagataggcagggcacttgggatatgacctttctgtccaggtgaatcacagactagacctttcttatcctcctcctagagtttgacttgggctctagtgttaagatgatgagcccgtgcatcaggtcttctgcacttggtggaagtctcccaggttaggttccattttgtgaaacgagtggaatcgtgttccagtgataaagtttagtgacctcatcctttatttttttttctcatctggccatggtggtgtcttagatggggtttaaattggacatgaatggtgggtaatggtgggttctcagaaatgggtcatgttttggcccaaacatagcttctggctctggtctatactggactcaatacctttaggtatcgtttcagagtttgggatactagtgtaaggggtcggtggtccccactacttaatggggagaatagtgaaccaataaaggtacgcggtattaatggggcatgtcatctaagagaggggaaatagngggtaggggtcaattctgataaggacggattcgaaaggagattatggcgggtggacatcaggttcactcagatgtaccattggatttaactatctaatcagagattctatgggtacctaggtccccctgtttgcgtatcaggttgaggaaattacgaggctgtantccatacgatgactagtcgagtggagtaccatgttctgggatgtctatgcaaatatta

SEQ ID NO: 649209 - DNA, 156 bp, Homo sapiens
tgactgcggtgatctaaggatttcatcggggctttctcatcatcatgataggactgaagtccgtcttatgggacttgaggcctcaagttcatataatggcagcaaaggctgtagcaaataccaatgagaacatcacttgtgaccaaatgggcttga

SEQ ID NO: 649210 - DNA, 110 bp, Homo sapiens
cccaaacccacttccactctaccaccagacaaccttaggcaaaccatttacccaaataaagtataggcgattgaaattgaaaccttgcgcgattatgatatatggtcccg

SEQ ID NO: 649211 - DNA, 300 bp, Homo sapiens
cgtcggtgctcgagttcttctcgatgtcatagctcgtcgcccatgccgatacgcccagagcacggaggggacgcagttcctgggctcggcgtagacgcgcgaggcaggtcgaggcgctacgcggtgtggcgcagcatgtagataaggtagacgttgagctccgagaggatggttcggtggaagtctgggagcgtcgcccatcatcttgatcatgatcgtgggcgagttgctcagatcttgggcggaagctgtctcggtttgggcccgtcaagggtcgacctttctctctgagctcttgct

SEQ ID NO: 649212 - DNA, 450 bp, Homo sapiens
tcgcacaacgaataccaaggacacgatcaacgcctttaaccatctgaaccaatgtggcgcaagcacaccattgctgaagccgctgccttcattcccatcagcactgtgcgcttatacgcatatcgacttactacacgcttaactacctggtatttgcatactggtgcaatgcacgtttagcatgtaacgaattcagcaaggcaatctttgttgacgagcatgtctctggttattccaaactgggagagttccgcgagatgaatgctattaatttgcatgagccccatatcgtaggagccgttcttgtagtaagagacttttccagtcgtgccaccttcggtgcgaatgatggccttgaccaagtcgggatgcgcacggtaatgagccgctgctcggacgatgcagacctcgcgagcttggccagtaatgtgcggactaggtggggcctgt

SEQ ID NO: 649213 - DNA, 133 bp, Homo sapiens
catgtatgcaagtcaggagataaagaccagcctaaacacggggaaaccctgtttctactaaaaaaaaaatgcaaaaaattggccgggcatggtggtgggcgcctgtggtcccagcctactctaggaggctgag

SEQ ID NO: 649214 - DNA, 396 bp, Homo sapiens
tatctgggaaacccatggacctccgactcctgagcgtgaactgagcacctcccgaccctccgactcctgagcgtggaactgagcacctcccggccccccagatctaggaggggtgacaaaaccaacctatgaccctgtgagcgaggaccaagaccccttgccagcgactttcaagaggctgggcctgcggaaaccaggctgtcaccgagggctgtggctggcgaagccctacgggcgggtgccgggcaccaaggcagcgagggcaaggggggctgaggttcacgctcatcgactcggggaggagcactggtaccgagcatacggccctgcgcgcccttcctttgggcagctggccatggacgcctgtccctgcaggacgagaccccgctcaaagcc

SEQ ID NO: 649215 - DNA, 463 bp, Homo sapiens
  misc_feature (58)..(58): n is a, c, g, or t
  misc_feature (272)..(272): n is a, c, g, or t
gacataccccaagactgggacaatttacaaaagaaagggggtttaatgggaccttaanaggtccccacatgggctggggaagccctcacagtcatggaagggaagggcaaagacgggagcaagtcacatccttacatgggatgggcagcagacaaagcgaaagagtgtgtgcaagggaaactccccatttttaaaaccatcagatctcatgagacttattcactctcatgagaacagcaagggaaagacccacccccatgattcaattatcntcccactgggtccctcccacaacacatgggaattatgggagctacaagatgagatttgcctgggatcacagagccaaaccatatcagtgtccatcaatggatgaatggataaagaaaatgtgacatatgtatagatagatacatacatatatagatagatagatagatagacatatacaatgaaatactat

SEQ ID NO: 649216 - DNA, 353 bp, Homo sapiens
attcgcggccgcgtcgacttttttttttttgatggagttttgctcttgttgcaccaggctggagtgcaatggtgtgatctcggctcaccacaacctccgcctcccaggttcaagcgattctcctgcctcagcctcctgagtagctgggattacaggcatgcgccaccactaacgtgcccggccaattttgtatttccagtagagacggggtttctccatgttggtcatgctgatctcaaactcccaacctcaggggatccacctgcctcggcctcccaaagtgctgggactataggcgtgagccactgttcccagccgaggctttaactttttgtcgacgcggtcgcgaattc

SEQ ID NO: 649217 - DNA, 333 bp, Homo sapiens
ccagaaactgcctgccatagtgaccaatgagaattcatgaatgagctgggcatggcggcgcatgcctataatcctagcactttaggggctgaggctggaggatcactagaggtcaggagttcgagagcagcctggccaacatagtaaaaccccgtctgtactaaaatacaaaaatcagccggacgtggtggtgcgtgcctgtaatcccagctacttggggagcctgaggcatgagggtcacttgaacctgggaggcggaggctgcagtgagctgtaattgtgcaactgcactccagcttgggtgacagagtgagacactgtctctaaaaaaaa

SEQ ID NO: 649218 - DNA, 118 bp, Homo sapiens
caccacgaagaatagtgatgagtttgctaatacaatgccagtcaggccacctacggagaaaagaaagatgaatcctagggctcagaccactgcacaggagcaaaacctgtcgcgtccg

SEQ ID NO: 649219 - DNA, 241 bp, Homo sapiens
cactccgaaatatctagggtgaaaattacatccgcagggttcggataagaccacggtgttgcttgttcagtatctcaagcccaaaaagataaattaatccttgaaggaggcaagacaacggaggaaaaataagtgacatgcttggcccggctaaagaccaaagccagacggtgactcaggttcagcacgtcattgagacggctcagacagggacgacggtagggaacaagacgggaacgga

SEQ ID NO: 649220 - DNA, 144 bp, Homo sapiens
gctgacaggttggtcatttgttgctggaggattttcactgtcctcctgtgggctcatggtgctgtaacagctccgtgccccagttcatggcggaactttctggccgtctggcggtcgccgctgtccttcagtcgtgtcacgcac

SEQ ID NO: 649221 - DNA, 1012 bp, Homo sapiens
ccactgaatgatcctggtgtcgccatgggccgccgccccggccgttgttacccggtattgtactgaacaagccgtacccaaagtctcgcttctgccgaggtgtccctgatgccaagattcgcatttttgacctgtggcggaaaaatggcataaagtggatgaagtttccgctttgtggccacatggtgtcacgatgattatgagcagttgtcctctgatagtccctggcaccggctgcccgaattttgtgccaataatgtacatggtatcaagagttgtggcaacagatggcttccatatccgggtaagcggatccaccccttccacgatcataccgcgatcaactaagatgttgtcctgtgctgggtggctgacagtgctccaagacaggtcatgcgaggtgcctttgggaaagccccagggcactgtggccaggttcacattgggccgagttatcatgtccatccgcatccatagctgccagagaccaaggagcacgtgtgatttgagtgccctgacgcatggggcaagttcaagttttcctgtgcgccagaagatcccaatctcaaaagcaagtgggggcttcaaccaaagttcaaatgctgactgaatttgagagacaatggtggctgatacaagcggctcatcccagatggctgtggggtcaagtcccatctccagtcgtggccctctggtacaaggtggcaggggccctgctgcatcatgacggccttcaatgtgctgcccccttctttattactcaaccatgtaattctactacctggtccaaaatacaacgagatcctgaagaaacagcgcggcgtcatccaagaatctcacacagagtgccaaaatatggataccgccactctcttgacaagagggcccctatagtaatctataaaaactcacaagagagtgtttaaacataaaattggaaaaagaccatcgctctttcaaccaccactttgtgcaatatgtggacatccacgaatacagataacacatatcg

SEQ ID NO: 649222 - DNA, 300 bp, Homo sapiens
ccccccccccctcccgggggggggggttaaaccccgtgggggctttattcccacccctttttggggcccgggaaaggggcccccttccccggtggttttcccccgcccccccccaagcaaaaaattttggggggggttttttccaaaattttttgtcccccccccctttttgggggcctcccccgttttcccttccaaagggggcaattttttttttttttgggggggggaaattccttttcttccccctacctttgggggaaaaaccccggggaaaaccgggggtttttttatttttga

SEQ ID NO: 649223 - DNA, 193 bp, Homo sapiens
aaatccacaacgattcccagatcgaagcggatttccgattgaatgattctcataaacacaaaggttaacacaaagatcgagaacaccggcacaaagaacacatgaaggagaagggccggtaaaagtccaagcatagcaacagtgaacataaagattctgaaaagaaacacaaagagaaggagaagaccaaaca

SEQ ID NO: 649224 - DNA, 159 bp, Homo sapiens
cagctcggtacctatgaggctccgtccagaacacagcacagagagggtttcccgatgcccaccgctggacttgcccaagcctctgggagcccctcatctcagatcccttatctataaatgggggctgttatccccctccctgtgggatggctgttgggg

SEQ ID NO: 649225 - DNA, 261 bp, Homo sapiens
tttcctgcacttcgggaggccaggagggaggatcacttgagtccaggaggttaggctccagaaagctagtatcatgccacggtactctagcctgggcaagaaagcaatggtgctgtctctaacttacaaaatagaaaaatggaacaaacttaaccacattaggttaaaaaaagaaaaatggaataaacttaaccacattaggttacggctgtagagcacttagcatgggatctgaatacacaggaagtgcacgaaacaaga

SEQ ID NO: 649226 - DNA, 486 bp, Homo sapiens
  misc_feature (259)..(259): n is a, c, g, or t
ctgctgcctcccgcgtcagtctattccaaaacctagtacaagatgttatctgatatagcacaaaagtcacttactttaatctaaaatcaaaactgtcatgaagttctgtggaagacatcatgatccctaaacattttgaactatttgacaaattagcagacataaaaatcctacccaaaacgaatctggaagactgtaaattaaaatttactttgaaatgcgaagcaatgaacctgttacatgatggcctctcttatcnacatggaaaagcttagaggtgggcagatcattttgtaatactatatttcgtgtttgggaaatttgaaaaaggggaggctttccaaccgggatcatctgggtttggatatgttcatgctgacaatacctgctgtcttcacgaggcattccaagatagtggtagtaaattgcaagatgaataacatagaattttcaaaatttgctccatggaccactgaacaataattc

SEQ ID NO: 649227 - DNA, 200 bp, Homo sapiens
  misc_feature (31)..(31): n is a, c, g, or t
  misc_feature (65)..(65): n is a, c, g, or t
  misc_feature (130)..(130): n is a, c, g, or t
  misc_feature (175)..(175): n is a, c, g, or t
  misc_feature (183)..(183): n is a, c, g, or t
cacccccatctaccaatcccttcctggcagnatgcagtccaacaccagagatggaggtaactggncaacggagaaaggagatttagatcaaccaaagaagcctaaagccccagacaatccatttcatggncattgtttccaagtgttttgagcctcatctctacgtgtatatcgnattccaanacaagaacctcgggggg

SEQ ID NO: 649228 - DNA, 108 bp, Homo sapiens
gaggagagccattgcatgctgataatcatgtgttgagtttgcctcagtagatactaaagcaaattgctcactgacagtttttttaaatgaccacctttgcatgctctc

SEQ ID NO: 649229 - DNA, 244 bp, Homo sapiens
attaggtctgttgcgagcgatggctgttattatgctctaggatagtacagagggtggctatgtgttgtcggggtgagatgatgtgaggtatatacatagcgctagtttagagtactgggcagtctatgaccaggatggggctcgaatggcttaggagtcatagtgagtcgtaagaggtatcttactataaagctatgtgtagctagtcatattagttgtggctcagagttgatagtcttggcag

SEQ ID NO: 649230 - DNA, 141 bp, Homo sapiens
cttagtttagaagcctctaaacttagaaaggattggggggaaaaattcattaattaatacaaactattctgctgttttacccgattcctaattgtgctttttcaataagttgaaatcaaaatgtacttttttcaaacagct

SEQ ID NO: 649231 - DNA, 524 bp, Homo sapiens
  misc_feature (60)..(61): n is a, c, g, or t
  misc_feature (316)..(316): n is a, c, g, or t
gaggaggcagtggcgtggtgggaagcgcagctcgaaaagcgatgccgtattctgtgtttnncctggggctgctgtgcccacttttcggtgtagaacccatgccggccttggaaagggcccgagctcgtgcagtgctgatgggcgcccaatagaaaaaataaaccgaaacgcccggggggccttggggcctgggcctggggccctttttggcccttccagaaggggcaagccccccgccactgggggcgggcctttggcggcacggggttttttgaaacccacaagtctttttcacccttggggccaaaacgcaacnggattggaccggtggccctttaaccaaatgggcggcaaacggccctgtgggcccctaaacctcggggcaaaaggacccatgggaggatttggggggcactttttttcggcttatagagggtttcccaaaacgggaaacagggggcccctaccaccttaataaataaaatttgggcaaactattgaaccaaattaaaacccttttcccg

SEQ ID NO: 649232 - DNA, 262 bp, Homo sapiens
ccatttcctgggggattttttcccccccccccccccccctcccttttttggggaaaaacaggccctggggtcccccttaaaagggggccctcccccggctcccaggggtcctaggggtcccccccccctccgccccccatggggggttcttcccaaaaaaaaagggggggttttttttcccccaggggttgccgggcccctgacttatttttgtggaaaaaatttggggccccttccctttaataaattttgggggggttga

SEQ ID NO: 649233 - DNA, 768 bp, Homo sapiens
gtgaatgtgcctgtgtgtgtgtgtgtgtgtgtgtgtgtgtgtacatgtacgcgtgtgcattgaggagagagagactgaacagagagtactttgctgctaacgaatccagtcgttgtgactaaagttctgacaaggtctcagtttccccagttgtgcaggggagtaggtcagacagggtttgcagtgtctagatttacgctggttagatttacctctaaaatcttaacgcagatgctgaactccataagatgccaaaggagtgctgaggagctggagtgtggtgggccctaccctcgacaacagacccagggagatacatcttggactccatgggaatctggattcaagaaagatgggactgaacgacgaggagcgaccgtgctcacgccatgagtgtcgagccgagcggagaatgttccaagtcatggtcatggtcgtggtggcatccttaaaaagcggatgtcggcgcagaatgtgcagactcagaacagagaagaaacgaccagtaagcggcgaacggaggaacgaccctaccaaaggggacacattcggtcgacagcgactgagacggaggaatacgccgatacagctctaacccaccaacacaaaagaggggagacgcaagcacaaacagcccagcggagcacacgcatccccatcccccaccaacgaaccaaacacccatggcagagccagtgagaaagcagggcagaggagacggggggagccaccaaaagcgagaaggcaccacgacaaattcaacaaatc

SEQ ID NO: 649234 - DNA, 805 bp, Homo sapiens
gatcctggtgtcgccatgggccgcgccccggccgttgttaccggtatgtaagaacaagccgtacccaaagtctcgcttctgccgaggtgtccctgatgccaagattcgcattttagactggggcggaaaaaggcaaaagtggatgagtttccgctttgtggccacagtggtgtcagactgaatatgacgcagcttgtccttctgaagccctggaggctgaccgaatttgtgccaagtaattacatggtacagagttgtggcaaagatggcttccatatccgggtgcggttccaaccccgttccactgtcatccgcatcaacaagatgttgtcctgtgctgaggctgacaggctccaaagaggcatgcaaagtgcctttggagaagccccagggcgactgtggccagggttcacattggcaagttatcatgtgcatccgcaccaagactgcagtaacaaggagcactgtgattgaggccctgcgcagggcaagttcaagtttctggcgccagaagatccagatctcagagaatggtggggcttcaccacacgttcaatgctgatgaattttgtaagacattggttggctgaaaagcaggtcatccatgatggcctgtgggggtcaagtaacatgccccagtcaggtggccctctgggacaaagtggcgggcctggcactcatgagggcttccaatgtgctgccccctcttaatacttcaccaataaattctacttccctgtccagagaaagaaccaatggaaaaattttgtggactccttgggggtcggacacacaaagggttacc

SEQ ID NO: 649235 - DNA, 340 bp, Homo sapiens
tcgtgtcatcccccttcgtaaacttccccctgcgtgttcacaggtgacacttgttgtggctgctgcgggaagtctatgaagggactgcggataatgtgttaagtcttgtggaggtctgggcggctcccccggacacaagagtctactgtggccacgagtacaccatcaacaacctcaagtttgcacgccacgtggaagcccggcaatgccgccatccgggagaagctggcctgggccaaggagaagtacagcatcggggagcccacagtgccatccaccctggcagaggagtttacctacaaccccttcatgagagtgagggagaagacggtgcagcagc

SEQ ID NO: 649236 - DNA, 1127 bp, Homo sapiens
gtagctgccggagaacacgcacgcagctgacttgtgtcttctccgccaggactgtcacagaggtctccagagccttctctctccgtgtgcaacactgtggcaactcttaaggaaaaactcattggcaccagttgcggaagaagaaggcaacgagttccaaacaataagatcactgtagtggggttgtgggaacaagtgggtatggacgtgtgctatcgagcattcctggggaaagtctctggctgatgaactggcatcattgatggaatggtctgggaacgataaggcttaaagggagacaagtgatggatcgtgcaggccatgggagcattactttcttacagaacacccttaaaaattgtgcgcagattacaagattactcctgtgaccggccaatccctaagcactggtcgtgggtaacttggcaggagtccggtcagcaaagacaaggggagagttgggctcaatctgattgcagacgacgtgtccaatgtcttcaaaattccattatatccctccaagattcggtcacacgctacccagtcccttgattggcattcataaatgggtggatatccaaaaccacagttggaccattcttaacgatattgttacccttggcacacacttaagttggattaaccagaaaacaccggcgtgacttggcaaccgtggattgtcactctgggaattctggctagcattctacgccaacccattaatggctgaaaacaccctgtgcactttcaatcgccagcaagtttgccacatggagtcggatatcggggagacaccacttggcgaccctcaaggatttgcacatatgctgggactgtggtgtaaaatggtgaggcacggagtgtacatccccacagggcaattggcaccccgcgaacacgggtagccaggaaccacagccatggcacacttgcaccggcaagcctgcaaacaaatgcgtgcgacaaccatgcacatacaaggcctaacgccaagaggagtacccaccaggggcaaaagacaagcgggggcagaaactggacccgtgtagacaactccgcaccacccggagcaacagagagaagacaaaagcaaaaacccacgcacaccacgccagacggacagtacg

SEQ ID NO: 649237 - DNA, 819 bp, Homo sapiens
ctggtacgcccggatacgggattactcagtgcgcggcctaggtactgggcctatggtgccgcgtggtggcgcctccatggcggcctgtgttttgatttggatttggagacggaggaagtgcatcgagggcgaggtgcgagccagagctcatcccctgcatgcctgtgggacactatgaagagtgtggagctgactgataccagcgttgaacgttggcccagagcgcatctgggccccactgcttatgagcttgctgctgtgtgctgggcaagggtgggctatggcaaggtgttccaggatgcgaaaggtgcaagtgcaccaacttgggcaaaatatatgccatgaaagtcctaaggaagggcaaccattgtgcgcaatgccaaggacacatgcacaatacacgggctgcagccggaacattcatagcagtcaggtgaagcgcccctttatatgtggaacttgggcctatgccttccagactggtggcaaagtctacctcatccttgagtgcctcagttgactgagctgtcctgagaggcagtggctgggtctcttcatcctgtccccagcttcagccagcacagtggccatgcaaccgagtaggcgtcggtagatgtcagctgaattgaattgaatccccacggcaggctctgtgaggcaggttgccgagctcttcacgcatcttggagcgagaagggcattcttcccttggaaagatacggcctgcttctaccttgtgctgacgaatcacgctggcccttggggccatctccaactcccagtgtcatcatctacccggggactacaaggcccgagaac

SEQ ID NO: 649238 - DNA, 251 bp, Homo sapiens
gatcctctcctgaagctaattcggtgatgtagaataagatgcggattctgaggaacaggctaacctgcagtctttacattcaaaggagaactcttctaacatgaagtctctagtaaggctaaattatagctcaatatttacctgcactccttactttaatttattatttcccttaaaaccagagtcaagctctaatggcccaggcctgaagtggcccttatggcccaggctgcagatagctttaattgccc

SEQ ID NO: 649239 - DNA, 300 bp, Homo sapiens
tgtctacgaccctagacagcggaccccagccctggaccactgtcctactctgtctgtgagctgtgacagttttagatccacatatgagtaacatgcagtatctgtctttctgtgcctgggtcgtttcacttaacataatgactttgggttcatccacgttgtcacacatgacaggatctccttcgttttcatagctgaataatattcagttgtgtacacacaccacattgtcattaaacaccaaaaatttttaggttgtttccatatctcgggtattgtgaataacgctgcaatgaacat

SEQ ID NO: 649240 - DNA, 276 bp, Homo sapiens
acatcccctttccatccgaaaggatgatgaagttcaggttgtacgctggtacactgataacaggtcagcaaattggggaagtagtccaggtttacaggaagaaatatgttgatctacattgaccgggtgcagcgggaaaaggctaatggcacaactgtgcacgtagtgcattcacccctagcaatggttggttatcagtaagctaaaactggacaaagaccgcgaaaagatcctcgaacggaaagccaaatctcgccaagtatgatggaaaggggg

SEQ ID NO: 649241 - DNA, 1355 bp, Homo sapiens
  misc_feature (1150)..(1150): n is a, c, g, or t
ggtcacaaccgccgcttataaaaagttggacccccccccgcccccaagtggggggaaaagaccaaagacattggggcgtattctataacaaggggctttcaacagaggtgggtaaatatgtaattcccctctgggacaaccaccgcattccccacaagaggccgccccacaaaatttatagaggcggcgccccgcggcggcgttataataggcccccccccgctgggtgtatattttggggagatttgcgccgaccacaccacccgggggctgtttctacacaacgtttgtggacaacaatggcgcacaaagttgttttttgcccctgggagaagtccttgtaaaaaagggatgataaaaaggagatttaggagatttccgcccccgccttttttcttcggggttatatacaataaacagctcttcgtggaagtaaaagatcatgggggcgcccccctcagtatagattttgttctccttcggaggaaaggttctcctcgggcggtgatgataaattgttctctgtccacaacaacttttgtgttgtgagaataatagtgggggttctctccctttggtggccaaccaacgagccacaccacaagtagtttgtttgttttggagagagaggccgctgttcttctctacagaggactactatattctccaccaccctccttttatggtggggtgtctgccccttttgcttcctgtgtctgctgctgtgaagaatatatggagagtagcacacagcacacacagcgtttgtgcggcgcgtgtgggggtgtgtgcactactctacacaagcgcacagcgtggtgacacacacagagagagggcgctgtgcgtgtgagagccgcgccacacagggtcacaccacacagtctgtgtcccaacagagaaagctctgcacagagagaggccgctataatatgagaatatattatatctctcccctataatatacccttgcgcacaccccagcacgtctttataatacacagtgtggtgtggagatagaacaccggtgtctcacacagagacactcgtgttttggttgttgcacacattggcgcgcacatctttataagttctaatgtgagagtatacataagagactctggttgtataatgaatataccacacatgngcgacttccgtataaacacctcttcacgagaggagaaaggaggaaatgttttgtggagccacctttggtgtttcttttttgcgtgtggcacgttttaagttatattatgtttttaaaaatcacgtaactttttaaatgggaaacacaacttgagcccaaaatttgtcacagaattttgagaccccatttaaaaagtttaatgaga

SEQ ID NO: 649242 - DNA, 721 bp, Homo sapiens
  misc_feature (1)..(1): n is a, c, g, or t
  misc_feature (211)..(211): n is a, c, g, or t
  misc_feature (234)..(234): n is a, c, g, or t
  misc_feature (237)..(237): n is a, c, g, or t
  misc_feature (246)..(246): n is a, c, g, or t
  misc_feature (256)..(257): n is a, c, g, or t
  misc_feature (270)..(270): n is a, c, g, or t
  misc_feature (297)..(297): n is a, c, g, or t
  misc_feature (311)..(311): n is a, c, g, or t
  misc_feature (320)..(320): n is a, c, g, or t
  misc_feature (330)..(330): n is a, c, g, or t
  misc_feature (346)..(346): n is a, c, g, or t
  misc_feature (348)..(348): n is a, c, g, or t
  misc_feature (350)..(352): n is a, c, g, or t
  misc_feature (370)..(370): n is a, c, g, or t
  misc_feature (405)..(405): n is a, c, g, or t
  misc_feature (408)..(408): n is a, c, g, or t
  misc_feature (410)..(410): n is a, c, g, or t
  misc_feature (412)..(412): n is a, c, g, or t
  misc_feature (414)..(414): n is a, c, g, or t
  misc_feature (421)..(421): n is a, c, g, or t
  misc_feature (445)..(445): n is a, c, g, or t
  misc_feature (454)..(455): n is a, c, g, or t
  misc_feature (475)..(475): n is a, c, g, or t
  misc_feature (477)..(477): n is a, c, g, or t
  misc_feature (479)..(479): n is a, c, g, or t
  misc_feature (483)..(483): n is a, c, g, or t
  misc_feature (485)..(485): n is a, c, g, or t
  misc_feature (492)..(492): n is a, c, g, or t
  misc_feature (506)..(507): n is a, c, g, or t
  misc_feature (510)..(510): n is a, c, g, or t
  misc_feature (512)..(512): n is a, c, g, or t
  misc_feature (515)..(515): n is a, c, g, or t
  misc_feature (517)..(519): n is a, c, g, or t
  misc_feature (521)..(521): n is a, c, g, or t
  misc_feature (523)..(523): n is a, c, g, or t
  misc_feature (525)..(526): n is a, c, g, or t
  misc_feature (535)..(535): n is a, c, g, or t
  misc_feature (549)..(549): n is a, c, g, or t
  misc_feature (551)..(551): n is a, c, g, or t
  misc_feature (554)..(554): n is a, c, g, or t
  misc_feature (561)..(562): n is a, c, g, or t
  misc_feature (567)..(567): n is a, c, g, or t
  misc_feature (570)..(570): n is a, c, g, or t
  misc_feature (576)..(576): n is a, c, g, or t
  misc_feature (578)..(578): n is a, c, g, or t
  misc_feature (580)..(581): n is a, c, g, or t
  misc_feature (583)..(583): n is a, c, g, or t
  misc_feature (587)..(588): n is a, c, g, or t
  misc_feature (590)..(590): n is a, c, g, or t
  misc_feature (592)..(592): n is a, c, g, or t
  misc_feature (596)..(596): n is a, c, g, or t
  misc_feature (599)..(600): n is a, c, g, or t
  misc_feature (602)..(602): n is a, c, g, or t
  misc_feature (605)..(605): n is a, c, g, or t
  misc_feature (607)..(607): n is a, c, g, or t
  misc_feature (611)..(611): n is a, c, g, or t
  misc_feature (614)..(614): n is a, c, g, or t
  misc_feature (623)..(623): n is a, c, g, or t
  misc_feature (636)..(636): n is a, c, g, or t
  misc_feature (639)..(639): n is a, c, g, or t
  misc_feature (703)..(703): n is a, c, g, or t
nttaaacatgctctaattataaatcactgcattaaggacaatgaaaataatcaatttcggttatacaatatatacagttgtgctgcaaccaaagtaatcaggtgaatgaactgaatatcatacatctcaaaatagcatcctaagctgcatattatgttatccaccccttaacagatcacacagttactcttagtctgtgtacatgttctgngccatcatcccagatctgatggngantggcatgcnaaatgccagnntcctgcagctgcngttcatgaaacataaactttaaatatnaatagatatctacnatgtttttntttctcttanttgcttttttaatttncnannngcaaataactaagacagngtattagcagggtcgttaatataatttctcctctngtnanantnctattanttactgcacaatagcaccaaattntagactggnnatatatttcctaggtatttntntnccantnaacctgncagattagtttggnnctngngtncnnntntngnnatgaatcanctttattccttatntngcnggcaccnnggggncangaggcngncnntnacanncngntgcnggnngnttntnaagntanacataagtncactgtgcaaaanacntctgtttacttaaatctatgagaaaattaaatgaagggttcaaacagaaattaacaattagtgnaaacagatgtagtgcttt

SEQ ID NO: 649243 - DNA, 470 bp, Homo sapiens
  misc_feature (427)..(427): n is a, c, g, or t
tcaaaataaagctctgtcatcaaaattggagtatggtagggagaggatgctggcatgtgccgcaacacatccattagcgcgctggggctgcaccattttacatgtaagtacaggaactgaccacattatggttaatttacattcggaagcaaaaagtacattatctatcatagtgacatttaacttactgaggacagaatcattgttataaaactaataatacacttattattagccagataataataatctacttattatagccagatcataattatagccagaatgagctcctttgacacttcataagatcatactgctaaaggattacctagcaatgaccatgctagtgcttttggataagagcacgagtatgccatatacgctagtgacatctaaggcgtggacgaatcagtgaaactcaccncatattctactgtacaggcaatggagatgagcgatccttgatc

SEQ ID NO: 649244 - DNA, 776 bp, Homo sapiens
gtgataagccagccatgggtgggttggggattgattatctctcagcaacgtcatcctctgagagcagttggcatcaggccagcactccgagctggcagcctggtacaggccatggcccttccatggaggattcctctgctgatccatcaatggaaagcctaaagtcgtatctggtccaggttccatgagtgcagtcctggagccttctgctctggagcagcttgttaagtgcatgcagaagcagaagactagcatagcggggactaagggcaccagtgaactcctccactactgagtgccaagagtggcaagcctgggaagtgaaggcttccataagaccatgggcatgtccgggtttgcacggactgggtccacatcagttccgctcgctgtcaggagtagggcaaggcgcgcatctttcttactagatcttcatcggctcgttcacacggaggggctgtcacaggtagtttcgcaaccagggcgccgcttgagctcgtggcaagcggaaacactggttcagcacggtgcaaagccaaacagaggcacatgaatccaaatcagtggaagctctgtcggtcctcgcccgtggtggccttcctgggagggacgcagagagagtgacactggctggtgtagtctcgactccagttacttgggtatcacgcgcctctcacctttctccatcagatggcatgtcaccgcatgatcaccatggagaacgtgaaaggctgaagaaggggaaggcccgatggggactaagagcaatgggtgaa

SEQ ID NO: 649245 - DNA, 660 bp, Homo sapiens
gggcctcatttagagccttttggccccaaatattttttttggggaaaaattaattttaatttttaaactcttaaaaaaattttttatggggccgcctttatgaatcttattttatggcttctatgtttgaaaaaagaaaaattaaaatgggtttcccaccccgggggccaagggttggttccttaaccaaggggatttggtattaacctgggtaaaggggaaacccttttcacttaaatttccgggttattaaaaattaaaagaccttgggaggttttggaaaaatttcccccaattttccggtttgggcccaaaggtcaaaattcctttcccaaaataaatttggtaggggccaaccgcctcaaaaagccttttgggggtggctgccccttccccatttggaactccctttcattggtgccccaggctttttacatttcttaacccctatttatggcccccagtggaacccggcaacttttccctttagggcccggttgttttaaagaaacccccaattcaaaccatccggccccaaaaaaggggggccggggaaggttaaacaaactttccccacaattccgggcccataaaggccacgggggaaagggggcaaataaacccggaacaccccccgggtggggcctcccaaaaacccct

SEQ ID NO: 649246 - DNA, 148 bp, Homo sapiens
gatagagggactggggataatactggatagctgtgcttaggcagtaggcataggatatgtggcattcgtagtggttgcaagtggcttattgtcgcatgacacgtggttgtgactgttgttgttgcggggatccttccaaaagtctatc

SEQ ID NO: 649247 - DNA, 882 bp, Homo sapiens
tgaccagcttcatttgtcagctttgctcagatcagatcgatgggattggaatacattgtaactaaaatcttcctcaggactattaacccctgtcaaagtttctacagggaactgcctatgtgtaacaatgagaccagatttctcacttgctcttcatacttctatattgaggtaactgttgtagctatgaaatgcttatctgagaagtagtgcttgatacctgcatttctaccaattatcccattgtactgatgatttgagaggggagaaatagccagctgtatgtaaagcaaaatgttccagccaggcgcggtggctcacgcctgtaattccatcatttatgggcaggccacagctgtggcagactgcttgtagacccaggagttgaagaacgtggcagaaaccccgtatctattattgtaaaaaaattgactagaagtaagaaacaagaaaagggaaacacaaagtcgtatttaacagaagatgttgcgcaattaaattcgcgagcaagaactctctagattcggggaaactaggagcagaaatgagactcagcgacttctggttgactcctcaaaccatcgcgctacctaaagttgccactgggcagagacctcctgcaaagtgatcttaagacccctcttttatcccacaatacaccaagatataatccattgctatatatcccaaagtggtggcaacagcttcttgcttgctctggtcaactgccaactatgtttcccaagataattcatgacccactattaaatcctagtcatagtaactgttcctgcttacgatcctgctcaaggatacctcagtaagcacacggatacaccaacattctagccatatgtgccaaggtactaagtatcaaagata

SEQ ID NO: 649248 - DNA, 852 bp, Homo sapiens
ccatcaccctaacacccagcgcagagacagatgtatccctggctctaccgtgtgcttcatctacccaatgctgcctgggagggccaggtggaccaggggctgaggatgtggccgtgtggacgcgggcccagtcgcctacacgtcctggtcccggatggcccgtggccctgacacggagaacatggaggaggtggggcgctgggttggctcatcaggagcaaggagacgctggcggctgcatgctgccctgggtctgctcgcctcttccctctgtcctgggcgggacccaccagtatgcgacgtagagatccatgggccacgctctatacggcatcggccggccctgggcctagcggtagctaagctcgtgctgtgggatcggactggtgtgccgcgggaggcggcgagatctccttcttcttcctggagccctaccgctcgtcgtcctgcacctcctattcttcctgcctgggctgcttgggcggatccagggctgtggctgtgtgcctgaccagtggcacctgccacctgtgccagggcggagcccattgtggggatgacggggctggtgggtccctgctggtgctggtgcctaccctctgcccactctgcgaggagcatcgggactggccatcgcctgcacccaggaccccttctgtgagtgacggatccgatgtcctatttacgaatttacagagggtcggtgcggtggctcatgccttataatctagcgtttggagaggcccaggtgggttgtcccaggtcccgagttcgtgaccagcctggccatttggtgagaccgctgtcttcttggttccattgttgggttggtgccccttgtagtcggggacg

SEQ ID NO: 649249 - DNA, 111 bp, Homo sapiens
cgtactgaaaaagttcacaaatgtttgtgatgtgctgttagagctactgcttttaaaaggtttcataaaaccctgtctttagaaaacctctacatatacaacaggcagtag

SEQ ID NO: 649250 - DNA, 422 bp, Homo sapiens
tcccgggtcgactactactaaattcgcggccgcgtcgacggggtcagagaattccctttcctagtcaaagaaaggggttatagatggcacctggaaaattgggtcactcccaccctaatactgtgcttttccaatggactcaacaaatggcacaccaggagattatatcccacacctggctcggagggtcctatgcccacagagccttgctccttgctagcgcagcagtctgagatcaaactgcaaggcggcagcgaggctgggggaggggacgcccaccattgcccaggcttgagtcggtaaacaaagtggtcgggaagcttgaactgggtggagcccaccacagctcaagaaggcctgcctgcctctgtaggctccacctctgggggcagggactgcttcagtttcttgtcgacgcggcc

SEQ ID NO: 649251 - DNA, 325 bp, Homo sapiens
  misc_feature (16)..(16): n is a, c, g, or t
  misc_feature (20)..(21): n is a, c, g, or t
  misc_feature (88)..(88): n is a, c, g, or t
  misc_feature (111)..(111): n is a, c, g, or t
  misc_feature (138)..(138): n is a, c, g, or t
  misc_feature (140)..(140): n is a, c, g, or t
  misc_feature (166)..(166): n is a, c, g, or t
  misc_feature (184)..(184): n is a, c, g, or t
  misc_feature (231)..(231): n is a, c, g, or t
  misc_feature (251)..(251): n is a, c, g, or t
  misc_feature (266)..(266): n is a, c, g, or t
  misc_feature (276)..(276): n is a, c, g, or t
  misc_feature (279)..(281): n is a, c, g, or t
attgagatgggcaaanctcnntctctacaaagggagtaatcaagtaaatacctgttctctttcaatggactgttgcctattgagcatntgtggatgatgtgttttcagatnttccaggtgaagttctgaccctacctncntggacaaagacgtaaattgagagganaggacttcgtcttccgancaaccagcatttaacgaacagtggcttaatgcagatcactcaagagngcagcatagcaatgtaaaangaatataagtaggtnttggatgccnccnnncctagaccaggaatggggaatacataacacctgtgccaccgttc

SEQ ID NO: 649252 - DNA, 373 bp, Homo sapiens
ctataaccaccatgaggcagactgatagtcaagagaggtaagttgatatattcacacagatagtggcaaaccacgactatgaaactagaaattgcttcctagtgctctaccacaatatactgaacacacctcactcttatgaccaccatttttttttaagcagctttagatgtgacagtgtttatctgtgttggagagagaagaagatacatctctactcttaacacagcttggaaagcttattagtatcatggggactccctaatgttagagatacatctcaaacattagaaagacatcctaatatcaagcatttatttattgactgcttgctgtctgttcaacattgtggaatatcatgggaagataagtt

SEQ ID NO: 649253 - DNA, 994 bp, Homo sapiens
  misc_feature (379)..(379): n is a, c, g, or t
cttatctctgcgcgggccacccgttggtgcgtgggtcgcctgaaggcgccctccctcctggtccatatactgccgctcgatgttgatgtgcgtcgccgggtctgcttgttggctcgccgggatcactgtatgtctctttcgttagcccctgttagtctccccggcgcggtgtctcgtttgtgaaccgctccctcgtgggggcccttcgtgtcccgggggggtgttcatcaatcatatgggagccgctctttgcctgacggactctggtgtgctcggccgcccacccgcgtgtctcctttctaaggggcgccccactacacctcttctgcgcaaccacggtggattcaacaaagactgttactggcgaccagcggggggntctacccacggccgcagggggacacccgcggcacagtttggtgaacgacgccaccccgggccccacaagggggaaacgccgccccccgtagccacagaagtggtgtaaaaaatcactgcgggtgtccccctgcgcaagatggcgcgcaagggacggtatgtatctccacgacaagggtgcaagcacgcgccgccccccaaacaccgagaagtggggcgcaaacacccaggggccagcacctgctgtttagaccgcccaaaggttaagccgtcgccacagggacccacgccagatcgctaataaatatggggagactaccgccccccagagcaccacctggggtgcccacgtgcgaagagaacggataacaagtaggataaggggggcaatatcttgggacagattaaacgtcgcccacaaggaaaggcggagccgttgaaggggagcacacaggccccgtacaggcattaatcattattaaggggtcgacaatacccacaaaacaagaatgaaaagaggccagaacccaaacgacgcgggcaggcagtggtatgagggacgccccccccccacggtgcggggtctcacccaaaaccccgtcggcccaacataaca

SEQ ID NO: 649254 - DNA, 315 bp, Homo sapiens
gctcagaccacagcgattgcatcagtgtatgggtcagatggcaactaagcagaaagcttgccagctccgtaaaaaccaatgatttcagtcccttggtcgctatggagggtgaaaaagcacgttgcgcccgggctatacgcacaacaacggtgcgcactgcgcagcgtcgatgcgattataccgtgcgcccgccccatggaaatgactatagacactgcgtggtacactggtcggtaatctgtttccggaaccttagccatgcttgcgcccaaagctttcctcgatgccctgagcggccacgcctcccggtcgacg

SEQ ID NO: 649255 - DNA, 420 bp, Homo sapiens
aacgggatgcggttggtaaacaggcgaggtaagatatgcacgagttccgttatacggttatataagcgtctgcctatatgatcatgcctgtggttgggtctgacagcgagggtaataatgactatgattggttgattgtagatattggtgctgttaattgtcagtacagggtgataaactggatgcaagcgttatgtcggaggatacatgttatcatgttacgtaatactaacattagggctgctaatacgggtgatacattggtccaagtgggtgtgaggagttcacgataatatgttgtgattttttaagtcgcgcgtgtagagcttgaacgcttgcttaattggaggctgctcttaggcctactatgggtgtttaatctctgactctctctctacgtgtgtacccctagtgtcccag

SEQ ID NO: 649256 - DNA, 438 bp, Homo sapiens
tatgactagggaagggggcggtcagggacgttcctccaggaagcggtagtgggttctcatagccgtgccgctcagttcgcgcagctgtgctcctcagggtcagcatggggtccactccaccacgccatggctgatagccccgtagggcttcttcctgcgcaggagccagcatggagaggacgatgagggagcctccgcccggttccaatgatcagcagaaccgacacagcctcacggggacaccccttgtcccagctgggtgccagcgtcattccgtcttgaaatctccggatggagtggaaaaggggaaaccccctttggaaccagaacgcatttcacctttcggctcattactgttcccagcggggtatcagtcttctctatactacagggggaatgcaagcatcttgtttcatgtggaaccctttttgggaaggg

SEQ ID NO: 649257 - DNA, 451 bp, Homo sapiens
  misc_feature (79)..(79): n is a, c, g, or t
  misc_feature (105)..(105): n is a, c, g, or t
  misc_feature (185)..(185): n is a, c, g, or t
  misc_feature (250)..(250): n is a, c, g, or t
ccaccctatgcagctgacatagctgtcactcagcaatgtgagcaacaacactagagatttagtctgcaggtctctaacnatgcaagccatagggcaggtccatancactcctccactgagaaaaagacaatggcttaggctacaaggtttgggtcaccaaggaaagctgtcaaataatgaagtgngtaagcagattcctaaaaattggaaccatttcagcagcagtttcatccacagggagacagagtanatgctctctcaaatctgttctcacatctatagaaaccttactctatttatggtcttttggcatcttgctctgctatctcacttgagatcactcctatagaactaatagaggaataaatcaaaagcaaaccagtataagtagagacgcaataaaatttggatgtcttgagttctgaggggcttgcacacacttgttaaggca

SEQ ID NO: 649258 - DNA, 405 bp, Homo sapiens
gtgatggaatccaccattgatggacacccaggttgataccacgtctttgctatcgtgaacagtgctgtgattagcatacaagtgcatgtctcttttgtgtaaaattatttattgtccttagggtatatacccagtcatgagattgccgggtcaaatggtagctccactttaaattctttgagaaatctccaaactgctttccacagtggccgaaccagtctacattcccacaaacagtatataagtattcccttttctctgcagccttgccaacatccgttattttttgactttgtaataatagccattctgattggtgtgagatggcatcttattgtggttttgatttgcatttctttgatgttgatataatcaccaaaaacgtaaacatttcagttgctattg

SEQ ID NO: 649259 - DNA, 427 bp, Homo sapiens
  misc_feature (35)..(35): n is a, c, g, or t
  misc_feature (141)..(141): n is a, c, g, or t
aattaactgggcgtggtggcgggcacctgtaatcncagctaccgggagtctgaggccggagaatctcttgaagcgaagaggcggaggttagaatgaaccgagttggtgccactgcactccagtctgggcgacagagtgagncttcatctcaaaaaaaaaaaaaaaaaaagacgtcacttcacagattctaaggatttttggagttggataccaggaaaccggaagactaaatgtatacatatttcacaacatcacaattactgtgacagttttttttaaactatgttaaattacattaattgattatgttagtaattgtattagtttgctcagggtgccattgtaactacccaacatattgtccctgcccactgcctagactttatcaagacaggggaattgcaataaagagtttaattcacacaga

SEQ ID NO: 649260 - DNA, 101 bp, Homo sapiens
ccggccatgcttttcaagtgctgcagctcactgctttcctcctcacgtttccgcacagtgcccaccagaagtatgtccgacaagcctggcagcaggcagac

SEQ ID NO: 649261 - DNA, 146 bp, Homo sapiens
acacacacacagaatttaaaaaaaaaaaaaaaggcaatcattctaaatgtcctatgatagcttgttaaacgatgcaagtatgctatagaaactaaagtaattatgaacagcactactcattaacctaggaggtgtagaaatttgaa

SEQ ID NO: 649262 - DNA, 178 bp, Homo sapiens
tgggctgaaccaggggcatcctctccaccgagtataaatgctctgtgcggcagtctcaagtgttctcatcgttgaggtctcgttgcattggacagtgaaaaaggcagaccagatgaaaaccactttctacaaggcaaacaataacaacagcttctgtgaattaaacatctacggtgcc

SEQ ID NO: 649263 - DNA, 109 bp, Homo sapiens
tacatgctgttatcctacatatacctttctttcttttatatacttatccagttctcaagttattctgttatatgcaacatgaatatggactaagacaaaattggtactg

SEQ ID NO: 649264 - DNA, 123 bp, Homo sapiens
tcatggaagatctttggaaaggccatgccatccgtgcttgtactgctagaagcactttatgtttcctttatgggtgaaatggatttatgtgagtgctttaaacaagatagcaatacttataga

SEQ ID NO: 649265 - DNA, 1077 bp, Homo sapiens
  misc_feature (13)..(13): n is a, c, g, or t
  misc_feature (16)..(16): n is a, c, g, or t
agcgggcgtctgngcngctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacactcctccccaccatcctccctacctccttaactttgtactagactggcctgggcctgcccagctcagcgttatcagtctgtttcatattatttattattttaattttctattaaattattgaaataaagttaagttgagaaactggtgctggctcctggggagagggacggggagatgcctgtgttaggaggtatctggccgggcgtggtggctcacacgtgtaatcccaactactcaggaggttgaggcagaaggatcacttgagcccaggagttcaagaccagcctgggcaacaaagcaagaccctgactctac

SEQ ID NO: 649266 - DNA, 126 bp, Homo sapiens
cccgtttttgagagaggtactcacgggctcaggggccgatgcatacctcctatgtaagaatgctcttcccttgcggttattcatacacactttccacttcaaatatacccgaatatggctttcctc

SEQ ID NO: 649267 - DNA, 112 bp, Homo sapiens
ggagtattctagttgactctaggtagggcacaatctagcagtgatgactggataaactggacaactgtcactatctctctattagctccagaattccttggacacattgcag

SEQ ID NO: 649268 - DNA, 1082 bp, Homo sapiens
tgccaggcgcgctggcgtacggtccagccggctggatctggttccagccgcgccgggccggcctgggcatgcgcagtgtggatggctgctgagtgctgctaggatgtgctgctgggcctgggctggtgctgcacttgctgtggctgcatcccttgcccctgtgctgcctgtcctgtgccctgctgtggaccttgacatgcctgggtcagagtggcgaagctgtgctcagtgccctgtggctggactgcagatgccagagctgtccccagatggagcagagggtcctggaaagggaagctgaaaaaggaacggaatgaaacgaggagaggcagcgtctgcgggaggcaggccttgtggcccagcacccgcctgccaggcgctcgggggccgaactggccctggactacctctgcagatgggcccaaaagcacaagaactggaggtttcagaatgacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcggggagctggatgaggagggctctgatccccccctgccggggaggggcccagcgcatctgacaggtgctgcagttgctctcctagtgggttcagcggcgttgcgggccgttgccagtgcagggctgctcagaccaacatggtgcagctctcggcgtgtgtgggcgtgttcacaagcagggcagctggtgagcaagggctttcaggtcctcggtggtggggcgggatcccagcatcagagcttcgaagtggcccttcctcctcgaaccttcttggcgtgtcgcctgtaccggtatggcgggtcacgggctttcgggacagggtgatttcttgacttaccggaccgtgctttgaggccccacgcacgacttctttctgggagttatattccgggcaaataggatgggcgagtgtccccgtgaaagctcgtttcaccctgtgtatacaccatcgaggcggtggtttaccaacacacgtggcgcacgatct

SEQ ID NO: 649269 - DNA, 439 bp, Homo sapiens
cccctcgtggcctctggaatgtgtctcgacttgttggctccttgcttctagcactccaaggctcatagatcgattgtgtcttaaactagaagaatacgttttccattatctcaagtagcagaacatgttccatatgcttcaaagaaaattctaaaccatcacagctgtagatcatgcacttgatacactgctttttttcaacccccacatcctcaccacctgcttctttgatcaccaataaatagtgtgggcttccagggctcggggcctacacagccttcatactagtgttggcccctcgcgccactttatgcactcttgtctcatctgttttgactcgccggacttcatagtcccacagcctggggtgggtctgatcacccaacattctggcgccatgatgaggcacgacacccagtgaggacatagggtgtgtaaa

SEQ ID NO: 649270 - DNA, 131 bp, Homo sapiens
  misc_feature (89)..(90): n is a, c, g, or t
gacatttttacagtatttttttgtaaagcaaactattttttcccttgaatttggtatatgtgtattagtgaacattgtaaaggtgaacnnctacctctgtatctaaatgtataccatccacttgtaaatga

SEQ ID NO: 649271 - DNA, 976 bp, Homo sapiens
gtggggggggggggggggggggcgctctgctccttgcgcattttgtgccctgctcgtttggggcgttggtggtgccggttggcgtcgcgtggcgtgtgcgctggtgtgggggtcgcccgcgcgtccgcggcgccctctgctcgcgcgcgcttgtgtgtggtctgttgtggtgtgttcgcggcggcgcgcgcgcgggcactggactggcgcgcggtcgctcgtcgtgtggcccctccgcggctcttgtgtgtgtggggtctcggcggctcgctgtccggcccgctgcgctgttgtgtgtgtgtgttgtgggcggtcgccccctgcgcgtcgctctctctctgtggagggcgctggcgcggcgcggccgcgctctctctctctctccgcgcgcagatgtcgtctcgcgcgtctctccttggtgtatgatcggtgggtgtgtgtctctctctctctctcgctccctctctcgcgctcgcgcgctacgccctcaactaactcgcgtattaattctgatgtctgcaccacgtcttccgagcattctcgtctcactccactgtcgttttttctatgatggagaggagcacatcgggcctcacatgttgtgtggtttccccgatagcatgatgattgtccctggcgtgaggagctgtgtgtgtgtgtgagagagaagagtgcaacaaatgatgattggctcgatacaaccacatttcacctcttttcaccgagctactcccgacccgattcccggttagtatatattattttggttcgcacaccccatcgcaggtgtatcgttgactcaatagaaaacatgaaattagtgaagaggtgataatgggaaaaggaatgagaacctgtggctctacgcgcgcacgcttacagaagggaaatcatcatatatatagagcctatggatttatttcatgaacaggaaaaggataaaaaccagtgcatttaattagaacaaggaaagagg

SEQ ID NO: 649272 - DNA, 488 bp, Homo sapiens
  misc_feature (69)..(69): n is a, c, g, or t
acctctagacgagtgtgcatattgtctgtgtgcttgacacagcaagtcatctctgactgcacatctgtngctgcacatggtatcagttaaccctgcactgcatttaacttttctctgagttctttgagaaggggacctggctcatgggccctttggtatggcatccaatgtgtgttagaatctaaacagttagataattatcaacctgtgcctgaagactgccatgaatcaatatgtaaatgaatcagggcactggtcagtcttccagccccacttgatattaaagactcagtgaagatggttagcaaagcagaggacagcaaatgggtctccggcagctgtgaagcaccagagtttatccaaaggggggacgtgcggtctagagactcatctcaaagttgcattttcataacaaatacactgggtttttttttttatagctatattgggtatttgttggggcctaatggaaatttaggaggacccaa

SEQ ID NO: 649273 - DNA, 254 bp, Homo sapiens
atgcaccatttgccctcataatctgcagcatggcccagtgccgtgggcacacagcagggcctgcaggcaagtgtcttccatgtcaccatgctcctgcaaaactcacgtgcatggccagccgtggcagcttgcttggctggcatgttccagttatgcctatggaggcttccccttcatagcccagccgtcatgcagggtgccagtttatctcgtgtgcaggcagcacagcagccttgtctgctgcaaaatccatg

SEQ ID NO: 649274 - DNA, 670 bp, Homo sapiens
aataataactttttaaactgtatttttatgtctcaaaattactgatggtaatgtggaaactgtcactttttgaatttcagggtttatcaataaacaaaagtaatggcatgtaattacatatgaaatgatgctatttcagttgtggcatgcttctattataattatttccaaagctcactaataggtcaccagttaaaaattacttttcattaattctgtaaatgtgtaacctaatttacctttcttttcacagtcaaaaggcagatagttgaatagcatgagaaaggttaggagagatacctactttctgcagcttaccttagttgaaacccttattacctcatgcgttaagcttgaaccagcctctcttcctttaagctttcatcacttttcttgatattgttactagaactgtgttttaaaaatatctctttatggtgtcattccagcatacaaaggcattctgagattctccatttcctaattgataaattccaaattgttagcttgatatgaaggtttctaaaaatgtggcacagactatttcttactatcttcccccataattttcaaaaaggcattaggctatagcagggtggtactattgaagaacatgattattctttccattgattttgatcaggtgcttaagactggaggcttaaaatta

SEQ ID NO: 649275 - DNA, 610 bp, Homo sapiens
  misc_feature (552)..(552): n is a, c, g, or t
  misc_feature (568)..(568): n is a, c, g, or t
  misc_feature (579)..(579): n is a, c, g, or t
  misc_feature (596)..(596): n is a, c, g, or t
caggaaagtacctgtgcagatgctggcacttaaggcctatggagaaaacatcaggtgttatagagagtctgttgtagggaattaacgaaaagaccactgagttaagtcaaagaatggtctatttgagtttaggtggtctggtttatggggaccctggctaaggagcatactccaaattcttggtgttaaccctctcagtagtcataagaatagtctccctggtgcactgtattctctcaaaggttttaaatgtttgcatgaagccatctttagaacgtcagatggtctctcttcaactggaatgacaagagctgaaagaaatgtgtgaccacgaggacaccgaaaccgatgagtgacatgctgagactggaaatccaaaatgatagtaacggagagtggcgctaacatcctaagttttggtcacactcttgcctaagtgacaacctgacaaagggggaattttttaaactgatgggaggccattgttttggactgagcactatgtcccaacagaccccgaaccacacatgggtcctagaatagaccaggttntgtttttctcttgcanacaggactttncagcataaggtggtatnctcctcgtccttgt

SEQ ID NO: 649276 - DNA, 1083 bp, Homo sapiens
gctatagagagatttttacaagtcagattttatgttccccaaatcttttaaatgaagccagtgactcccagattctcaacacatggccccagtcaagacagaacaccatggaaaaaaccctgtaagtattatggcactctccgaatcctcctgaaggcatttcctctacagacatagtgttacaggaagtgcaaatgcaaatgtgcaatttatttttaaaggcagcttattaaacaaagtcacatcaatacattggtgtctgagaacatcagttgcctatattctaagcatttcatcaaggctgcagatatagcacgcattggacttcagattcatgctagccatgtaaagagtggtggactattaaaaccagtaagaggtatcattacaagtcacctggaacagactcaaagaccaggttctatatgggcaacagacaacgcaagaatcaagttctgtgctagtcccgagcagtgtgtactgagtaccataacactggaagtagctgcttaagtctagggacgtagatagatagtgactactataacaaataagcatagactgacaatgagagcagaagaccttcggaagcacatagtgtaacataaaatgtactccacaatggacagtccacatagctatctattacataatacagaggcttcatttacaatgctgtgataaaatgatgtagaacattaagacaacggaaagaccatagataacaagaggcgaacgagataccggaacaaaaataaacacgacaaacaacacgaaaaaagaaatcaccaaaacccagaacaaaacagcacagcacgcaaagaaagagagacggagacaaagaagagaccaagagaccaaaagacgaacacaaaacacgaacagacccacacgaggtcgagccaaacacgtacaaaacaacggcacaacagagaaacaaaacaaaccgagaacaagaagaagaaaaaagaagaagaaaagaaaagacaaaacgacatgaagaggaaggagcacagaagatacacagaacataacaacgaccaaaaagagacaagaagaagacacgaaaacacaaccttataa

SEQ ID NO: 649277 - DNA, 94 bp, Homo sapiens
ccaaggaggatacacagagaatggcttcctgttgttttgttttcttaacgtgtacagatggaaacttcatttaaaaataaaaacaaaacaactc

SEQ ID NO: 649278 - DNA, 140 bp, Homo sapiens
  misc_feature (80)..(80): n is a, c, g, or t
gccagttggggcccggcgagcacccccagccctgtatgtaaaccccatggacaaatcccgaatatattgtcaatgaaganaattggcttggccccagttcttggctatttgaattattgaaggaggattttaataattgc

SEQ ID NO: 649279 - DNA, 412 bp, Homo sapiens
  misc_feature (4)..(4): n is a, c, g, or t
  misc_feature (20)..(20): n is a, c, g, or t
  misc_feature (32)..(32): n is a, c, g, or t
  misc_feature (55)..(55): n is a, c, g, or t
tggnaacccctgggtgcagnaaactggtcganaacccaaaggtccctccccaaanatctggaaactgggcatagatttctcaagaaggaagactccccctgcctccccagggcctctgctctccctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccaatgcactgcagcctgggcgacagagcgagattctgcctcaaaaataaacaaataaattttaaaaataaata

SEQ ID NO: 649280 - DNA, 405 bp, Homo sapiens
gctcatgcctgtagtctcaactatttgggaggccgaggcaggtagattgcttgagcccaggtgtttgagaccagcctgagcaacatggcaagaccctgtctttacaaaaaatacaaaaaaatttatccagatgtggtggcaagttcctgtaagccaacgcttcgggaggccgcaggaggtggattgcttgagcccaggaattcgataccagcctaagcaacatggcaagaccccatctttacaaaaaataccaaaaaatctagccaggtgtggtggcaagttcctgtagtcccagctacccagggggctaggtgggaggattgcttgagctgggaggttgaagctgcagtgagccatgatcacaccactgcattccagcctagtcaatggtaagaccctgtctca

SEQ ID NO: 649281 - DNA, 92 bp, Homo sapiens
tttctgccttacagggctgtccctgaggctggatttgttacaaatgagtcatgacatcatactgtaataaaaacagcttgttttttgcttga

SEQ ID NO: 649282 - DNA, 270 bp, Homo sapiens
tggtgattagagatcttgaagcatctaacaggtcctgcactaatcaaaaaaacaaaactactagccatggatgtcatggcacgtttgttcgttggtccaaaagcctccagtggctttccattgcggattggcacggtctagactcagcgatcaaaacttccaccagtgattgctttaccaaaacatcttccctaattcctgttgtgaataccacctggtttacttattatctctggcttgcactaatctgggcagggactgcttgccggg

SEQ ID NO: 649283 - DNA, 84 bp, Homo sapiens
  misc_feature (24)..(24): n is a, c, g, or t
aagttcttccaggagaaagccatnttcagttgagccaagatgtcaagccaatggacaagcggagagttcactcccatttccacc

SEQ ID NO: 649284 - DNA, 409 bp, Homo sapiens
  misc_feature (45)..(45): n is a, c, g, or t
  misc_feature (79)..(79): n is a, c, g, or t
  misc_feature (282)..(282): n is a, c, g, or t
  misc_feature (297)..(297): n is a, c, g, or t
  misc_feature (337)..(337): n is a, c, g, or t
  misc_feature (368)..(368): n is a, c, g, or t
  misc_feature (383)..(383): n is a, c, g, or t
tcgggaggtgaaataagtcctcacgaaaagctgatggttttcgantgtggcacttccccctgctccccgcctcctgacnaccatgtaagatgtgcctgcctccacttccacccatgatgattcactgagctacactaaggactcagggaaaggctaatcagagactcagaagaatgcaactgcttgtctcttatctacctgcgaccctggaagcctcttacttcgagttgctctgcctgactggactgaaccaatgttcatcttacatatattgactgatgncttacgtatccctanaatgtataaagcccagctgtgtcctgaaaaccttgggcanatgttatcaggacctcctgaggctgtgtcanaggtgtgtccttaancttggcaaaaaaaactttctaaattg

SEQ ID NO: 649285 - DNA, 151 bp, Homo sapiens
tctagaggatctccattggatagcggatagggcgggagcagtcttccagaaacaggtgggagcagcgctcattttcatagccaagggtccaggagctcccaggagctcggcaatgggctggtccatggtgggtgaggggccagagcgtctg

SEQ ID NO: 649286 - DNA, 411 bp, Homo sapiens
tggccggaggaaaactttattatttaatgaaccacgtcttatgaacaggtggggggtaaaccacccaggacaattatgcgggttggattatgtctccagaaaatggaggctactttatttgattaggggggttctccaaaaacaaatttttccaagtggggtggggggaaaaaaatcaccattctaactttgcttctgactttaaatcttaaaatggctttggctttctaaccctttactacatgggagggactttgatagtttctattcgggaatattctattatttcctgctagttccatttaattccatcccactccactccacttaatttcattccattctcatttcatttataaaaggacgggcaggactcatgaaactgatctcatggcccactaataggttgca

SEQ ID NO: 649287 - DNA, 453 bp, Homo sapiens
tcagagcaccgcggggccacagaccagtacctctgtggctgttaggaatgggctgcacggcaggagatgagcagtgggctggcgagcattaccaccagagctctgcctcctgtcaggcggtgcaggattagattctcacaggagcgcaaacactattgtgaactacgcctgttagggatctagcttgtgagctccttttgagcatctatctaatgctgattatctgaggtggaacagtttcatcccgaaaccatcgcccccatctcctgccaccatccatgtcaaaactgtcttccacgagaccagttcctggtgccaaaaagtttggggactgctgttacaagatgaactgcactgtgacagctagtactgacgacagcaagaagccatctgtgtaacaggatcttgattatatacttctattaacactgggaaaagagacacaatgctcac

SEQ ID NO: 649288 - DNA, 123 bp, Homo sapiens
cacgtagctttatctacataaagtgacatcagtgcaggactggtgattttgctctactgtgtgacagatatcagagagacaccaaacaagccaggacaaagtccaccctaccaggagttagat

SEQ ID NO: 649289 - DNA, 796 bp, Homo sapiens
gcggcacgccttgagagcttcagtgtgccccaggattagaatcccaaagataatcagatgggatctcggggattgctgctcacctggagaagggatggaaataacttcacagcaatttgtgctgtaaacaacttcctccttgtaacctgagtaacagaggacctgttacagaatccatacttcagccaagacttctcctgaatctctcacagatatgtggatgagagtgggttaagcctcaccctagcaaaggagctaggctcaggcatggaaggaagttcgactgcataagaaacatggttgaggtctgagatttgtacacagagtcattcaagagttgcttgtggactactatgtgaagatacaagacacaaatgtaagttctgaggacaaaaagtttcatgagacccttgaacaggggctgttgtaactgaactgatgcggctcttaggtcctagccaggagagggagatacctccactgctggggctggagaaagcggagcttctggaagtcatgccatctcagaggatttgtgtggatgagggctcggtacagcagagaagtagaggagcaggttcaaaagagaaatgtttcactctggtctgtactatgattccaattcagatgctgacagtgaaaccgtggaaggcagaaaggtgtggaaaactcgcagaggtcctggtgggtgagcagaagcagtgcaggatgccaagagcagagaaggagcagatgttgtgctgggaagagagtgctgttactcgaggtgttctcggggctcatttgcgagaggctc

SEQ ID NO: 649290 - DNA, 989 bp, Homo sapiens
caaataaaaatatctcacataccgacatgtaggtacactcttcagatattttcccttataccattgctggtgaacttattcgaaaattcattccacagatgcacaactcttgtttaactccacaacctggctatcaccgctttctctgctttttccgctcaccctccccccactatcccccttatctttgggacaccccacctatcacccgtggctccagcccacaaattggaccgtggtctaacacttcgccagcttccatactataccccacgcaacccacgtaattgcaccctttgttggcaagccccttatcttcccacggtttcaccaaaggatttccgcgttgtttttccaaggaacccaccttcccccttggaatattgttggcaaaagcccggtgtgtctgctaggagaggctttttcaaaccccctcgccgccctcctttgtatgttacatgatcgcccccctggggcgagacattctcttccgcggtaatcctcccaccggggggggtgttcacccctcggtggggtaacgagtctctttgtggacaaaaatcccccccgtcttgccatgggccgtcgcgcccgcgataattccccgcccttcccctccaccatatgggggggccctggcgccacaacaccccattaacgtcgcgtttgtggatatactaacccaacactctctacatcatcggcacattacattactaccttctgtagaggcactgcgaaactcatttgttccccgaacaccacgaaagagttaaccaactggctcaaccactccttggtatcttaatcgtggtctctgtccccttctatgtcattttgtgcgttcttattgaacccttttactacccgcaccccgtaacacacgactttataagattcccctgcgggatttcttttaaattcttttcccgaaaaaaaaaaaagcccttttggggggcccacaaaacaaaaaacacaaaacatagaaa

SEQ ID NO: 649291 - DNA, 838 bp, Homo sapiens
ggttccaaagacctttgtttaacaccgccctttgtgctgacacagacgcctgtggatctcttggtcgcttgtgtgagttcacccacagacggttcctccctatatgggttttagggcgcctcccctcccatgctgatgtgattggacccccctttgtttaagggggaaccgcctcttggggtgcccaacggtggaccgccccccacaggggcccccttgttaccccacggaaaagggggttgccccttgggcccacaaggtccacaccctgggccgtgtcttataggcccccacgaagccccaattgctcccaagacgcttgcggtcctccttccccggaagccttttgggaatttaaaaccaccaaggggggaaccatcttggccgctttttccaaccgttttccccggcccgacaaatcccagacttgtgttgttccgcccatggtaaaatacttgaggaatgcctgggcctggtctgtctccctgtctccaggaattctgggcaccccagacctggcccagacctagaagactgtcacagaagggtcggagtctgtaaacccgcataccgtttggcttttttcaccatgatcacttttatatggaattaaaagatcctcgcatttatggtgtagcttctgagtcctgagactttttttgcgtgatggctatgccctgcaacacaaggtgttggtgatggggctgcttgagatgccttttgaaggtacatcgtttgccaatgtcagtttcctctcctgtccgtgtttgtttagtacttttataatgaaaagcaacaacagattgtttgggatttggaagttaagatttttaaccca

SEQ ID NO: 649292 - DNA, 616 bp, Homo sapiens
atagcatgagattatcttctctttaaaggtttagttaactcctgtaagaaaccacctggatttaatgactttttcaaaaaaaaaaaaaaaaaaaaaaaaaaaaaaaaaaaaaaaaaaaaaaaaaaaaaaaaaaaaaaaaaaaaagggggggggggcgaaaatttccccgggggggcctgggcacttttttgggaaaggggggctccctcaataatgaggctgacatatatttaattaacgacaaagacgcgggcggcggggtatataaaacaagagcgtgaagtagtgggagaaaaacacgtcaaacattggctaggaatcttcttgggaagaaacgaacgaaccactctatcttcgtgggggggggggaagcaaacatatgggtggggaacatcacactacaccctacacagaggagatatattaatgaagctcactcgaaggagggaataattatacaactaattatgaagggtcgagtattaggaggtggtggaaaacagccagcgtacatatgatcttggctggatgagaagaatatttgtggcctcaagcgaagcatgtagtatattagaaaaatatttatttacccagaggatctcttgtgataatagag

SEQ ID NO: 649293 - DNA, 224 bp, Homo sapiens
tgtggttctgtttctcaggctggaatgcagtatgcaatggtaggatcttggctcactgcaacctcctcctcccaggctcaagcaatcctcccatctcagcctcctgagtagctgggactacaggtgcacgccaccacacccggctgccttttgcattttttgtagagacggggtttcgccatcccggccaggctggtcttgaactcccgagctcaaacgatctg

SEQ ID NO: 649294 - DNA, 553 bp, Homo sapiens
cccctcagcttagcagctcataggtcggagcccctgtcctacagagctccagccgggcctgtcgttgccttatgctggaacgtctcgtggaatcttgtgccctttctttctgtgttggctgtgtcggggtggtctttgggaagcactatcatccaatggtccctcagtccgtttgtctcatctcgtctgtcccttccatgtctgagcatgcatgttatgttccggtgtacacatctctggagctgcatatgaggaggagggtaatcgtgcaagaaaacgtacacatggtgatagtcgttccgtgtcattataatgcaaagggccctagacccatgagtactcatacagatccttgttcacactatgggactttacttggatcctggcactgctctcgggtgaggatgaccactgtgccagtcaaatttgccaatgcatactgtacaacataagtggtgtagatggggctggagacagcgatgtaatgttgaagaggcccgtcaaccaagtaggaacttaagtcctgactgaggatacactggaaccatgagtt

SEQ ID NO: 649295 - DNA, 126 bp, Homo sapiens
ttttagtgacaaagaatttactacaacttctcttgctgtttctctgacccctcctttgcccttgcgtatggtcattctctaaatatttccttagtcttctgctcttctcccattgcaacacggtct

SEQ ID NO: 649296 - DNA, 119 bp, Homo sapiens
gtaaacttgttatccgctaatatcattggacattctgctggatccatggtatcttctcaaaatgaaagtccttccactatcgagtacagtgtctgaacgcagctgcgttacacttccga

SEQ ID NO: 649297 - DNA, 394 bp, Homo sapiens
  misc_feature (27)..(27): n is a, c, g, or t
  misc_feature (31)..(31): n is a, c, g, or t
  misc_feature (170)..(170): n is a, c, g, or t
  misc_feature (387)..(387): n is a, c, g, or t
agggtgcggagtttatggccaaattgncccnaaaacttacaatattttattcacgacaagatttctaacgattccaaatggagggaagtgcaaatcatattttctggccatgaagttccaggtgaaggtgaacacaagatcatgaactttataaggcatttaaaatcccnaaaggatttcaaccagaatacgagacattgtatttacggtcttgacgcagatttgattatgctgggtttgtctactcatgggccacattttgcgttattgagagaagaagtgacatttggtagaagaaatagtgaaaaaaaatcgcttgaacatccaaatttctacttattacatctttctttattaagagaatacatggagttggaattcctgcancccgggg

SEQ ID NO: 649298 - DNA, 289 bp, Homo sapiens
tccccaggttttggggcctagtttctgtttgtaaatcccaaacttgcctgaaagctgtgaaaaaaaaaaaaacccctggcctttgggcccggaggaattttttttttgaatcccccccggaactccctggcagtggattgtggggggctttttcttcccctaatcagggtgacctgggccttttgggcaggatcccagggtgaacccccctttgaacttttaagtccctagtccccctgggggccggggggcttccagtgtttgggcgaaaaaaagacttttggcccca

SEQ ID NO: 649299 - DNA, 418 bp, Homo sapiens
cacgagggggggtctctcacgcgtgtgaaatgcgccctttcttttccgagaatgcggcgtgaacactctcccggccacaacacaagagagatgagctttctacagcgcaaccaatgtgaatgcccacccaagaaagataccacccgacacagaggataagctcgaagaaagggaaatgggcgccatccaaagcgccagaaaccccgggataaggcctggggcgcgccatgtggtgcttggtcacagaggagaaagcatttggtcggaccagatccgcacacccgttaagggtcctgtggaaacacggaccagacgaagaggtgaaccctgccagaaggagactcccttaagggttccggtacccgatctctctcccggaatgactggttcaccgttctggtcatagacccgctgtggc

SEQ ID NO: 649300 - DNA, 892 bp, Homo sapiens
ggagagaactagtctcgaatttttttggttttttttttaggtttgagggggaatgctggaaatggtaaggggttatggaaacttgtcatataacgtaatgctagggtgagtggtaggaagttttttacataggaggtgtatgagtgggtcgtagcggaactcgggggtatgctgtccgaatccataagaacagggaggttacaagtagggtctgggtgaccaaatatgttgtgtagagttcaggggaagatgtggctgttcattttgttgtgccctaaggacaaattggtatctgggttagacgggtggtctcattcatcacataatggttggtgtgtatcccggctaatagaacgaatagggcagaagggcgcctgcgcggtattcgactgttagaagcctggagactagttcggaatccccccttacggcaaggtcccacaacgggggtccggtagaggcctctggacaacggagtgggcagataaaactcatattaggggcccacagggcccatagacggggccgagaagtaacacagagggtgccccccagccgtagcagcacaacgcggtcggaccaagggtacacaacaaggagcaacacaactaatcagagaatgtccgaacccgcaacaaactgaactagcactcaagggagaaacacccataatgaacaaatgtcactgggcaccaaactgcccccgccacgaacgcaccaacccagagacgacagaccacgaagtagaagaggcacacccatgatacagaaaatagatgaaacgcgagcagccaacaggtgggcacaacaacacctaagcagaccaaaccactaggagtcggcacaggagcacgaccatcggacgacgtgactacagataagcgccgtgtcc

SEQ ID NO: 649301 - DNA, 730 bp, Homo sapiens
  misc_feature (123)..(123): n is a, c, g, or t
  misc_feature (474)..(474): n is a, c, g, or t
  misc_feature (477)..(477): n is a, c, g, or t
  misc_feature (700)..(700): n is a, c, g, or t
  misc_feature (720)..(720): n is a, c, g, or t
aaagttagtctaactattagactgtcagactctgaagtgtttcttattttggaaaggtgaagacttgctttagtttgttcatagtttccttggcagctgctgatggttttgatggagattcanatggatttggaactaatgctaacttctgcttggtgaagatgctaaccaagttagatactcttcagtgaattctggtactgtgtacgattaatcctcatccacagtattacgctgtgcaaggctatatatacacaggattaatctttccatgatttccactgccctgaaggaaattagaatgtagtctggctccaagaaaacactagaaactacttcagctggtgatggaaaatagtggaattctatacatcctttgagacaatggaagcagcaaaccagcgttctttggattggggaatatttttggtactaactgaaaaacatcattttaagcctgggccctgcttaaanganacttgttttctcttccctctctccctctcttccttttttccctccttcctctttttctttcctcctttccttcttgtctccctcccttctccttccttccttcttcctctttttctttcctccttccctccctccctcccttccttccttttttcctttctcccctccttccttccttttttttcttccttccttcctccctccctccccttcttttcctccnttcttcctttggcccccctnaaacttgggg

SEQ ID NO: 649302 - DNA, 808 bp, Homo sapiens
ctaaagggaacacgtgtcctcttagttaaaggttcaatggagcgcaggtcaagtccaaaattcaagccacgtgatgtactccagacgtgttaatggacatctctggccgctatacatccagagaaagctacacccttacgcattaacgaacaagaaggtagtgaccttgcgtccagaagaacagcttgagacaagtttaaatatgcttacatgtaacctggatcctccatcttgataaggtacatcaataactgcagaaacatatgcaacaataacgcacgtgtgatgacgacatggtaacaaactagagcaaaagtcttaagcgagcactaatcatgaatatcctcagtgccagaaaaaaacagggaaattccgtaaatttcagttgccagcaagagggcttagcttattagttgactgcgatagaaatgaactgcgtatggcacaaacattcctgaacagctcttgcacgcgaagggctacgtctccactatacaacgctcagcaacattcatgaaacaatcatgcaactttttaacacaacacactctcaatactgagtacccgaaacggccaatcagaccattagcacgatacacctaggggacgcagccaatagttcaacaccaaagacggggtaccaaaaacagcaaccatcacagagactacctggcaacgcaaatcaatcaacctactacacaacgcaccacacgcacaacagtccatgcatcgcaccaagatcgacagacaacacgcagcccaataaagtataacaacaacaacaaccacatcagaaccgggaaacgaa

SEQ ID NO: 649303 - DNA, 438 bp, Homo sapiens
atgcactcccaggagggagggttctatggggctgaagtaccacagagggaaattatgacagcacaatacttggcccacaatcagtactcaaaaatggtagctaatatttccatttgaataacagcttggcgtgctggacagacactaggctagtcaccagaggtctgtgagggcatataacataacatgcataaaagcaagttgatttcttccttaacaagatggttgatacactttaaggccatattaggatattacctggaaatcctatagccctgtggggctaaatacatactagatacctaaaagccagtaaaccatggaagctaggcttggtttcaagctattacttacctttccaattcactgcaagagaaacttagtaatattatcctggaacaaacgactgttcagcagtatagacttcatttttcttta

SEQ ID NO: 649304 - DNA, 224 bp, Homo sapiens
accccgaccgccccagcgaacaccagttgcccctgctcaagggccacgagaagaacgagctggggatatggatcaataccgccaaccagttgctggcctccatcgagcgcaatacccacttgcgtcacgaggcggaaaacagcctgttgcgcatggcccagtacgacttcctcaccggcttgccaaaccgccagcagctgcaacaacagctggacaagatcctg

SEQ ID NO: 649305 - DNA, 306 bp, Homo sapiens
  misc_feature (266)..(267): n is a, c, g, or t
acacatgcgacggactgatcaactgttatccccacctctgatgattcctcagatgtccagaccaatgattgaacctgtccctccatgttcttcctgtcaactctgtaggcctcccttgctctcagcctgactcctcacagccagtgcttttataaggagaaggaggtcctggtgaagtgacagacatgagtcccctgtctgcgcttcagtgattgcctcctggtggtgattgtcccaatgcccccctccacttgtgatgcttgtcnncagatcagctcctgttctgcgattgtttgtggttacctg

SEQ ID NO: 649306 - DNA, 306 bp, Homo sapiens
acttgagctaaacagacactgtacatttcacctggtcagtatgaccatctttattctgcggtggtggaaggaagggcaaggtgactgtgtaaagcacagatgtgggaagtagaaatattgttactagacattataaagtcatggtgcctagaatagctgcgagtcatgcataggctaagggggaaaagactacactccaactttagaaaattaatttagaaggctaggggcagagattaagtcattgcagtttaacatgaaaaatgcacatgttatagaatggagcacaatggaggattcataaaa

SEQ ID NO: 649307 - DNA, 330 bp, Homo sapiens
cgaccttaccagagagagaatgccatgaaaacattggctgaaacatgaaatactacagaatatttctgtttcttattctgaatacgctgctaagactaaaggtcattcggtacctgtttgtgtggtagcgtaactggagattcgggcaattccatgtaatgtaagattcgggatgaagcagccttttgggctaccggtcactgggcagattgggttgaaagaagccccacaagcattttcaacggacagacatggggggattcaaggtctaacatgaaaagactgctggaaaatctttacaataggttctttacatcaaaattcaggcaa

SEQ ID NO: 649308 - DNA, 1050 bp, Homo sapiens
tcgacccacgcgtcgcccacgcgtccggtgtgtgcctgtaatcccagctactcagcaggctaaggcaggagaatctcttgaacctgggaggcggaggttacagtgacccgagattgcgccactgcactccagcctgggtgacagagactctgtctcaaaaaaaaaaaaaaaaaaagggaaatcttatgggtcacaccccaaaaacccttactttcagtgaagagagtgtggaaaattttccaaatagtgcccatgtgaggttaaactattataccggggcatttttcccattcttctataaataccaccttccagttttttccagggtactttagtgaaccttaaactttcttaccactctcgggttgagggggctgagggtggttgggagaaaaacacgtttggactacctcggataaaagccaccaattaatgggggtttggcacactcttaaggtaagacgctcaaccccgggctggccatattacaggtaaatggggtactcatatatgggcggggaagtaaaatctctttctcaagcacaattattttccaggaattgggccgtggtatgaaagggctggtttcccccaaggtttattataaatacccattcttgttggccgggggcagcggggtggagctcaccgcctagggtaattcccaagacctttgcgacacaggcttggaggcaaagcaagatacaaccctgagggtctgcacgtgggagaccagccgtgaccaccttggggaacgccagtgctctgctggaaggtacaaaatacgccggggggcgggggcggccatcctgggacgtcccagcatacttgggaggctgaggcagggacgattgctgacccgggaaggcgtagtgggggtgacgagatcgccatggacactcacctgcggaagacgcgacctcgtttttaaacaaaagacaaaaagggcgcgcaaaaatccagggggccaactacggccacatctgacaggccacaaggcacaaaacagcggcggcaacccgcggaacgctgatcgagccacgggcagcc

SEQ ID NO: 649309 - DNA, 892 bp, Homo sapiens
ctagtgggaactggtaagcacccattctgcaggaaggtggggtgcccatggtgggaactgtgcaggaagattactaagcctctgagatcgttgggctaacagctgcttccctgttgctggagagtcctggcgtctcctgtgcaaaagcatgggtcctaataacaggtggggacgctgtggctgagaatgcgccggcgcttagcatgcgaaggaatttctatcctgtaacgggcgcaggtagcatggtgctttcgttcgctgaacagaaaggtgtggagtactaccctggggcagagtgagtctggggaagcgccctgggccaggagggcactcccctccgaggagctgacacaggcagactggagaagctgctgcaagtgacgggcagacaggtaatggcaagcgggtgttcgactggatagaggacatactctgagtgagccagcagatagtatccaacaccgtgagttacggagcccgtcatgacggatgtcgtgctatgctgcaatttattttgagactcccctccgagctggacgttgcagtgctgaaaagcgcgagcgaagctgctgcagaaatacctgtgtgacgagcagaaggagctacaggcgctctacgccctccaggccttgtagtgaccttagaacaggctcccaacctgctgcggatgttctttgacgcactgtatgaccgaggacgtggtgaaaggaggatgccttctacagttgggagagtagcaagggaccccggttgagcagcagggcagggggttgggccttaatctgtcacagcttcttcagtgctcgggcagcaaagagagattgacacaactgaggggtggggggcgggaactggagccctgggaacagatggccgggtacgctgaacgcgg

SEQ ID NO: 649310 - DNA, 256 bp, Homo sapiens
cagggagacaattcctggagattcgtgtcatgactgtttctctctccaaacctgtttctgctggattgcgcaggtctgatgaccctggagctcttggcttccatacgtgtctcagacagcatactcttcccctttaaatattaaacctcagcatcgtctttggagaaaggcacagaccacagattgtttatatgattctgtgttttttccttccaacttgtccttaatcttggcaaaataaacttctaaattgaaa

SEQ ID NO: 649311 - DNA, 389 bp, Homo sapiens
aatgtttgtaaatcatacacctgacaagggatttttatccagacaactcaacaataaaaagccaaataacccaatttaaaaatgggcaaaggattcgcatagacatttctccaaagaagatacacaagtggctaacaagtacataaaaaaaagctcaacattaattaattaataaccgacatcattggttattagggaaatgctcatcaaaaccacaatgaaataccactttataccaatgaaaatgactaatatcaaaaagacaaacagggccaaccatggtggctcacgcctgtaatcccagcactttaggaagtggaggccggcagattgcttgagtccaggagttcaagatcagcctgagcaacacagtgagcccctgtctctac

SEQ ID NO: 649312 - DNA, 320 bp, Homo sapiens
tgagtcggtccctcgttattcatcggcaccactaccaacaccaccacctaccagcaccaccaccagcacactaacacctgcacaccaacatccacaccaacacctgcacaccaacacccacaccgggtgccgatgaatagcgagctattcatcggcacccatgtccatgtcctcctactcggtggtcagcacgggctccctgcaatgtgaagaccttgcagacgacacggttgccgatgaaagcgaggtgccgatgaatagcgagaggtgccgatgaatagcgaggtgccgatgaatagcgaggtgccgataaatagcga

SEQ ID NO: 649313 - DNA, 404 bp, Homo sapiens
  misc_feature (19)..(19): n is a, c, g, or t
  misc_feature (24)..(24): n is a, c, g, or t
  misc_feature (61)..(61): n is a, c, g, or t
  misc_feature (66)..(66): n is a, c, g, or t
  misc_feature (194)..(194): n is a, c, g, or t
  misc_feature (209)..(209): n is a, c, g, or t
  misc_feature (372)..(372): n is a, c, g, or t
aaccctggttaccctagtnggttnaaacctgataatatcccttcctggaaaagtcctcccnaatgnaaaagtaaaaatcctacagcccttttaaatggatatgaaaatggaggaaaataggcccgggtgccaggggcttacgccttgtaatccccagcactttgggaggcctcaggtgagagcatcgcttgagncccaggagtttgagnccagtccagacaacatagtgaggccccatctctacaaaaacttgaaaaaaaaaattagctagcatggtggcgtacatctgtagttccagctactctggcagctgaggtgggaggatcagttgaccctgggaggtggaagctgcaatgtgccatgatcacaccnccacactccaaactgggtgacagagtgagact

SEQ ID NO: 649314 - DNA, 236 bp, Homo sapiens
aaaacaacggcacgtgatatgaaattagcagcaaccatgatagcagaatgagttaacacaagacacttgtttcaaaaagggaaacaagtacagagactgattaactggaaggtgccgatgaatagcgaggtgccgatgaatagcgaggtgccgatgaatagcgaggtgccgatgaatagcgaggtgccgatgaatagcgaggtgccgatgaatagcgaggtgccgataaatagcga

SEQ ID NO: 649315 - DNA, 684 bp, Homo sapiens
  misc_feature (14)..(14): n is a, c, g, or t
  misc_feature (37)..(37): n is a, c, g, or t
  misc_feature (172)..(172): n is a, c, g, or t
  misc_feature (341)..(341): n is a, c, g, or t
  misc_feature (468)..(468): n is a, c, g, or t
  misc_feature (517)..(517): n is a, c, g, or t
  misc_feature (651)..(651): n is a, c, g, or t
  misc_feature (659)..(659): n is a, c, g, or t
atccccaaaaatgngactcaggcgtagttttttttantagcgcaagtggtcaaaagtggtcaaaatggtcctcattcctcgatggtctcttttttaccagtctcttgcccttcaaacagaggataccgggcctccacatcagcccatgtgatgttgccatgggctaggtctnggactatgctgggcagctcagagatctctgctcttatctgccgcattgagtcacggtcccctcagagttgcagtgtggggggtcttgttcactgtgtcaaagtcaatggtgacaccaaaagccacgccaatctcatcagtcctggcatagcgccttccgattgacccanaggaaatcgtctactttgtgagatactcccatgcctggtccagggcttcccgataattcccttgacaaatggcatgaactccctggtttttggctccagtgggaaggaacggaaacattttgaaatnggaaccaacttacagcaagggaaaactgaaaaatgttcctctgttccanctccttcctccgtacatggaatgttatgtttccaaatacccgtatacatgatcctaccccaagccgaaagaaaggttccaattacattccggaacaacttccttcccacatataatgttttcctggaatccccntcccattngatcatgttccttttggttaactga

SEQ ID NO: 649316 - DNA, 984 bp, Homo sapiens
  misc_feature (652)..(652): n is a, c, g, or t
  misc_feature (655)..(657): n is a, c, g, or t
  misc_feature (659)..(659): n is a, c, g, or t
  misc_feature (667)..(667): n is a, c, g, or t
  misc_feature (674)..(674): n is a, c, g, or t
  misc_feature (692)..(693): n is a, c, g, or t
ggtctacgctgtgcgcggcggacgtcggaggcagcggggagcggagcggggccgccggggcctctccagtggccgcagcggcagcagttgggccccccgccccggccggcggaccgaagaacgcaggaagtggggccgggggtgaccccgccccctggccggcctgcatgccatgaacctccaacgtggagaacctacccccgcagatcatccgccgtggtgtacaaggacggtgacgacactgaccgagacccacacccgatggcatcaaggtctttcccaacgaggaggacctcaccgactccaggtcaccatcgagggccctgaggggacccccatatgctggaggtctgttccgcatgaaactccgtgctggggaaggacttccctgcttccccaccccaagggctacttcctgaccaagatcttccacccgaacgttgggcgccaaattggcgaagatctgcgtcaaccgttgctcaagagggaactggaccggctgagtctgggctatccggacacgtactgctgacccatccatgtgcctgcttgtatccaccttaaccccgagttctgcactcaacgaggcaggcgggccggctgctctttggagaacctacgaggagtatgcagctcgggccgtctgctcacngannntncacggggncgccggnggcccagcggcagggccnnaagccggtgtgcctgccagtggtataagtttctccacgacctgggccagggggcccgaagaggcttgagggtccacctggcgaaacttggtggaacgcaaaagagttggggcagacaagagggaaagcggcgccgggggagagtgggccgtcctcttcccggacgccgttttttgctccctcaactgtttctagtttaatataggggcggcggaagggcgggcacggtgctttactggcgggaaaaaaaaaaaagcggcgctgccacgcctatgctggttaatcgacacgg

SEQ ID NO: 649317 - DNA, 223 bp, Homo sapiens
gcccttatcggcactcgctatcatcggcactcgctatcatcggcacattagctctagaggtccatgcatacttaatattatacttgaattcaatacgggtgccgatgaatagcgaggtgccgatgaatagcgaggtgccgatgaatagcgaggtgccgatgaatagcgaggtgccgatgaatagcgaggtgccgatgaatagcgaggtgccgataaatagcga

SEQ ID NO: 649318 - DNA, 317 bp, Homo sapiens
  misc_feature (160)..(160): n is a, c, g, or t
  misc_feature (193)..(193): n is a, c, g, or t
  misc_feature (202)..(202): n is a, c, g, or t
  misc_feature (273)..(274): n is a, c, g, or t
  misc_feature (292)..(293): n is a, c, g, or t
tcactgccatgtcacaacacatctctcaacttcttgctcctctcaccaaaaaccatcaaatggggagttttggcaccttcaccctggacttccctgccgcctggaaactgctaacatagcttctcgaaactggacaccctgtgggcttcacgggagcgcnctttgaacgcccctgagttcttgtacagacccnccggccacnttctctcgctaccctctcactaggcacgcttctctcctctagtgaatacacgcttgcacgctctcgcattnnctggacttgtatccactnnccttgtggcacatggcgcccgtga

SEQ ID NO: 649319 - DNA, 399 bp, Homo sapiens
  misc_feature (81)..(82): n is a, c, g, or t
  misc_feature (153)..(153): n is a, c, g, or t
  misc_feature (166)..(166): n is a, c, g, or t
  misc_feature (181)..(181): n is a, c, g, or t
  misc_feature (198)..(198): n is a, c, g, or t
  misc_feature (227)..(227): n is a, c, g, or t
  misc_feature (259)..(259): n is a, c, g, or t
  misc_feature (367)..(367): n is a, c, g, or t
  misc_feature (394)..(394): n is a, c, g, or t
agagtccccggatctgttcagcctccgaccgccctccgatttctctccgcttgcaacctcgggaccatcttctcggccatnnctgcttctgggacctgccagcaccgtttttgtggttagctcttcttgccaaccaaccatgagctccagatncgtcagaattatncaccgacgtggtagnagttgaaaactgcagtnccagtgccacggaagtgtgaattggagcntgcagataatgctcagccatcctcccatcttnactttagccagctgcagggcgggaaggcaaggaaagctgcttccctggaagtgtatcactttctccggcagctgggaagtctagaaccagccagactgggttaagggnttgtcaagcaatagcagaggtttcacncggca

SEQ ID NO: 649320 - DNA, 353 bp, Homo sapiens
ccgttgtcagtgaaaatccgtttggtaatggttaatatattggtatatataggagacggagtgttgctctgtcactcagtctgcagtacagtggcgccatcttggctcactggcaacctccgcctcccaggttcaagcgattctcgtgccttagccactcatgtagctgggataacaggcgcctgccaccacgcccagctaattatggtatataagtagagacggggtctcaccagtgttggccagtgctgatcttgaactcctgacctcaagtgatccacccgcttcagcctcccaaagtgctgggattacaggcatgagccattgacaagggcctcaccacttgacaacga

SEQ ID NO: 649321 - DNA, 1203 bp, Homo sapiens
gttctagtgctgcaggcagctcgaggacccgcggccccgcccctgtgctctgtgcctgtgcatgatatgcagatgtgcagcatgtgcctgtgcctgtgtgtgtgtgtgcactgtttgcttgtaactcatgttgtgcccagtggtgacttgttactgtgtgtgacatgttgcaccattgtgatgtgtgctgtgtgcccctgcacgtggttgacaaccacttgccttgcacgttgtgccttgatctgagtacgcatccgtgcgtcactacatcacatatcaggtgtgctgcttaccttgccctcattgtgttgacagcactcatcgcacgaccacttgccgctccaacactacgactgctgacaccactcactcaccaactgccacggacctaacgccaccaaacgctgcgcttccacaaacccccagcagcctgctccacacgaggcaccgacgatctcccacgcgcgcgcccccgggcgcactcgcgacccactccccacgcccctgccctgctcccctacgcgccacacgcactccactgctacccctctcctctccgcgcgcgcgccctcacgcacgaccacgcccatggccgcgccccacttctcaccaacacccacctgcgccccctctccacacccgcccctccccacctaccactacggccaccccacctgccccactggcgcaccctcctctactcctgcgtaccacaccctgcgggcccacgccccctttgcccacctgccatcgcgcaccgcgcgccccctctcccaaccctccactggctccacccacacttggtccttgctcccgcccccgccttccacccgactttcgctactagactaccctctcccgcgacgctgtgcgcccgcattggccccagaaaccactggccctccgtccggcgcggcaccacgctatccccccacttttcaccaccaccacacccttgccacccactcctctcaccccttcgccacacccccgcccaactctcccgcaacgcgttcctccctggcacctaccccccgatccacctttggacctgtggaccttttgcggcctttggcgcccccttgggctcgcccccgccagcgagcttccccagcgttcggcctatgcccccttgcgaaggtgtctcggcctgccccctgccaacgccaccaccacttcccgtcgccccctctactcgcgcta

SEQ ID NO: 649322 - DNA, 196 bp, Homo sapiens
catgcttacatcgggatgtctgatccaacaatagtgtttacgacctcgatgttggatcaggacataccgaggtgccgatgaatagcgaggtgccgatgaatagcgaggtgccgatgaatagcgaggtgccgatgaatagcgaggtgccgatgaatagcgaggtgccgatgaatagcgaggtgccgataaatagcga

SEQ ID NO: 649323 - DNA, 152 bp, Homo sapiens
gagatctatggtagcatgagctcatgcatgaagcctctccactgattagctactcgtaacaacggcacaaggctggagagaggctaaatgtactttacctatggcatgtcctcacacagatctcctgacaaagggatatatacagtaaaaca

SEQ ID NO: 649324 - DNA, 220 bp, Homo sapiens
  misc_feature (10)..(10): n is a, c, g, or t
  misc_feature (37)..(37): n is a, c, g, or t
  misc_feature (95)..(95): n is a, c, g, or t
  misc_feature (129)..(129): n is a, c, g, or t
  misc_feature (190)..(190): n is a, c, g, or t
  misc_feature (202)..(202): n is a, c, g, or t
gttgtgaggnttcaaagggatgaagagtacagcagtncctagcagatagtaaatggtcaataaatgggtactgtggcaaggtggctctcgcctgnaatcccagcattttgggaggctgaggggggaggntcccttgagcccaggagttcgagaccagcctggggaacatggtgagacctcatatctacanaaattacaaaanttagctgggtttacaggt

SEQ ID NO: 649325 - DNA, 204 bp, Homo sapiens
attcgcggccgcgtcgacatcagtgaagcttcggattactactttgtcaaaatgagtgatatctgtctatcatgcagtaaatctgcgtttggccggagtctgtgccacggacacatggcgaatgtgtctatcttctgaatctctggcttcaccaaagtcatttgtggccctcaatgattgagtgaattgactccttagaccgac

SEQ ID NO: 649326 - DNA, 189 bp, Homo sapiens
ctattgatcggcacacacatccttgttaagcgtcagctatggggcaaacccagcctaaaacagtaacattctacagcttggtacccagtagacacttggtgccgatgaatagcgaggtgccgatgaatagcgagaggtgccgatgaatagcgaggtgccgatgaatagcgaggtgccgataaatagcga

SEQ ID NO: 649327 - DNA, 194 bp, Homo sapiens
gcggcccggtgtgttgggagtagagagaaaaagtgactgccttataacctacaggttgtgaaacctggggtgccgatgaatagcgaggtgccgatgaatagcgaggtgccgatgaatagcgaggtgccgatgaatagcgaggtgccgatgaatagcgaggtgccgatgaatagcgaggtgccgataaatagcga

SEQ ID NO: 649328 - DNA, 212 bp, Homo sapiens
ctcgctattcatcggcacctcgctattcatcggcacttcgctattcatcggcacctcgctattcatcggcaccgggattcggcgagtgctgctgccgggggggctgtaacactcggggggggtgccgatgaatagcgaggtgccgatgaatagcgaggtgccgatgaatagcgaggtgccgatgaatagcggtgccgatgaatagcgagtgt

SEQ ID NO: 649329 - DNA, 920 bp, Homo sapiens
gcatacaaagttatgtacactatggtgcttaatagagtcgagccgtagctcagtgtgctaacctttcaaagggtcgtgaccttcaaattgtgctgtatggtaaatgtattttgtttaaagatatggtgtgagttagactagcattaggttaaagaagtgctaaaggcctgggtttggtttcaaaagttcatgtaatattcctgataaaaatcagaaatatgagccataagagtctggattatagataaaaccatatgcatattcatatattaagagctcatgtcatcagcaagatctgggaatagaaaatagtgagagtagctattttgaaagatatcattctccagtaaggttatacactctaatatgcgttggatggctatgcaccaaaactagtatcgcgtgtatctctttaattcttgtgacatgtagatataactatatatatactatcacctgtgccataagcagatgcgaagagcagctcaggtgagataagattgctagaattaccatctgttgcctagcccgccacagatggggggcttcacaaacatgtgaactgatgcacgccatggactcagtctaccaagatgggtatccaaccgaagacattcgaggagctagcagatcggagaggtgtccctccaaaggagccgattggacagttcgcgtactcggaagatagctctacgcactggacatcctgctcatggaccggtggcgtcccggacaaatggcggaccaggtattgaggcacagaggtctaattgcttgcgcaaacggtccaagacatgaacggtaccgctgggcccatgacagctggccacaaaccggtcgcgcgcacgcacaaaacgcgggcaaaacaacggccgccccacacgaaaccggaggaccaacccaccaaatcaagcacacga

SEQ ID NO: 649330 - DNA, 161 bp, Homo sapiens
catcggcacccagaccccagaaaaggtgttggttgatatagtcagcaggacggtgccgatgaatagcgaggtgccgatgaatagcgaggtgccgatgaatagcgagaggtgccgatgaatagcgaggtgccgatgaatagcgaggtgccgataaatagcga

SEQ ID NO: 649331 - DNA, 260 bp, Homo sapiens
agcagcaagacagtaatcttgagcataggtctcaataggtgcttctatcagtaaaccaattgtaaacagatgtgctgtcatccaggcttgtgtcgtcatttatagcacagaaacataatagatttaacaaaattcttaagggccttataatttttggaattgcaaataaacactggctcatataagtcagctgattagtcccaaacaagagagtcagcctgtcagttgaagctgtgaagataggcattgacatctctgca

SEQ ID NO: 649332 - DNA, 280 bp, Homo sapiens
gagcggtggagcggcctccgccacgaggggcaatggtcgccggggcgaggcccgggtcagcgccgggagcttcgcttaatggctgcggttcggtttccggacgtgcggcgcccctccactgagtgttttttcgccccacaccccctgcctctgggctgcgggtccgtgcccctcagtccgggcgtcctctggcgccggctgtatccgacccttgttccccgccaggccggctcgcgcctatgggccattccagggcccggcccttggtgggcgatgtaca

SEQ ID NO: 649333 - DNA, 883 bp, Homo sapiens
ggagaaggttgcgcagacagtgtgcccggagtctagaggcgcagaagaggaagccatcgcctggccccggtctctggaccttgttctcgctcgggagcggaaacagcggcagcagagaactgttttactcatggacaaacaaaactcacagatgaatgcttctcacccggaaacaaacttgccagtggtgtatcctcctcagtatccaccgacaggtattccaagggacctccaggatatacgtgggctaccctggggccccaggtcatgttacccaccccccacagcgcggcattcaggtccctgccccagttgctttcctgtcccaaatcagccagtgtataatcagccagtatataatcagccagttgtggagctgcaggggtccccatggtatgccagcgccaaagcctccattaaactgtccacctgggattagaatatttacgtcaggtaatttcaaagacacaaaaaatactcattaaaaaagagaactgtgcttccagttgtgtttacccgagattagcaaatgactaattcaccaaatgtctgaaattagcaaaactgtatttcgggctaaacaagattactctaatttcttactaggtccggtcaaatattaaagcaaaatacagtggcttagaaaaatggggattttcctgtgatctttaatacactctatgtgatatggcacatagcacacttttatttagccctgtgtctgccttgttgatgccgaacatgttactcttaatcttgggaacgggagaaaggcccttttcacacaaacaacgccccaggtttactcccgggggagcaaagcgcaaaggtttccccagggcggggggggccacaacacgcttggaaaaatttgtttggcccg

SEQ ID NO: 649334 - DNA, 132 bp, Homo sapiens
tttaagttgagtagtaggaatgcggtagtagttaggataatataaatagttggtgccgatgaatagcgaggtgccgatgaatagcgaagcgaggtgccgatgaatagcgaggtgccgatgaatagcgagtgt

SEQ ID NO: 649335 - DNA, 296 bp, Homo sapiens
cggcgtggcctgagccccttctccagggcaggtagaaaggaaaacttggtctctgcctcgggaagcaggaggcgggctagaagcacgtccctccccacctgcccagagctccaggccagaacagacattcctgaggccaatgtcaccaaagttagattgaatgtttactactctttctttttccttttacccttattgactggatgacctcttgcacctggattcctttccataaaccacgttaaagtatggcccgacccatttaagaaaaacaaccatcacgacgcgaggctgca

SEQ ID NO: 649336 - DNA, 2536 bp, Homo sapiens
cataattttctatctatggtacccttggcttctgcctggcttctgaggcttagggaagggaggaagggacctacaaagagccagggtacacctgcctcttgtgctgagggcacgtgccagcttctctgccagtaagccttttgctagctaacatttcccaccctcccaaggcccctaacctgccctcccctctccactatgttagtatatctacctctgtttctgactctgaggaagggtcaggccacacggagggaacagtagtgggtaccagcctcccctctgctgtccagtccaccacatcaatctcttcctcttcagagctggcaggaagtgagcctagtagttcagagtgaccagatacctccttgcctgccttgggagaagggtataataactcatctgtagtcaaggagacttccagcccagtctccacccagtttgagcagggaggtgagaggtccccataagacctctggggagtatcaagggagctgacatggagaagtttgtcttcctgaccatccagtggctgggagctggtaatttcaaggtctggtgtccaacggcctcctactgaaagcacttcactcacctcagagggcatgacaagggggctaaggagctcagttggccctctgttctcaccagcaggttccttttccaattctgtgagctccctgggccagagttccatgtctggtagacaccattcttccccttcaatccagttctttcctgtttctgtcagatggtaggtaggcgttctgcagccctcagcccctggactctccagagaccctataggtggttcaatgtctgagccacagagcatgaagtccaggatctcctccagctcactggtggcagcagcacttgtgattcggtactcctcagcctcacagggctgctccagcagagctgtgtcaaatgcatagggttctctgcagtcaatagccaacataggttccttctctaccagttctggactggactcaaactctgacttcaccactgggtggtctggggagtggctagcagagaccagaatgtcttgtagcttagtgcacatgggggagtcctgacacagttctgttctagtaggtgacatttcctgctcattactggagaatggctgagttcctgaaggctcttggaagtctcctccgggatctgggatctgggggctatcttgagtgtttttgagaggagtctcttgtaccacttcccagcaagtcccattgacaatcttcctaagtttaactctcccaacctgcccctcctctgcagagtctgagttaggtgccctgacttcagggctccgcttcctgctcccacctgtctttcccagaccagatgggtttggggtgctctgcagaggactagctctgcctggttttggcttgtcctctggtgtttctttatttacactcctctgccgccaaagacgccggccaggggttgcaggcactgagctagatccacttaaaatgctggaaggctttgatgtacagataccaggagatggctttgagcgactgagcctgatctttctgggcaacaggtgtttgtccacagaggggtacaagctgggtggggagagcactgtaggatcaagggcagtgtcattcttgttctctctaggctcttgactatggcttgatggtgaagagtttttttttcttgtggagttgggcaggctctggccttcctcttgagcagaagagtgccagacaaattgtctgcattctgtcggttgttttcctgagggaatggaggaggcgaccgttgttatcgagctggcctctcccgctccaggcgctctgtgaagaaggggctacaagctgacaggatgcagcagtgagctggaactgcctcacctgaagggaaacccaaatacttttgttatcaggtagactggcatgttcatgggctaagcatagacattactacccaaatgtactgccccttcttttattttccttccatgggacttcaagtaaaagaaaaaaattattcttctgcctgcctggaaccttctgccattaccttttgcctagctatttttttttttttttttgagacagtctcgcttggttgcccaggctggagtgcagtggtgcaatctcagctcactgcaacctctgcctcccgggttcaagcaattctcctgtcttagcctcccgagtagctgggattacaggcgcatgctgccacacccggctaatttttgtatttttagtagagacggggtttcaccttgttggtcaggccggtctcctgacctcaggtgatccacccgcctcggcctcccagagtgctgagattacaggcgtgagccaccgtgtccagcccgctaccttgtttctttattctcaaaatctacctttgtcatcacttccttcagaaagcctcctggggctgagtgcagtgccacatgcttgaaatcccaactgttaggtaggctgaagcaggagaattgcttgagtccagggctttgaggctagcctggggaacacagttataccttgtctcc

SEQ ID NO: 649337 - DNA, 137 bp, Homo sapiens
  misc_feature (18)..(20): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (32)..(33): n is a, c, g, or t
tcgctattcatcggcacnnnggacngnatngnnagattcatcggcacttcgcgtattcagcgaggtgccgatgaatagcgagaggtgccgatgaatagcgaggtgccgatgaatagcgaggtgccgataaatagcga

SEQ ID NO: 649338 - DNA, 376 bp, Homo sapiens
acgggagagagtagtagagcttaggggagattccccctagggaccctaggcgtatccacggcatactactagggatcagtagtacggaacctcacccgccctgaggtagtagttagtagggagtaggataggagcgggccaggcagcccctacaagaaggagcccaggacctcttgccatctgggcaatctcctaagctgggcccaagccccacagctgtattctacttactaactggttcttcagtgaaatatcccctgagggaccttgggtgggagtttttggcacagagcaggcctgccaggagaaccatgcgattggtcaaaactggggccttgcccttagtggggagaaagcccagtccctggcctaccat

SEQ ID NO: 649339 - DNA, 138 bp, Homo sapiens
gattttttaccccccccccaaataaaaaaaaaaagtattttaaaagggcgaaattagaaaaaattttttgaaaaaaccttttggcgggcaatttagattttatagggtaccccgcaaggggggaaaaaaaaaagatgg

SEQ ID NO: 649340 - DNA, 703 bp, Homo sapiens
  misc_feature (25)..(25): n is a, c, g, or t
  misc_feature (479)..(479): n is a, c, g, or t
agcggaagtgtcggcgccgccactngtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtctggtgagacgttacatggcacagatcctgaagatgtcatcagaaacgcctttgcttgctttgatgaagaagcaacaggcaccattcaggangattacctaagagagctgctgacaaaccatgggggatcggttctacagatgaggaagtggatgagctgtacagagaagcacctattgaccacacggtgaatttcaattagcatcagcttacacccatcttgaagccatgagccgccatagatgcgtgaacgaactttagcttttttcaggtacatcgacttactatgtttaatttttagacgcttcctcccctt

SEQ ID NO: 649341 - DNA, 196 bp, Homo sapiens
gtctacagctcccagcgtcagcgacacagaagacgggtgatttctgcatttccatctgaggtgcaacaacgagagtgagtggtcccagatccacgagaacatcatccgaaagtccagtgccaagtactctgcccccagcgccagccatggtcttatcatttctctgcagcttcttcgtggagacatggaacagatt

SEQ ID NO: 649342 - DNA, 828 bp, Homo sapiens
  misc_feature (25)..(25): n is a, c, g, or t
  misc_feature (479)..(479): n is a, c, g, or t
agcggaagtgtcggcgccgccactngtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtctggtgagacgttacatggcacagatcctgaagatgtcatcagaaacgcctttgcttgctttgatgaagaagcaacaggcaccattcaggangattacctaagagagctgctgacaaaccatgggggatcggttctacagatgaggaagtggatgagctgtacagagaagcacctattgagaagaaaggggaagtttcaattacatcgagttcacactgcatcctgaaacatggagccaaaagacaaagatgacttgaaagaactttagtaaaatcttccagttacattgtcttactctctttgacattctcagaacacttcccccagcctcatagaaacctgttgcatgcaacgttagtttcacagctttgcctctgcttttgatgtatctattccagacctttctgacacttagcacttgtataatcaagactggggat

SEQ ID NO: 649343 - DNA, 492 bp, Homo sapiens
tgcagtagagatgcagttccttcagggcaggggctcatctaattaatgttgtatctcaaggctttgcatagccttggcatacagctggcattcattaaatattcaaataatgaatagctaattagacctttctcatccttttcctttgtctttctaccttctctctcagttttctttccccaccctgttcctcccacctctgtatcttttctacccatgttctcttctctttctgatcctttatcatttctcctttgaaatgggaaaagagtaaaattccccagagaagattgtgtgtgtgagcaataacaaaagtaagcgagtgggagagagaaaagaagtgagtataaggcaaaaagggtatgagcagaattctgtggctctccagaaataagagaggaacatagcatgtattctgtgccactgatgggacaggaagtttgacagtttataaaactcggtccaaattaccccaagtactcattagaaata

SEQ ID NO: 649344 - DNA, 2883 bp, Homo sapiens
  misc_feature (25)..(25): n is a, c, g, or t
agcggaagtgtcggcgccgccactngtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggccgattggtcttttttgacagggtgctgattggtgcatttacaatccctgagctagacactgagtgctgattggtgtatttataaaccttgagctagacacagagtgctgattggtgtgtttacaaaccattagctagacacaagagtgctgattggtgtatttacagtcccttagctagacataaatgttctccaagtccccatcagattagctaaatacagagcactaaatgttgtatttacaaaccttgagctagacacagagtgctgattggtgtatttacaaaccttagctagacacagagtgctgattggagtatttacaaccccttagctagagataaatgttctccaagtcctcactagactcaggagcccaactggcttcacctagtggatcctgcaccagggccgcaggcggagctgcctgccagtcgtgcaccgtgagcccacactcctcagcctttgggcggtcaatgggactgggcgccgcggagcagggggcggcgcttgtcggggaggctcaggccgcgcaggagcccatggcgaaggggaggctcaggcatggtgggctgcagatcccgcgccctgccccatggggaggcagctgaggcccagcaagaatttgagcgcagtgctggtgggctggcactgctgggggaaccggcacaccctccgcagctgctggcctgggtgctaagcccctcactgcctggggccagcagcgctggctggcagctccgagtgtggggcctgccgagcccacgcccacccagaactcgtgctggcccgtgagcaccacgcacagccccagttcctgcctgtgcctctccctccacacctccccacaagcagagggagccggctcaggccttggccagcccagagaggggctcccatggtgcagcagtgagctgaagggctcctcaagcagggccagagtgggcgccaaggccaaggaggtgctgagagtgagcgagggctgcaagggctgccagcacgccatcacctttcactgccactgacagtacctgggaaactgcagagccccacacacatgtgcactgactgtaacagcaggaatacagccagcacctgcagccctggctggtgtccacaggactgagtttcagtcccatagccttgacttacctgtgatgttggacacgttggtctcctccagccttgttttctccatctgtgaactgggccaacgctcctctgctgtgagctgatgcgaagccacctcagataacctctgtgctcagtgctctgtgccatggccgtcgcccgtcgctttactgaggctattgcagaagtcagcgtgggctctgggcttccgcaccaaggtgcgagatgctcaccccgtggaatgaggttgctctgacagcaggaccatggccgtgctcatgcccagctccgccttcgtgggacaccacgcatgggcactccctctggttggggaaaaactgtcatactggattgtgttccttttttgccttaaattattagctgccatttttgctcatcaaaaaagtggcattaggcacttccacatggatcgaagggccctgtcactagtgggttcctgctcagagcgtcttgtgtgatgtttcatcttgatgctttgacaggttaacaaccttctcatcaggatcattgttaggtccttcaggtgtggtcctggggaccggtgatgagggacacccccattgcatctcagctacggctcttggaccatgggcagcggtgctgaaatgacaatcctggagccacagccttcctccgtccacagccagtgtgctcacggacgacacaagtaattgtggacaccactttgccaccacgactgtttatgctgcagccccaggggccacagcagcagctggtctctcctcaatgatggttcagcgccgagtgcattggcggcacggtccatttctctgccgagcgcttgtgttgtgcctggggtctgagccacagcggcaggtggatgggagagattccctcggaacaggtgtctggagcaggtgggttgcggggccactgtcaagcacgtggggactgtgcctgtggcttcatccctgcgtggactcagtcctccccttgttttaagtggtccctgggtcctttgtgcacatcagtaattgcagaggcgggacgcgcactctctgagcggagcagcttggctgggcttgtccctttaatttgcgatgcatcacaacaaatgattgtaatcagtcaccgcccgacggcggcctgctcttccatgaccacccttcagtgagccggcagctgagcgacacggacaaagccgcctggctcagggttggggaaaacactctttagtcagtagagttaaaccacctgatttattccatattgtggaaggtcagtctgatttaaggaaatgtcagtttgatagaatgttttgaaagaaatgcagctcataaatactgcgctgaaagctcagccttgatacaagctcacttggtaaaataacttaataaaggaaactttcgattc

SEQ ID NO: 649345 - DNA, 605 bp, Homo sapiens
gggtggcacacacctgtaatcccaggtactcaggagactgaggcagtagaatcacttgaacctggaagatggaggttgcagtgagccaagatcacaccactgcactccagcatgggtgacagagtgagactccgtctcaaaaataataataataatagagttgtagctgggtgcagtggctcaagcctgtaatgccagcacttcagagcctgaggtgggaggattgcttgagccctggagtttgagaccagcctggaccacatggtagaccccatccctacaaaaaaaaaaaagtcgggtgtggtggcacacgccttgtagtcccagttactcaaagaggctgaagtgggaggatccctagcccaggaggtcaaggctgcagttgagccatgatggcaccactgcaatcttggggtgacaaagactctgtttaaaaaaaaaaaaaggtgtcaggggttaaaagtgatcctcaagaggtgctattctccagtaggaagaaacttttattttattaattgagattggggagtatattaatgttttacgttgatagagtatgtgggagataatgacctaggtggatttaatgtgaaatgtgtaaatgc

SEQ ID NO: 649346 - DNA, 3380 bp, Homo sapiens
  misc_feature (25)..(25): n is a, c, g, or t
  misc_feature (198)..(198): n is a, c, g, or t
  misc_feature (206)..(206): n is a, c, g, or t
  misc_feature (532)..(532): n is a, c, g, or t
agcggaagtgtcggcgccgccactngtccggccacagcctaacgctcttcgctgtcgtttgcggtctcgcgcagggcggccccggttctggtgtttggcgtcgggtgagtcgcgctcgactctgctcgcgagacccctcgggccgccgtctccgtacccccgcgcccccctcccgtcgcgcgcctgcggccggacccngcccaggncggcaggcggcggcaggacctgtcagactggctgagaaggaggcgcggggccggaggtggagggaggagggttgctggcgaggccctggcccggacgtccaggtgccgggaggctccaggcgatggagccggtctggggagacgccctgctggagaagtggccgggtcccggccgtgcgtgggccggccctgcgccacctgggtgacctcagacacctgggccttggacggccggctgcccggcggcaacgcctgccctcccggcgccgcggcgggtctggcggtggattggggccgacccgggcgtgttcgtgtggagcacctgncctgtgcccaacactatcctagatgctttggagggtggaggagcctcctgttgcacggtcttgcctaagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggccgattggtcttttttgacagggtgctgattggtgcatttacaatccctgagctagacactgagtgctgattggtgtatttataaaccttgagctagacacagagtgctgattggtgtgtttacaaaccattagctagacacaagagtgctgattggtgtatttacagtcccttagctagacataaatgttctccaagtccccatcagattagctaaatacagagcactaaatgttgtatttacaaaccttgagctagacacagagtgctgattggtgtatttacaaaccttagctagacacagagtgctgattggagtatttacaaccccttagctagagataaatgttctccaagtcctcactagactcaggagcccaactggcttcacctagtggatcctgcaccagggccgcaggcggagctgcctgccagtcgtgcaccgtgagcccacactcctcagcctttgggcggtcaatgggactgggcgccgcggagcagggggcggcgcttgtcggggaggctcaggccgcgcaggagcccatggcgaaggggaggctcaggcatggtgggctgcagatcccgcgccctgccccatggggaggcagctgaggcccagcaagaatttgagcgcagtgctggtgggctggcactgctgggggaaccggcacaccctccgcagctgctggcctgggtgctaagcccctcactgcctggggccagcagcgctggctggcagctccgagtgtggggcctgccgagcccacgcccacccagaactcgtgctggcccgtgagcaccacgcacagccccagttcctgcctgtgcctctccctccacacctccccacaagcagagggagccggctcaggccttggccagcccagagaggggctcccatggtgcagcagtgagctgaagggctcctcaagcagggccagagtgggcgccaaggccaaggaggtgctgagagtgagcgagggctgcaagggctgccagcacgccatcacctttcactgccactgacagtacctgggaaactgcagagccccacacacatgtgcactgactgtaacagcaggaatacagccagcacctgcagccctggctggtgtccacaggactgagtttcagtcccatagccttgacttacctgtgatgttggacacgttggtctcctccagccttgttttctccatctgtgaactgggccaacgctcctctgctgtgagctgatgcgaagccacctcagataacctctgtgctcagtgctctgtgccatggccgtcgcccgtcgctttactgaggctattgcagaagtcagcgtgggctctgggcttccgcaccaaggtgcgagatgctcaccccgtggaatgaggttgctctgacagcaggaccatggccgtgctcatgcccagctccgccttcgtgggacaccacgcatgggcactccctctggttggggaaaaactgtcatactggattgtgttccttttttgccttaaattattagctgccatttttgctcatcaaaaaagtggcattaggcacttccacatggatcgaagggccctgtcactagtgggttcctgctcagagcgtcttgtgtgatgtttcatcttgatgctttgacaggttaacaaccttctcatcaggatcattgttaggtccttcaggtgtggtcctggggaccggtgatgagggacacccccattgcatctcagctacggctcttggaccatgggcagcggtgctgaaatgacaatcctggagccacagccttcctccgtccacagccagtgtgctcacggacgacacaagtaattgtggacaccactttgccaccacgactgtttatgctgcagccccaggggccacagcagcagctggtctctcctcaatgatggttcagcgccgagtgcattggcggcacggtccatttctctgccgagcgcttgtgttgtgcctggggtctgagccacagcggcaggtggatgggagagattccctcggaacaggtgtctggagcaggtgggttgcggggccactgtcaagcacgtggggactgtgcctgtggcttcatccctgcgtggactcagtcctccccttgttttaagtggtccctgggtcctttgtgcacatcagtaattgcagaggcgggacgcgcactctctgagcggagcagcttggctgggcttgtccctttaatttgcgatgcatcacaacaaatgattgtaatcagtcaccgcccgacggcggcctgctcttccatgaccacccttcagtgagccggcagctgagcgacacggacaaagccgcctggctcagggttggggaaaacactctttagtcagtagagttaaaccacctgatttattccatattgtggaaggtcagtctgatttaaggaaatgtcagtttgatagaatgttttgaaagaaatgcagctcataaatactgcgctgaaagctcagccttgatacaagctcacttggtaaaataacttaataaaggaaactttcgattc

SEQ ID NO: 649347 - DNA, 569 bp, Homo sapiens
gtttacagcactgactttggcttttcttggagaacatggtcaggctcagggccgcgacatttcatggtattggatactccccacattcccgaggaatagtccaagtgtttcaagccgtatcccgccaagtcccgtgattctattcgaatctagctatcccctgtgtaccttgtcattgggagattagacttctatgttgcttttgcaaacccggatattaaagtagacagatttcaagtctcttccgaataggcgttcacccagaattttctcccaacctgaaaggatcgatcaagcctatgggatgatcgcctatgggataattcccactgtgacccgcacctatataccatagtggccaaccctcacatttgtagtatctgtttgtcatatttatccatgatgactctttcattgtgaaaagccctccttccctccctgagagctagtgaaaataaattggatattggccattaaggaaaaccaagcaaggaagggaaatagcgaatcgtcagagaatgttcttgaaggaacaattctttggaccccttttcctcgaggattcacca

SEQ ID NO: 649348 - DNA, 648 bp, Homo sapiens
  misc_feature (25)..(25): n is a, c, g, or t
  misc_feature (424)..(424): n is a, c, g, or t
agcggaagtgtcggcgccgccactngtccggccacagcctaacgctcttcgctgtcgtttgcggtctcgcgcagggcggccccggttctggtgtttggcgtcggaattaaacaaccaccatgtcgagcagtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtctggtgagacgttacatggcacagatcctgaagatgtcatcagaaacgcctttgcttgctttgatgaagaagcaacaggcaccattcaggangattacctaagagagctgctgacaaaccatgggggatcggttctacagatgaggaagtggatgagctgtacagagaagcacctattgaccacacggtgaatttcaattagcatcagcttacacccatcttgaagccatgagccgccatagatgcgtgaacgaactttagcttttttcaggtacatcgacttactatgtttaatttttagacgcttcctcccctt

SEQ ID NO: 649349 - DNA, 203 bp, Homo sapiens
tgttatcacataccttagaatgtgcgtgtatttagacccaacaattcagaatagtaggaatttaacccaagtcagatgaagtgatgcaaagtttatatctcatgtggatgtacgtcgcttagccatttatactacagaaaaatagaagctgttcttggtgtttaataatgggaggttaattgtatatccgtatgattaactgt

SEQ ID NO: 649350 - DNA, 342 bp, Homo sapiens
cgggagcgcttacatcctcttcatcatcgctatcttgcatttcatctagcgcagaagctggcaaggagccagcatcaatagccgctctaagagcctgtattttgagactatcctttttagtaggttgttctcgaataacactagccatttcttcatctccagcatgattgtcctcgtccggtaatctgatagcacctgtacctatatcaagatcatctggttttcttctgccccggagtgctttgctttgtgttgctgctcgggatgtagagtatgcgattgctaggaacgtgaagatagctccgactacaatcatacttgtttgagctccctccgctcgtg

SEQ ID NO: 649351 - DNA, 275 bp, Homo sapiens
atcctgattgaggtaattgattacttgcagccacgccgttggaaacaaaatctccaggaatgtctacatctagaaagctccctaggcaattctaacatccaacacagcccagcctagagcagcatagagctttgggaactaactagcccgtgtgacatttaatggccagtttggctctgagccttcccctagagctccctggagcaggaaccgacccacagatccagttctagcacaaagtaagtgatcaagaaacatagcatgcgtgacgatcc

SEQ ID NO: 649352 - DNA, 550 bp, Homo sapiens
  misc_feature (493)..(493): n is a, c, g, or t
  misc_feature (550)..(550): n is a, c, g, or t
gccgctcctgtatatatccgagttacacaaaccgggacctgactacatacattcttgtcaactcacccttatccgcgttcttgtatgaatccctatgtagttaattacaacagcctccacatacctccgggaacatcacacttggcgtgggggacattctattttctctgggtatccagacagtgcttggtgtgcattcgggttcgcggaccctgcaaaaactacagtccacaggctgggagctgctggcttagcctttagttgcctagaaagctacattactgtcagttttggtaaggcagaaaatttgtttaatttaaacctctcatctttttttaagcactcactgaaaatgaccgagacagccagtcgccgttgaggaatcctctgttgtcaacatcgagacccctggttttcgggaaacccaatggcacgtacctcttttcattgttgctttcccctgcataccactgcagtggcgggaggcaccggngtttgcctcaatccttctcttgtaggagcctttgtctttccctttcgtccaatgaan

SEQ ID NO: 649353 - DNA, 391 bp, Homo sapiens
  misc_feature (370)..(370): n is a, c, g, or t
cccgctcactgccatccacgatgtcctctgacagtgtgaggatgtactgtcccttgcagtacgacgtgcagaatgtggactgcagagtgaagatgacatcctccttcttgatgctggtgatttcactaatctcattgatggtgatctgtggcctctccccgctctccgacttcagccccatcaggatctccaggatggtctgggaccagtagcttcgataggataggaggccaaggtctgagaggggcttctcaggggtccctgttttcccttccactttggtgagttcatagcatcccgtctccattgctgtctgagttccaagactgagtttcttcaagcatccacttgtgctaccaggctgagaagntctgaggatgtgaccccatct

SEQ ID NO: 649354 - DNA, 416 bp, Homo sapiens
  misc_feature (180)..(180): n is a, c, g, or t
  misc_feature (183)..(183): n is a, c, g, or t
taaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcactgctctcnctncacactgcgcaacccggcccgctacgttactgtgatttgttaatggatgaattgtattttgtaaagatagttagagaaatacctccttccccttagctttattaaggtatcattgataaataaaaataaaatatgtttaatgtatataatgtgacccccaaatatatatatatatatatatatatacacacatagtgaaataatgaaataaaggtaattaacacatctaaaaa

SEQ ID NO: 649355 - DNA, 737 bp, Homo sapiens
  misc_feature (185)..(187): n is a, c, g, or t
  misc_feature (189)..(190): n is a, c, g, or t
  misc_feature (195)..(195): n is a, c, g, or t
  misc_feature (198)..(198): n is a, c, g, or t
tatagtgtgagtgtatagtccgtgtgggtgacaagtcccacgaggctgtgaagtctttcttcagtcactggatctgcagccctagaatctcgaaatgttgcccattctgtttctttttcttctcttcacttttttttctgacactttacatctttcctcaaactgggtgaaaatttaataatacnnntnngtaanccncaagaaaagagcccgttcaaactgtctacaagagattagaaataattgtaaatgttttcattgctgatgactcagagtaaatccttgttgatagcttagttccccacaaccatgtacatttgggaatgtgctatagtcagacccggccctgattccattcaagactgacctggacaccctttgctgttagtgtagatagacacagactctgagggtcttgcccaagctatgtaaattctttggtggcatggaacatctgagccctaaggatggcagaccttccaggaggttctaaatgctgcctaaaattctgttaagtagggagcttagaaatggggctgtggaacctggaccatggaaaaacagtcattgcatacctgctgagtagaaggtgcacttttagctgcagaaatcctgctttcatgcagtttattataggaatgagaacgtgtaaaaggctctaacagaaggtttcctcccagcctgggaaacatactgagaccctgtttctttttatgttttctgtcatcatagtcacc

SEQ ID NO: 649356 - DNA, 471 bp, Homo sapiens
  misc_feature (132)..(132): n is a, c, g, or t
  misc_feature (214)..(214): n is a, c, g, or t
gccccggcccgcttttgggggttttgtttccttttaaaaaaaaaaaaaaaatttttcgggggggttttttttttggggcggggggttttaaagttccccccccgggggggaaaattttggggtttggttggnttttttcttccgggggggcccccccccttgttcgcggggttccggggcctttccccccccgggggtttttcccccgttttanaaaaaattgggggcccggccccggcccccccccccccccttttttttttttggggggggggggttttgggccccccagtccccccggcggggttttaaaggttttcccgacccccggtttatttttcccttcccccccggggttttgggcggtggggcccaccccgtttttcccccccgggggcccccccctttttttttgggggggggcccttttccgggggggccccccttttttttggggggcccccgggttta

SEQ ID NO: 649357 - DNA, 527 bp, Homo sapiens
ttttgacatttaaaaaatattaatttatttaaaaagaataactcattatatggtaacagaaataatactttcgtggaaaaacaaattttccaaaacaataaagtctattagataagtggcattggttttcattttgaagatctctttaatgtcttggcttaatcacagagctggattcgtttatgtgcttctgcattcagtctgtcgcactattacaggtcacagaacgctggaaactgcagtgtccactccataatgtaaaaaattgtctttgggggcagatctccagagtattacggtgctaacgagtactctggttagggaaggttctgggcttcctgaagaaagccaggtatggaggactcctgctgagtagaaggtgcacttttagctgcagaaatcctgctttcatgcagtttattataggaatgagaacgtgtaaaaggctctaacagaaggtttcctcccagcctgggaaacatactgagaccctgtttctttttatgttttctgtcatcatagtcacc

SEQ ID NO: 649358 - DNA, 951 bp, Homo sapiens
  misc_feature (344)..(344): n is a, c, g, or t
cgatgataaggataagtcatgcgacataccaaacatacgtcgttgttaccactagtctgccaaaatcccatactgagacccgctattaaagggtcttctttatctgcaccgctcccctgtggtgccgtcccagaaatattctctgtgaattgccatataaaaaggctttattaataatactatatatttcttctatgagactagatcacaccccccctgtaattcttatcggttcttccttgccctattgccccaggctatccatgagttgcttatgtgtcttcagcccgcttgctcccccgctgagcgtcgagggcgctgttcctcctctccagctccgggtnaactcgtgaaccccccaagggcctcactttctgcttataaacccttcaaccccctatgtccccgcccacataaggaaaaacgcggctgttgcttccacccaagcggcacgcccaatccgcctcgcctgtatacttagagacaattgccctcccgaggtggtcacgcccccaacaggtacatcacaaaatttctgcctcctcgagggaatatcttttttataagacaacacggtctttaaccacagttgctctcaaagcaatcttccgatgtccttctcatctcgtacaacagcaatttggcgtgtccccgttcttatagactcagcgaggtgacattctccctccgctatgctacaaaaaaggtgactcacgcggttgtcatgcccaaaagattcgacttgctccgccaaagatgacctcttgtggttttcaagagagtgggcattcctcccaccttcatcggagtctaacagtatggaatggcagcagtgcactttaggcaatatgatgagtagcgcgggcggaaaaaaaagaagggggggagacaaaaaaaaacccaaggaaaaaaaccccgttttaccacaaaaaaaaaaacagaacaaaaaaa

SEQ ID NO: 649359 - DNA, 409 bp, Homo sapiens
ttttgacatttaaaaaatattaatttatttaaaaagaataactcattatatggtaacagaaataatactttcgtggaaaaacaaattttccaaaacaataaagtctattagataagtggcattggttttcattttgaagatctctttaatgtcttggcttaatcacagagctggattcgtttatgtgcttctgcattcagtctgtcgcactattacaggtcacagaacgctggaaactgcagtgtccactccttgaaagtccatattcttttcactctgttagtcccagtaattcagctttcttccaaacttgatgtcacgtctccctttgcaaatctgaaactgtagtcccagctactcaggaggctgaagtgggacgatcgcttgagcccagaaggtcagaggttac

SEQ ID NO: 649360 - DNA, 304 bp, Homo sapiens
cagagagccgtgattgcgccactgcactccagcctgggccacagagcgagactccgtctcaaaaaaaaaaaaagaaaaaaaaatacaaaatattagccggggcttgattgtggatcccccttgaggatctggctccccaagaagcacttatttgaccctttcctcacggcctcccgaaaccggatttcctccatggcgcgtgtgcccccacggagctcgctttggccccctttggtacccattggggacccagcccacccgaaacccttaatataagaaacccacagggggaacccttcataga

SEQ ID NO: 649361 - DNA, 248 bp, Homo sapiens
  misc_feature (52)..(53): n is a, c, g, or t
  misc_feature (63)..(63): n is a, c, g, or t
  misc_feature (66)..(66): n is a, c, g, or t
  misc_feature (84)..(84): n is a, c, g, or t
  misc_feature (87)..(88): n is a, c, g, or t
  misc_feature (90)..(90): n is a, c, g, or t
  misc_feature (100)..(101): n is a, c, g, or t
  misc_feature (108)..(108): n is a, c, g, or t
  misc_feature (117)..(117): n is a, c, g, or t
  misc_feature (132)..(132): n is a, c, g, or t
  misc_feature (152)..(152): n is a, c, g, or t
  misc_feature (186)..(186): n is a, c, g, or t
  misc_feature (200)..(200): n is a, c, g, or t
  misc_feature (203)..(203): n is a, c, g, or t
  misc_feature (213)..(213): n is a, c, g, or t
  misc_feature (217)..(217): n is a, c, g, or t
  misc_feature (227)..(227): n is a, c, g, or t
  misc_feature (232)..(233): n is a, c, g, or t
  misc_feature (246)..(247): n is a, c, g, or t
cagagtacttcgagtctcccttcaccatttccggcgggatctacggctcaannttttttgtancgngggcttccgcggacttcncgnnantattggctcnnctttccncactatctncttcatccgccggcnaatatttcacttttcatccnaacatcactttggcttcgaaaccgccgccggatnctggcggtttgtanatntggtttgacnattnctgtatgtcncgggnnattaatgagggcnng

SEQ ID NO: 649362 - DNA, 984 bp, Homo sapiens
  misc_feature (201)..(201): n is a, c, g, or t
gttccttctcgcctaacgctgccaacaatggtgttgcaggcgcttcgtggattgttggccagggtggcctaatgtctccgtttggaccatcatgccgtgcaagaattgagtcgctgatttgtagactgttcttgagtcaagaatcagaggctttggtcatttggacacttgcagctcattaccgtgatggagacaggccantgccttttcaacgtgcagtgcactcgtcactgattgtcagtcctgcaaggtttcacgcagctagtagcccagccagatagtattgtccgatcaaggcctgggcagagaggcatgacatctatacggaatgggcagccgcacgatgggccaatgaagattgaaagccagtagaaaggatgatgccctgagtgacggacttttgatcgttttacagttctgaaggccctgagcatgaggaacagatataatcagagaatgaggtgttagaagcttctccaggcagttctctcctgtaaagcttctcccaataaagcacctggtactaagggtactgctgcatgcttgctgttgatgctgtgtgctgctgcttgtgctgctaaagttccatgcatgaaagatcaccggcaggagataaataaggctccagaaccgagaaggttgctgtccagaagaggtcacaggtcaagtaaagctagctgactgctccatctagctcatgacagcggtcaagcatggttccagtccagaaaggagctgttccagaaggcatcttggcaagaaaatgcatcaggtgggcatcattaagaagtagtcaaaggttacattgtgaccgtgttgacaaatgttatataaggcgtttgggattgtaaaggctggtgaaggatagaagttagaggccagatgaataggagggactatggataacattaaatatcgtgaaaagaaataagaacaaaggtataaaagacgtttcgggccgagtgcgcgaaaattatagagagc

SEQ ID NO: 649363 - DNA, 120 bp, Homo sapiens
tccagaggagttatggaggaatactatttgcgtggaggaatcttttgcttttcctctcaagtctcagagatgtgtgtgttaggttcctcttttgccatcgagcatcctattcccacctca

SEQ ID NO: 649364 - DNA, 223 bp, Homo sapiens
aaacaacaaccacagcaaataacaactagctgtggtgtgttggcacatgcctgtaatcccagctacttggggagctgagctgggagtatcacctgagcccaggaagtggagagctagccgtgcagctgtgatcagctaaacacacaagacaggttcactggctcccatcccaacccggaacagctcccataggtataacacactcgacatgccatgtggtttt

SEQ ID NO: 649365 - DNA, 1025 bp, Homo sapiens
ggctgctctgaaaaagcccatctttgcattgttccgtcatccgcctccttgctcgccgcatgccgtctccgccgcgcgctcctccgccgccgccggactccggcagctttatcgccagagtccctgaactctcgctttcatttttaatcccctgcatcggatcaaccggcgtgccgaccatgtcaagacgcggccgtagacaccagctccgaaatcaccaccaaggacttataggagaagaaggaagttgtggaagaggctgaaaatggaagagacgcccctgcataacggtgaatgctatgtgaggaataatggggaagcaggagtgctgacaagttgaggtagacgacagaagaggaatacggtggtggaggaagatggagagagtgacagtaacgacaggtgatggtgagagaagcaggatgtagatgatatgatagtctgctggtcagatagatggattgcgtcgcttgcatgagagatggccgatgatgccggatgtcgatttcagcaagtattagatactgccgaggcatgcactagatcaagacaaaagggtatcagtgacacttcgggatgggtatctcatgttctactcaattagagccctgattagccggctgagtgattaagatctgagtcagcttccgaggttcagagagccgagcgtcccacgtaggcttgagcaccccgtgatggaaatctcactgtcgccataaaagccatacgattggaattctcacacgggaggaaaccgcagccgcatcttccagacgcgcgtaaaatcgtcaaagtcgttaacaggcaacatggtggcctccaacaccattaactagggccaatggaggggccgcaattaagagtcctgagtccaacaagcttcgacgtccgcaccgcatccatactgtggagccgtcttacccaggaagaacggagagagatgacgacacctttcgaccacatgggtcatcgaacagtcagaacacaatccacatcacacgcgagtacaacatgtaacacactat

SEQ ID NO: 649366 - DNA, 120 bp, Homo sapiens
tgtatcctgttaccgtaactagtggaggctgaaagtagcgaagcaaagcggctgggcaatgatcacaccggcaatgagggcaggagcaggacttgaatgtcatcctcacatgccactcaa

SEQ ID NO: 649367 - DNA, 511 bp, Homo sapiens
agatggctaccaaaagagtacagagtacacagagaagagattccatataaaagtaattctgtgagtaacttccacttagctacatctaaaaaatacttgaattcaaattctccttaatatacttctgatcatgtttcacttgaatcagtagcctccttcgctcattcaattctgcaccctttctctctggtttctattacctgtcagagaaagtcagatggccttggtattagctaccttttggtatcaattgaagacatgaaaaccacattcaaacacagttctacattcatttccccctctcaacctcttctgacccattcttgtctcaggccctgcctcatagaacacccaaaggtgccctcacttccctcatacaggtagcttttactctgagactaggaatgtctttgatgactaatccctacgcaaaaagatgtgccatcacttagcaaaatagaaagtaagaaaggtgagagggtgatgaccactccagtctagtgtggctgta

SEQ ID NO: 649368 - DNA, 429 bp, Homo sapiens
aggaagactcccagcatatgcaccgtgggaccgcctttggatctctgtggccaggtaccacatcgaggtgaaccgtgttcctgcgggcaactgggttctgattgacaggtgttgatcacccaattgctgaagacagcatgcatcaccgaaccccgcaggcaatgaggaggctcaaagtttttccgacccgttgaagttcaagtaacgcacatcctgttattagagttgctgtggaggccggttcaaccccttccgagctgccccttattcttgatggtcttgcgcaggtccacgggagctatcctttcctcccccccatggtggcggggtccggcgagcgtgttatccttggcactggggagctctacctttactgtgtgatgcctgatttgcggaagatgtactctgagatcgacttcttggtgggtc

SEQ ID NO: 649369 - DNA, 459 bp, Homo sapiens
gatgagatattctacacattaatctacttatctggaatcactttgcctctaaaggccagagaaaaatcacagcttccttatcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgagtgctgctgccttcggtgactatatgagaatggaaacttctaaggaagccaggttgttagaattgttaccccccatctcagcctggataatctatgttatctctgagtaaagggggtaacaattattatccaggctgagatggaaaacaagccctttattgaattttcaacacagactccctgcttctcatctccttaataaaatttcattaaaatccccttaaaatccc

SEQ ID NO: 649370 - DNA, 210 bp, Homo sapiens
aagactgcatctaaaaaaaaagaaaattaaaaattgtattctgggctaggcatgaaggtttgcccctgtaatcctagcacttttggaggccaaggtggagcattgcgtgaggccagaagatcgggaccagtctgagcaacatagcaagaccccacctctacagaaataataattaacataaaaagttctactctaacttgttgtaaggtc

SEQ ID NO: 649371 - DNA, 133 bp, Homo sapiens
taccctaataatatgaacttatgcatctctacttcatggaactcgctctacactccttccagttgggcagtaggcggcttgaataaaattgtacaaaacttttgaaaagatacatattaatttagggttgatg

SEQ ID NO: 649372 - DNA, 332 bp, Homo sapiens
aaagcattgctatggagaagacctatactgtttgaaaatgcaggccgggcgcggatggctcatgcctgtagtgccagcactttgggagggcgaggcgggaggatcacgaggtcaggagatcaagaccatcctggctaacatggtgaagccccgtctctactaaaaatacaaaaaaaacaaaattagccgggcgtggtggtgaacgccggtggtctcagctactcgggaggttagggcaggagaatggtgtgaacatgggagatggagcttgcggtgagccaagatacacaaactgcacaccagcatgagcaaaagagtggaactctatctaa

SEQ ID NO: 649373 - DNA, 130 bp, Homo sapiens
tctcgctataaactcgtgcattagttattaacactggcagccacagtaactaagtcatatgttatatcttcgttcgaaaccatacttatccccaccttggctctcatcacccgatgaggcaaccagccag

SEQ ID NO: 649374 - DNA, 857 bp, Homo sapiens
  misc_feature (854)..(855): n is a, c, g, or t
tctggtcagaagctgatattataactttcctcttccattacccttgaagggttcaagggattctcgtgcctcggcctccagagtggctgggaatgcgggtgcccaccaacaccacgcctggtaatttttgtgttttttttagtagagacggggtttcaccatttgggccagactgtctcgagctcctgacctcaagtgatccccacccgccttgctcccaggtgctgggattgcaggcgtgagccccaccgtgcctggccccaaatctgtatctttatttgatgatgcgtatcatataatgtgtttttggagacggagtctcgctctgtcacccaggctgaagtgcgagtggggcgatctcagctcaatgcaacctccgtctccggggtcaggcgattctcctgcctcgggcctcctgagtagctggattacaggcgcccacgaccatgcccggtattttggtggttcagtaacgagccggttgcccatttggccaggctggtctctttgggcagggttggtctcgaaccccttgactggtggtccgccatttgtggctcccgggatgcgggattgcggggtgagcacaagcccggccaaaacattgtcttaaataaggttcaatgataacctatccttgaatgcttcacaatggaccccaaggttgcgcttctaactcaatatggacggaaagacatgtccgggtcctgtcaaatacccgctcttgggaacacactgtgggagtcaagaccgtgtcggcaaaatatcgagaaagctaaacaatgtggagcctctctcgatcgacgtttttctctctgcatctttgttatctgcttgttgtgtcttgggtggtnngc

SEQ ID NO: 649375 - DNA, 578 bp, Homo sapiens
tacttttccacagggcatcacatggtgaggggactaacgagagacagccacattggcttttattacagacccactcttgtgctaactagccccttctctgaataacccattaatctgagaatggctcaagcacttcctaaaggtctcgcctcttaacacgcctgcattgggcaccaagtatccaacagatgaacttctgggggacacattcaaatcgttgcggggtattaaagcgaagtacaaagaagagagatttgctgtcaagtagtttgcattaaacttggaaataaatatgaattggtaggttacctattaaacaagtgtgttagagtagcctagcagttttcaaagtgtagtctgtggaatcctagagaatagactcctttcatggagtctgtgagatcagaatagtttcataataatactaagtcatcatttgccttcttccctgtgttaacatttgcagtgatatccaaaagcaatgctgattaaaacgttagcataaccctgagcaatagcaccaaactagtagcaggcattgtgttattgtcatgcagtttaaatttgcagtaaaaaaa

SEQ ID NO: 649376 - DNA, 178 bp, Homo sapiens
attgccggaggctcaatggccggaggcgttgaatggcccgtaggcgttgaatggcccggaggcgttgaatggcccaaagccaattttccggaagaaggctaagaccacaaagacaattgtgctattggctgcaatgtgtcgagcctaactgcagatccaagaggatcctggccattca

SEQ ID NO: 649377 - DNA, 175 bp, Homo sapiens
actccggcagctgctcatggatcggcttggtgctcgaaaggacgttggcatcgtcctcattagagctcagcactcgcatcaacttcgaaggctgcacaccgtccagcggggaacaggctgatataatcctcaatgtcttcgcggctgctcctctctcttctgcgcggcgctgcga

SEQ ID NO: 649378 - DNA, 260 bp, Homo sapiens
taaggccttcgaacatctaagatctggttctagcctaggggcgggctgcagaggaggcggtgccaggcacagtatgcaagccctagcccagctcaacagaatctttctccagacaagagctattcggatcttctccaaagactattcaaacgggtacaaggcgggaccccgagggtgggcaagatttccttcagtccaaaactccagagctacattggaacctcgcggggcctcatcctaccgggcatctggtccacggt

SEQ ID NO: 649379 - DNA, 179 bp, Homo sapiens
gcgtaccgggggtaggaccacttcactgtcggacctctggcctgcttgttctgtctcattctcacctctcttccacccaagtgtcagaagtggtagcataaccagttggtgacgagtaggcctgtactccttcagttagtcggtctctcagttggctctccatgctttcgtgtgtgtct

SEQ ID NO: 649380 - DNA, 293 bp, Homo sapiens
tcgtcattgagtttgacctcaatgggcagcgccgacataccagtggagcggcacttttccgatagcttgagggtcaatgggttcaacatcaaactaccgactggcgaatgggtgctgctcgccaatcaagctatcaagcttcctcaagcttccggcatggcctatttccttggcaaagtggagggcaaacgcttgattggtggcatgcggctattcgccctacgcagcaacgacagcgcttcggcggagttaacgcctcttaagggttgccagcctgatgacccgggcctgat

SEQ ID NO: 649381 - DNA, 1132 bp, Homo sapiens
tggctttatggaccctttattttccatgtgattccggtacatagggatttatgaaattaccccttttacaattgggaactattttactagaacattggaccaaaccttgcaccgggttattcggatggtgattccacgggagtttaacgcttcaaatccagccaaaaattttggtcacaatctctttcagcttggctatctgatggtcctgagatctttccatcagccctggatatgtggcccaaacaagggtctagggtggctgggctggacagactatggaagacaaagaacagctattctacaaatctttggtcaatcctggctggggctccagtttatcaagagatatccctcttaacacccggcataaggataccaccgccccttggtctcttacaataagccctaggggaaagacatcactgggtgccttggtttccaagccacatcacgatgtttaaagacggcatggccaacaggatctacacaacatgttcggctgagatgtggggcacgctatacgaagtgtcaagacaccggacttgggcgccacaacagcgagcaaccttcaaggatcatctggacccaatatatcccatcgtctttcaatggggcaaccctgggtattacctctgggttatacatcacgcccctggtgttttgggggcaagggagatccgagagcaacaggagatcacaggaactaaagacgcaagtgtacatttgcgcagggggcggagataacccctttttggtaacaaaacacattctctggttttccccacaaaaaacacgattctttgctccctgtacattgttgatgtggcaaaattggcacccttttatggttcggagacattgtgtaaacagccaaaacacacatattaacaacccaagggcctatgagggcttacccacaataaaaacgtggcgacacaaaacgcactgctcccaggagacgccacaccgacaccaacacgagcaaactcgcgtccaaatatataggcgacgagacaccatctcaccaggcaaacccggggaaagtaggtagggaaacaaaacaaatttacacaaagagactaaggcctacaacaaccaaggggggcacggggggaacaaaccagaacat

SEQ ID NO: 649382 - DNA, 490 bp, Homo sapiens
aatgctggcgtctgctcctccgtctcccagaatcctgccctggaaaaaaccagcgccaaccgccggtttaactgaggacggatttaaggcattacgaaagacagctttcccctttgctcggctctccttctctctcctgctgccctgtgaagaggtgtcttctgccataattgaagaggaagacagagctcttaccagggggaggcagagatggcacagcaagagacatgcccccagaatgccaccaatgccccaggacaggcccacccatgggaccaggttatcgggataacctgggaggatggggtggaatctgaggggtgagccttcttccccaggctggaagtgggcgacacgagactggcacctctacatctgattgtcccccaaacccagcatttatgtcgtgagcaaagaaagaaatcatgttacttcttccaaaaaaaaaaatataattattataaatttaaaaataaaatatatatttata

SEQ ID NO: 649383 - DNA, 124 bp, Homo sapiens
aatgagctggtaccgctcaccgatggggtgcactggtgatctgttgctgaactacaagcctcaggttggggcacgcatcctcaggaccgtcatctcctggaactatcaggtcagcctggatcat

SEQ ID NO: 649384 - DNA, 610 bp, Homo sapiens
attctataggccaggcgagcggcatgttatagaagctacgtaagaagatggttcgtcgcaagtgggcaggtgccgtgtgcttatgagcaccatcagggcacatcagccacggattctttgaattatatacctaagtgtctctaattcttaagcagagttctttgaggtgatctgcaactctttcaccatctggtaatgcggagatgcaggaagtcggtgtgggcctatatcccagatatctcttgtgctacaatcggcagactgtgaccccaactgtacgattgtgtacaatgggccccacctcttactgcgagcagtccgagacatcgagggtgggagaggagctcaccatctgctacctggatatgctgatgaccagtgaggagcgccggaagcagctgagggaccagtactgcttggaactgtgactgtttccgttgccaaacccaggacaaggatgctgatatgctaactggtgatgagcaagtatggacggaagttcaagaatccctgataccccattgaagaactgaaggcacacctggcacgtgggagcagggttgtggccatgtgccaggcgatcatacgcagcaattctgaacgggttacc

SEQ ID NO: 649385 - DNA, 203 bp, Homo sapiens
cgtcgaccatgagtcaggagtgcgtcgaccacgaggttcaggagtgcgtcgaccagtcaggtcaggagtgcgtctaccataggtcaggagtttgagaccagcctggccaatatggtgaaaccacgtctctattaaaaatagaaaaattagccaggcgtggtggtgtgtgcctgtattcacagctgcttggatggctgaggcag

SEQ ID NO: 649386 - DNA, 317 bp, Homo sapiens
gactctagcaggatccttatacccggttctgggtataatgccaggtaaggcacagtggtgagtctgtataaggctttacaaagcttctataggaaaaaacaaaccagatttgatttcggattagcagtaagagtgatgaagacgaaccagggggatggagtgatgtcttgacggtgggagatgatcttagggtggccaggaaaggcctttctgaagaagtgagatttgaattaagatctgaaagataagaaaccagtcatgagaagaattgggactggggaggctgggcgctttggctcacgcctgttatcccagca

SEQ ID NO: 649387 - DNA, 134 bp, Homo sapiens
  misc_feature (5)..(5): n is a, c, g, or t
  misc_feature (65)..(65): n is a, c, g, or t
cacantactgacttcagcaccagcggctcgtcaacaagcttcccattcacatatgtctcagctcncttcacaaggctccagagtgaccaccacttctccatctggctgggggatgctccggaacagacagtgtt

SEQ ID NO: 649388 - DNA, 1445 bp, Homo sapiens
  misc_feature (366)..(366): n is a, c, g, or t
actagttctagatcgcgagcggccgctcgtgttgttgtatgattggagagttggtatagatgaaggagcaagggcctcatgtatataagtgtgatcctgcaggctgtgggtactgttggggtcctaaatgccacgtgcagtctgggagattaaatgaaatctgagatcaatccagtgtatccattgaaggtgaaaagtgaagaagaaagtgggacttggagcatttgaacggacagctggaaactgcaagttacgatgccatggtctacatgtactagttcaaatcgatcttctaaagacattctagaaaatgaggaagttaggagctaggtggacaagattgcaaaatctctagagattccaggnattcttgacagaagactgagaggattgactggctgtcgacgcgttgataggcatcataagcagacgatgacgactgtaagacgagttggtcggtacacgatagtataccaggaatccggctgaatgcccactggttaccgtggtggtgatacgggtaagccaacaaatctcagagggatcgagtcgcgcaggtaccccgggggcattggagagccctgcgacgccaatctacctcacataaactaacctgaaacaggcggaaaaggcgggctcacggacttctattattaaaactcaaagggaaccaaggggctaaaaaggcacaaccacacactacaacacacacgcaccaccacaaaaacaacacaacacaaacccaacaaacacgcacaccccacacaaacgaacaaaaacaaaagcaagacacaacgaaaaaaccagaacatcgacaacacagacgaaaaacagacaaccaccaacaaggaagaagagcgggacggggcagcacacaacacaacaatacccagcgcgcggaggagggcgcagaaaaaaccgaacgggagccagagaaagagaaagcaaccaccaccccgaccccacaggcccgagaatgaacacagaaagcacgaacacgcggcgcgcacgccaccaccaccagcgaagcagacggacaaacaaacacacagagacgcgagcaggtgcccgcgcgcaaccacacccagacccatgggagcggagagaaccaaccaacagacacacacacacaacgaaagcacgccggcccagacgacacaaaaagcccaaggagcgaggcgccacgagcaccaacaagcccacggccgcgggcaacgaaaccgcgcgggcgcgtgaaaaaaacccaaggccgcgacacaggcgacacagcggcagccggcagcgcgcgcggcaggccgcggggcggcccccgcccggcccggcacgcgggccgcccgacgcacagaccgaccaggcccgcgcgcacacgcacaagccacgcgcacggagcaaccagacgaagagcgacgcgcacgagcagagacggagacaaggaggaaggacat

SEQ ID NO: 649389 - DNA, 190 bp, Homo sapiens
cctagttttagaagtttcaatagcacttagctctgctctgatctttttatattatttcctatctgattttaggtttagtttgttcttgcttttcgagttccctgaggtgcagtagttaggttgtttatttgaaacatttctactttttagatgaaggcatttattgctattgataacttctaaaactagg

SEQ ID NO: 649390 - DNA, 747 bp, Homo sapiens
agcggagacgctgcagaggcacgaggcactagtggatcgttccgcatggtattgtggactgtatacagagtgccgccacggagcccgccgtatccaccgttcctgctgctgccgccgctgcccgaatcggaaccgtcgggccgcgagaccgccggcaatgccgcgaaggaagaggaatgcaggcagtacgttcagatggaaccgaagattccgacttttgtctacatgatctcggagcacacagacagttcagacagtgagtggcacatcccgacgatctgctcgagtcaccccgctccgtcagtcctacggctagggccacgagttctcaaagattccagtcctgttcgaaatctgcagtcttttggcacttgaggagtcctgcttactctacctagaagatgtgacgccgtagtcagcagcatgcctaccccagtgactccgaaataaataccctcttcggcagactcgttcatctggttcagaaactgagcaagtggttgatttttcatgatagagacactaataatacggctgatcactgagtgagtcgccgactcgaactccaactggaaatgcgccttcttctgagtctgacatacgacatctccagcgcccaatgtatctcacgatgaggagcattgccgaggcactatgtccctgaaggactcaggcagtgatctctctcatcgccccaagcgccgacgttccatgaaagctacaaccttcaatatgaagtgtctacac

SEQ ID NO: 649391 - DNA, 130 bp, Homo sapiens
gtcagcttgtgttcgcctgttgtgcgagtgctggtgtttcacacagctggagcacctacatctcatcccgtctgaatcgcctgctgttcagattggggacggtatgtcgttgtgtttattgttctgagct

SEQ ID NO: 649392 - DNA, 348 bp, Homo sapiens
ccacacactgcgcccgtgcatgtgatctgggaaccatggcgccttctaaatgccaacaacaaggtaaatcaaatatgcaacaaacagaaataacggcattgacatgtgccatggaaaggcctatacagatgactgcagttcactgccgacgtcatcaaaggggtcactcttaaataataaatttcagacgccacggcccaaattgctgcttaaggagtggaagtcctccacatgcctctgcttccttcggtacctctttattagctctgccgatgtccttccctggtggcacatttcctttctttctttcttcctttcgagactgagtcttgcgctttcgcccaggcc

SEQ ID NO: 649393 - DNA, 118 bp, Homo sapiens
ccgagatggcgccactgcattccagcctgggtgacagaatgagactctcccaggaaaaaaaaaaagtgagaaacataggaaatacaaaaaagaaaaaagtttgctataatctaccgtg

SEQ ID NO: 649394 - DNA, 106 bp, Homo sapiens
ctcactggttacggaaaataattgggggagtggattacaagggtgttcgcgatctcttaaaagtgattttggagaagattttgacgattcctaatacagtgagctc

SEQ ID NO: 649395 - DNA, 765 bp, Homo sapiens
ctagaactagtcggcatcgtgggctataatctactcgtcaagtatttatatctctgtgtctttcataagcagacgtcagaagttatgatgtctatgaaatcatgaaagccaagtacaagagtttacgaatctgggggttatacccttctcatccggggattgatccactcagacagatggagagagtccttggtttgctgttagaaagacattaataaaagtcatggtcccttccaaagaagaactatggtgactgtatacaaggagccctccttcatcaagatgtgaacacagcttggaatttgtatcaggaattgataggtcataatctcatccctccgttggaaactctaaaagccttctttgattatggcaaagacttaaactgatgatcactattcagacaaactcctggacatacttttgtatctaaggaataatcagctgtatcctggagagtcatttgcacacagtataaaaacgtggttgaaagtatccctggaagacaatggaaaggacagttcaccaagcaattcagaaaagtggccagtgctcaggctgtggtcagaactatagagcctattcatctgagtccagaagagtatgagtttctgaaggaaaaaatcatgagggatgtgatagatggcgggaacagtatacgaagagatctcaggaatggaagagatacgagagctttgtgactcctgtctcctttgatatcgttattgatggctcatggttgcaaaatgtttctaaggtggaatc

SEQ ID NO: 649396 - DNA, 5672 bp, Homo sapiens
aatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcatcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgtgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcaactgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggacaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctgctcaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaaagcccgctagaaggtttgggaacgaggggaaagttctcagaactgttgctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctggccctcctgggaaggagggagctgctcagaatgccgcatgacaactgaaggcaacctggaaggttcagggcccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgcccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaagggaaaaaatggaaaccatcaa

SEQ ID NO: 649397 - DNA, 152 bp, Homo sapiens
tgctcgagagaattctatcggaagctgcttcgccatcatgtggggtgctgtatgccgtggatagctacaaccaggcggaatgccaacatctcctacgctttcgacacccataccaacacacagatcgtccccaggctgcttgttcgacgaac

SEQ ID NO: 649398 - DNA, 499 bp, Homo sapiens
aatttttttgtacagcacaggtcttgttttgttacccgggctggtctggaactccgaggctcaagtgattctcccatctaatccttccaaagtgctggaattacacagtgtgagccaccacacctggttcccatttatttgtatttacttgcctctttgattagggcattttggtagaaaactctacagcacatgactcagattagataatgcagttggcaattgaaataatccatggatgtagaacactgcaattaatttaacacatattttcattcttggaacaacatcatttgagtgcctactgtgtgccagttctagagacacagcagtgaccaagacataaaccaccaggtgtctttatagcatgtacattttcccctctaaacaccgtagtgtatcatggagtggctgtcacttcatacaaccacctgaacacaattttggggaccccctcagatcctggcccgcaccttgggaaatcacagtgcggggtgtc

SEQ ID NO: 649399 - DNA, 203 bp, Homo sapiens
cagtatgttaaggaagccaaaatggagagaagcctcgaacctccgcacctgcactccagcaagccgtccatatatcacagaacaaatgtaaaccctctcaaggcctttccacagaagaaaacctgtcttcctccatcaccaaacaacctattcatcaaagggaaaatatcataccattacttgtgacaagcaattctgatcag

SEQ ID NO: 649400 - DNA, 119 bp, Homo sapiens
ctgctaggattacaggcgtgaaccaagcgcacctggccaagactgtaatttctttttctttttttttgttgtatgagacgaagatatacctatttgtcgacccacggctggacgtgcaa

SEQ ID NO: 649401 - DNA, 477 bp, Homo sapiens
  misc_feature (477)..(477): n is a, c, g, or t
cagaaacccataaacttgtctaagaccaccgaagttgtccaaaggcctgataagtcacaaagaacgtttttagagcgcctccaggaggcttatcggatttacaccccttttgacccggcagctcccgaaaatagccgtgctcttaatttagcatttgtggctcaggcagccccggatattgaaaagaaactccaaaaactagaaagatttgctagaataaatatcagtcagcttttagaaatagcccaaaaagtttttgacaatcaaaagtttaataaacaaaaacaagcaacacaggcagctgaaaaggccgctgataaagcattcaaaagacaaacaaaaatcttagtggcagctatccaagaagtacagaatgaaatagcccattaatttagcattaactgaagcccctgctttagccttccctaatatctccatgccaaggagttgctgacgtgcttactcagactctgcctn

SEQ ID NO: 649402 - DNA, 176 bp, Homo sapiens
tccatctacctgcgcttatgctcctgaagaaaattatgcaacaatctaagtgtcgtcagactgaaaacagggatccagtctgtatgtcatgctacggactcagtgagtgcagagcgagcatgtgataccaggaaggtccccatcctctgccctgatgggcaagccctctagatggc

SEQ ID NO: 649403 - DNA, 228 bp, Homo sapiens
  misc_feature (166)..(166): n is a, c, g, or t
ggatctcggtgcatgatgtgggcaagttatgcagagagtatatttgaggagatcatatgatctgtgagagttgtcttctaatatggtctgtggggagtgtgatgctggagtggagatactgtttccatactcgtgtaaatgtccacaaaaaataacactcactgtntgcgaaaattaaaaaataagcctagggatgataaggttcctctgatccaagtctttggaagt

SEQ ID NO: 649404 - DNA, 239 bp, Homo sapiens
gattctagcaggatccttaagtcacccgcgtagtgctcccaggatttgtcacagccgcttttgaaggctgtaatcaacgcacactcttcctgactccttgtaggaagacacaacaacaataaccgtccttctgtagcccctgggcgcggaaatggagtgcgcgatgaagttcacagtaaaaaccctgcttgcctgttcttgcatgactgcatgccttaccctaagcgccgtcagccttg

SEQ ID NO: 649405 - DNA, 408 bp, Homo sapiens
tggtcgtctagaggatcccgagcgagatcacatcacaccattacgatgactactatcaagaaaacaagtgtggcaaagatgtggagaaactgggagacttgtgcactcttgggggtaatgtaaaagggtacagccattatggaaaatagtatggcagttcctcaaaaagttaaaaacagaattaccaaatgatagggcaattccacttctgggtatataaccaaaagaatttaaaacagggtctcagagagagagagagagatgcccatgtacacagcaacattattcacattagctaaactgtggaagcaacccaagtgtctatggacagataaatgcataagcaaaatgtggtatatacatgtaatgtaatattattcagccttaaaaaggaaggaatttctttct

SEQ ID NO: 649406 - DNA, 831 bp, Homo sapiens
  misc_feature (132)..(132): n is a, c, g, or t
  misc_feature (139)..(139): n is a, c, g, or t
  misc_feature (141)..(141): n is a, c, g, or t
  misc_feature (168)..(168): n is a, c, g, or t
  misc_feature (217)..(217): n is a, c, g, or t
  misc_feature (233)..(233): n is a, c, g, or t
  misc_feature (263)..(263): n is a, c, g, or t
  misc_feature (340)..(340): n is a, c, g, or t
  misc_feature (343)..(343): n is a, c, g, or t
  misc_feature (351)..(351): n is a, c, g, or t
  misc_feature (712)..(713): n is a, c, g, or t
ggtggggtttgacccccttagcctttccccattcaaactgggcccccataagccattctctggcctctgcaccagacagactccgccaatctgcgagtatgggattctgccaaatcccactcgctcacttcntagtctncngggtgacccaatccagtgggtgcagcnccacccgcgctcaacccactatgtggacagacacatggcaaatatgganctgaagcccgtctggnctggagcacatctggttgttgttgggttgnagtcgtcttgcagttagatgattcaggttactccagggcaaagcatgatcttgatgacacccggcggaaaagcaggntgnagcctcgnaagagctggccctgcacactcaggtacttccagcagtgaatccaggatttgaacactggggagtaaggggggagcacagcttgcagcccgcagttgttcacagccatgaggtcgccaactagcaggaaggggtaggtcagcatgctcactgcaatccccatcacgaacttggtatagctccggatggccagggcctggctgaactgtgaacctggattcttggtcgtatcccagcccccctgtggtgtctctcacgctgtcatccaccaggtaggcattgatgaagtgggcccagcaggttacagcccccacaagaaaaaccacatcgcccaagggaggtgagggataatccaacgaaganncccagcagcccttccttctttgaacaatcttccccaaattggagctcaagaaacaccactgatacttggcctcccgtcccacaaactggaccatgcagcgcattgcactgaccacggg

SEQ ID NO: 649407 - DNA, 884 bp, Homo sapiens
  misc_feature (132)..(132): n is a, c, g, or t
  misc_feature (139)..(139): n is a, c, g, or t
  misc_feature (141)..(141): n is a, c, g, or t
  misc_feature (168)..(168): n is a, c, g, or t
  misc_feature (217)..(217): n is a, c, g, or t
  misc_feature (233)..(233): n is a, c, g, or t
  misc_feature (263)..(263): n is a, c, g, or t
  misc_feature (393)..(393): n is a, c, g, or t
  misc_feature (396)..(396): n is a, c, g, or t
  misc_feature (404)..(404): n is a, c, g, or t
  misc_feature (765)..(766): n is a, c, g, or t
ggtggggtttgacccccttagcctttccccattcaaactgggcccccataagccattctctggcctctgcaccagacagactccgccaatctgcgagtatgggattctgccaaatcccactcgctcacttcntagtctncngggtgacccaatccagtgggtgcagcnccacccgcgctcaacccactatgtggacagacacatggcaaatatgganctgaagcccgtctggnctggagcacatctggttgttgttgggttgnagtcgtcttgcaggtgtcccaaggtggtcaggcctcacccaccgtggccaggttgagaccgtgtttttagatgattcaggttactccagggcaaagcatgatcttgatgacacccggcggaaaagcaggntgnagcctcgnaagagctggccctgcacactcaggtacttccagcagtgaatccaggatttgaacactggggagtaaggggggagcacagcttgcagcccgcagttgttcacagccatgaggtcgccaactagcaggaaggggtaggtcagcatgctcactgcaatccccatcacgaacttggtatagctccggatggccagggcctggctgaactgtgaacctggattcttggtcgtatcccagcccccctgtggtgtctctcacgctgtcatccaccaggtaggcattgatgaagtgggcccagcaggttacagcccccacaagaaaaaccacatcgcccaagggaggtgagggataatccaacgaaganncccagcagcccttccttctttgaacaatcttccccaaattggagctcaagaaacaccactgatacttggcctcccgtcccacaaactggaccatgcagcgcattgcactgaccacggg

SEQ ID NO: 649408 - DNA, 167 bp, Homo sapiens
acatgttactcatgcacacatacatacacacatgcatacacaccaatacacatatatcacacatgtgcacccatatacatacatacaacaggcccctgtgaattctcagcagggcatccattggcctgggccatgccctccatgccctctatgccctccatgcccat

SEQ ID NO: 649409 - DNA, 632 bp, Homo sapiens
  misc_feature (310)..(310): n is a, c, g, or t
tggccgaggcatagaagaactccatggtctgtcgtttaaggacgcccacctttgcaggaggagcctactccgttgaaccagtcattccttgagcagagcactgactaagcaccgtgcgacacttcaattcctcacaatctgcgcatggacctgtaagtgagagaagctgccagagtcgtcttgccatgatgcccctgtgttaacttggctcacattgtatctacagatcttgctctacagacggtgttactgctaaggattcggagtgcgaatgcagataccggtgtgtagcataccagcacgttatgangaaggctcttgtagtctgatgtgagagctccgccgctgcaccgtgctgtcacaaaggactgagacagacaatgcagtcttctgacccttgagcgcagggcctgtaacgctgttgcccatactcgatgtaatatcacctcctacaaaagagctattccttgacaccgtgactcaagatgttctctagtttcagacaagtgtaatagacatcttaagcttgctatacaatgcagagctagctactcacatctgccaatactgtattcgctatacatttaacgtgaccgcgtttgacaagttgaagagggggatacccgggagtg

SEQ ID NO: 649410 - DNA, 450 bp, Homo sapiens
  misc_feature (313)..(313): n is a, c, g, or t
  misc_feature (375)..(375): n is a, c, g, or t
  misc_feature (393)..(393): n is a, c, g, or t
  misc_feature (407)..(407): n is a, c, g, or t
  misc_feature (420)..(420): n is a, c, g, or t
tttcttttgttttttgagacagggtctcactctcttgcccaggctggagtacagtgatctcagctcactgcaaccatctccctcccagttccagctattctcctgcctcagcctcccaagttgccagtgtgccactttccattattacttttttttttttaagagaaagggtcttactctgtcacccagggctggaataagtggcatgatcatagctcatttcagtctgggaactcctggggctcaagcaatcctcccacctcggcctccccagtagcggggactgcaggcaggcgccaccatgcctgggctnactttattaggtaattcactggctacaaagtgaggagcagcttcccgggggcacaggaactnccccacacctggcagggntgccccgcagcccncaggccccacacntgggtttttgttccttcaagttccggggat

SEQ ID NO: 649411 - DNA, 117 bp, Homo sapiens
gatgatctacaggagcttaaacacgcaatctcaaccccatctcggtataaaaatacagaaaaaagttagctgggtgtggtggcagtgcgcctgtaattccatgctactcatggaggc

SEQ ID NO: 649412 - DNA, 4309 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagca

SEQ ID NO: 649413 - DNA, 4725 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttcgaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649414 - DNA, 191 bp, Homo sapiens
aaatagtgtacatgtcatttatgcgagatgaaggatgacaagtaagcctgaggatgtctatgattgtgtagtatgggttgaaggtgatttacactcgtgaatgcgacgtgatccctaagggtgttgtttgtggcaataaaaatgattaaggatactagtataagatatcaggttcgtcctttattgttgtg

SEQ ID NO: 649415 - DNA, 4429 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaggagacgcaatcattgagtcttatcgaaacagttacatagttacatgttacacggttattggtatggtatctgtatggacattagcttcggtgcgtgtttttacaaattttccataacagatcatcacctaattgggcctattcgacgtcacgattccaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagca

SEQ ID NO: 649416 - DNA, 3889 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctacctagtgacttgagagattacactatatacatgccattatatacatatgatatgctttgatgacaatcagaggagaaactcttctaataatgaacatcttaacttcctgactgatgcatattttcagagacatttttaccataaa

SEQ ID NO: 649417 - DNA, 238 bp, Homo sapiens
aatggaaatattggatttttactgagtagcgctagctctgctacccggggcgcatgcgcatcacctgggcggaacccgcggaactgcgcctgcgcggccttgggccttccaaggtccgttccacgagggcaagcgcgccccagacccactcgtgcgccgttcttaatgtccccgcggtcgaaaacggtcacatacgcccccaagaaaacattgccaaggatccacacaggtcctggag

SEQ ID NO: 649418 - DNA, 4724 bp, Homo sapiens
  misc_feature (3008)..(3008): n is a, c, g, or t
  misc_feature (3014)..(3014): n is a, c, g, or t
  misc_feature (3023)..(3023): n is a, c, g, or t
  misc_feature (3029)..(3029): n is a, c, g, or t
  misc_feature (3032)..(3032): n is a, c, g, or t
  misc_feature (3034)..(3034): n is a, c, g, or t
  misc_feature (3060)..(3060): n is a, c, g, or t
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgatgnttaatnttttccttncttttntcntntttttttttcacttcttttttttctnttttttatttttcctttgaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttcgaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649419 - DNA, 910 bp, Homo sapiens
taaaatgttcagcttttaattagaacatgtatatagaaagaggtttagccaaaaaaaccaaagcccatgtcatctatcaaactcctcggatccttcttttcttggtctcttcacttttcttccttctcctctcatgctgtgagagcagcacgaagtgtggagggggacaggaccctcctgtgctgagatgcaagcaccaagcagtgcgtgagaacgcagtatccaccgggcccctatacattgtgcaaatatgatggctctcccaatgtgtgtgactgtgtgcgccagaggccttatgtgaccaacaccaaacagcacagggcacacaaaaagcggctctcaaacattataacccgcacgagacagtgcttttaaactgatgagggagacattgtgatctctgtatatctctctctcgctgtagtaaaacagtgttcccacctactcatctctgtctgcggagacaaaaaaagtgaaggggcccagaaagtttacaatgtggccgaggagacgacaagaccttgcgggaaagaaacacagaaatggccccagtggggcgccgcgagaggccgacagagtgtatagcgggatagtgagaacggcccttggcgcgagacaccgggccgagggggcaatagaaactgcacagcgcgagaaaaactaacagaagtgttgtaagggagcacccaactcaacacccaccaaaagcggacagagccaacaatatagcagcgatactcaccaatcgaggacagagggggcaacgagaaagacaacaccgccgggagcagagctattgggctcaaagtcacgagctgaaacccagtttcacacccactcgaggagcagggggaaccgacaaaagagtcggaggccctcaaacgtgagcagtagatggtgggggaccccc

SEQ ID NO: 649420 - DNA, 4337 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttcgaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagca

SEQ ID NO: 649421 - DNA, 276 bp, Homo sapiens
ctccatctcaaaaagagaaaaacaaagtcctttaaaactgtctttgtgcctggtctgcagtgatccatgcctgtaatcgcagcactttggcaggccaaggtgcgaggatcacttgagctcaggaatttgaacctagcctgggcaccataaggagacctcatctctacaaacaaaatacgaaaactgtttcttgttatatagaaactcaatccgtcttcatatggtgtctctatagctaatatacggttccacaaaccatggccactcccgtaccag

SEQ ID NO: 649422 - DNA, 374 bp, Homo sapiens
ggtcgcaggatgagcaatattaaatcatagaacaaacaaaaggggccgctgataacacgtgcatagagccggcggacacctgggtcagctgggtttactctagaatttcactggtcggtcccaccccacttcttccaccccacttcttccttcaccaacatgcaagttctttccttcccggccagccagatagatagacagatgggaaaggcaggcgcggccttcgtggtcagtagttctttgatgtgaaaggggcagcacagtcatttaaacttgatccaacctcttggcatcttacaaagttaaacagctaaaagaagtaaaataagagggcaaggctggtggaaggtacagggcatatgggctgcacccgg

SEQ ID NO: 649423 - DNA, 3792 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaaaaaaaaaaaaaaaaaaaaaaaaaaaaaaaaaaaaaaaaaaaaaaaaaaaaaaaaaaactctggggggggctccggaacccaaatcccctatagggggccttaaaccaatagatggcccgtaaaaaaacacctgggggggggccaaaacccctggtaccccccacaaaggagtcgcgttttaaataaccacgcggcctttatctaaaaagggctatacagggac

SEQ ID NO: 649424 - DNA, 125 bp, Homo sapiens
accctcagccagaaatatagatgaaattcaaagctgttctgttttcagaaccacctgcctctgatgtagaccaagaaattgctggtagctttctaagtgttgagtttgcattggttttttcccca

SEQ ID NO: 649425 - DNA, 154 bp, Homo sapiens
ccactcacggcaattagatagatctcatagcaaactctagcacactggggatgagatggtgatagatcacgcctttgaggatagactaaatgaatcagcgagggactttatggtcctccttcgtgaggccgacggatgttatagctgtgtcctg

SEQ ID NO: 649426 - DNA, 747 bp, Homo sapiens
gtctgtacatgtgtgctgtaacagaaaatactgggtatgcattacttgaatacttgaaaactgacattaataagatgtattacataatgaattagatttctctgaaacagtttttaccactgaaaactcttcatttctggatgtgcacgttggaccacctggaactgaagacctgaattattatgggtagaaaaacaaccttatgactacgtgcttatacacgaacctgtaaacctgttttataacacctcttggtgtatgacgcatcaaacctgtcaacgtctttctcgtaacgtttcctctcctgacaaacttttcttctctcttctatacctttatgcacttactatactcctgatgtaataacaagagccgggttaaaaatatgtgtatctggtattcattgtgaatccctgtacgcttttctagttacgccaaaaaaatcgctttctaacaatactcttaatacccatagttataggtataaacatcttacccattagtagtatcttcacaatgccattaaatcactatttaggtacacacacctaatgttataataaaacaatttggacacaccattaccatcacttgtcttccacaaacttaattacagttgcacgagtaccgaacaaaaaacactagacaaagaagaatgtgtagggggactgcaattcagttaaatttcaaaaagtcactccataaaggacacgtcagcgattgttgcaacccagggatccgtaataa

SEQ ID NO: 649427 - DNA, 2832 bp, Homo sapiens
  misc_feature (2821)..(2821): n is a, c, g, or t
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctaaaaaaaaaaaaaaaaaaaaaaaaaaaaaaaaaaaaaaaaaaaaaaaaaaaaaaaaaaaaaattttaaaaaggaaaaaaaaaaaaaagaaaaaaaaagagagaaaaataaaaaaataaattgtaaaagggagtttaatgaaattttttggcacattaataaaaaattgtttggaggcccattcctggggaaacttttaaaattccccaagaaatcccctccctgcaaatacccattttaatggcaaagaggccctttaagagggcccaaaaaaaaaaaaaccccaactgtttaaaaacatgaaagcggaaaaaaaattgtgtggccaaaaataaagttaaatttggaaaaaacccttttttaaataaaccaaaagtaaaaaaagggccaaacattttcttaatcaaaaaaattgccacaagtatggggcgagtgtgaattaaggggggaacaaaatttgaaaaaaaagccaattattctccaacgaaaacagcaatttttaacaaaaaaaggcgagctgtcaaagttcttgtaaaaataaaagaaaaaaaccgtaagggggtgttgttggcccaaaccaaaaaacgggagngcccccaaagg

SEQ ID NO: 649428 - DNA, 2285 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggaaaaaaaaaaaaaaaaaaattttttggggcgccgggcccaaaaaattttttaaacccttcttggggcgccggggggaca

SEQ ID NO: 649429 - DNA, 175 bp, Homo sapiens
atgcactgcttcttacccttttactgggtctctcttttaccctcctacagcctccgagtacttcgagtctcccttcacatttccgacggctctacggctccacccttttttgtagccccaggcttccccggacttcccgtccttattggctccaccttttctcactatctggttt

SEQ ID NO: 649430 - DNA, 3701 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggactgaatgaaattcctccgaacaaaagaacaaaacataaaacacaaaacacaaaaaaacacgttgttgcggcgcgccgcctcgggcgccccggagaagaggcttttttaacacccattttcgctgagtgtggagccgcgcgcgcgggcccacagagggtctaggcgagaaccgtggtgcaccatgcgggtgtctccaccccagggagaaaaacctcagggggcacagcgacagacaataggagcgatagggatctctctacccacgcaatacaaagaaagacgcacaccggggggaggaaacaaccaagacggcaggtcagtacggacaccaaacaccagcaagtagcgagggaggatactcagagagggcgacacgatcaaaaggggggaagaacataacatacaagcgagcgcgagaatcaacacagacgagaggaagagcagccagagaaatcatacaaaaagtagcaacagccccaccgagaaccaacggggagagcagagaggagaagaagacagagcaagagcgaagaaagacagacgaagcaagaacaggaaggaaacaagcaagtaagaacaagagcaaagacaaaccaaaagagaagagcaaacgacacagaagagaacagaagaggacagaccggaaacacaaagaatgaaagagaaaggaaagaaagacagaagcgaagcagggaagaggaacgagggggagaggacagcagacagaggagagagaggacgagagcgagagaggaggaacgcgagaaagagaggagggggggagaggcggacgaagacaacgcagggagagaggaggagagaagggagggacgagagaaagaaggagagggaggaaagcaagaggcgacggagagagagaagaagagagaaagagcgagaagagagagcgagaccgggaggaagaggaggaagagcgagaggaacaggagacgaggagaggcagggagcagaccggagcggaggaggggcacagaggggcgcaagagcaggagagagagaaggaggcagacggagagcgggagcacaggacgaggaccgaaggagaagagagagacgagcgacagggcgaaaggagcggaggaggggcgggggggaagcaggtgagagggacgggcagggagaacagagagggggaagaaaaggaaggagagagacgaggacagacaagagcaagagacaagagcacagaaggcagggaaagcgcgaagagagagggacgagacaagaggacgacaagacagcagagacggacaaagagaagagacgagaaacgaagggagcaagaggagggagagaggacgaagcagaagaggagaagagagaacagagagagagcaagagcgcacgaagaagaacagacaggcagagacaaacgcgaactgcgaagcaaagacgaaaccagctgagacaagcgacgcagcagagagcaagcagcagagagagagagcgagcgcagacagcgacgacgagaaa

SEQ ID NO: 649431 - DNA, 363 bp, Homo sapiens
tggagacaaagtcttgctctgtcgcccgggctggagtgcagtggctcaaccttggctcactgcaacctccgtctcctgggtttaagctattctcttgcctcagcctcccgagtagctgggactacaggcacatgccaccatgcctggctaatttttgtatttttagtagagatgggatttcaccctgttggccaggctggtcttgaactcctgatctcaggtgatccacctgcctcagcctcccaaagtgctgggatttacaggcatgagccaccacacccggcccagatgtgcttgctctttagtaaacagattggaaggaacaccaaaacaaattgcataaaagggggttatggtgagagt

SEQ ID NO: 649432 - DNA, 344 bp, Homo sapiens
agtcgccggcagcacatacttataccaccagaaagtccggctctactgcacaccctctttgggtcccgcttgctcagcaagacctttcttccgactgaacctctctctcctgctgcagtcaccggctgagttgggccaggcacaatctccccaaatacttaaatgaaggcccacttgaggtttgggcctcaccgctaagctgagatgaaacatgcaaggcattccggccccttccccttctggtcccagctgaccttccacccacagcacttacactcagataaagaaaagtcactccctgcaagtgaaaaaaaaaaagagaaaaatggccctccttggcctca

SEQ ID NO: 649433 - DNA, 653 bp, Homo sapiens
gagaaaggtaatagaatgcaagagaaatgtacttaaaatggtaacaggaataggtgatgggtttgactggggaataaggcagagagaggcattatgaataacccaaagtaaaataaggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaa

SEQ ID NO: 649434 - DNA, 162 bp, Homo sapiens
ccaggcaaggaggcgccatcatggggagttggacatccgccataacaagggaccgcaagtttcggcgcaaggagccaagagccaggatatcttactcaggctgttggtcaagtatacaggttctggcagaggaccactcacatcaccaggttgttttgaagg

SEQ ID NO: 649435 - DNA, 123 bp, Homo sapiens
  misc_feature (120)..(120): n is a, c, g, or t
ccgacaccatagaatgtctaccgaattatagctttacaaaatacaacaattttatatttcacaaatatttgaactcaaataaatcaattcttacaaagtacactttctcattctatggtngct

SEQ ID NO: 649436 - DNA, 386 bp, Homo sapiens
  misc_feature (386)..(386): n is a, c, g, or t
gagagagagagagagagagagagatagagagagagagagagagagagagagagcgagatagagagagagatagagagagccacagagatagagagagaccttgtgagcgtcttacctacttcgttccttttactctatttctacccgttcttctgtctccttccatccatcacctatctaagtgctctttctgccatgttgttttcttgactattgtgcttaccgcttctcttgcgctcatctcttcctgctcactctcatgctctctcctttccctcatgtacctttacatactgccccgctccttttccattttttcgcttttgtcctatttcctctgttttgggtatttctgccttctcatgaccagcttttgtctcttttcn

SEQ ID NO: 649437 - DNA, 3181 bp, Homo sapiens
gaattcgcggccgcgtcgacccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagttagaagaactcactgcaaaacagtttaccccatttaaccttagttgcatgttaaccccaagtttgaattaatacctggcaaaaatagaaccaaaatttccataaaacccacggggtagtgggtccctttgtgtggctttccctaattaactccaaattgaatttccccccaccttggccacagggtgctttcaaatatttttaaaattaattttaaaaaaaaaatttattgatttaaccttttaaataaccaaaataattaattaactccttgtctatttggggtttggcaaaagaaccccctattcaaaggaatgtcgcctgttcgctataaaaaaaatggttccaaaattttccataaaaccgtgaaaactgaatgttcttcttcattttgctcccgtgttaccaacctaaattgctgcacactttggggggcttcggttttttttttttttcccccccttcaaccccttcaaaattctccccaaaaggaaagttttcctctcccccccccgcctatattaaacccacacttaaactgaacccccccaccccccccctctaaaaaaaaccaaatggttttttggttcgaccatctaaagcatctctgctcataacaaattccttttttttccagggcaaagctattaccttgtaggatgctctaatcatattggcatttaattttattttgcaacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgaaataaatttcccaaagttaaaaatttttttaaataggactgtgggaatttttaaagattaattatgaaaatggagctcagggtccgtttgggggtaagaaaagctgtaggggaaagccctgtttgttttttaaacactaggtggaaggtttcaataaaaaaagcctgctgctcacagcacagaaaatggggcagggggagcctcaagcacaatttagctgtcctcctaaagaatttgtaatgctcaatccccttgggtttctcccggcgctgtcgggaggctgtgctggtggttgtgtagaggtccttttcctttcaaatggtgcagagagagaggacctttcctccttgttcagttgcaattcagtattttcacggatatgaatgtaaaatatataaatatataaacctgaggatttaacaaatgtaaaacaaccttttgaattagttccgagtatagataattaaatt

SEQ ID NO: 649438 - DNA, 339 bp, Homo sapiens
ttgatgtttaggttcttgagttcttgatatactttggatgtcagctctctgtcagatgtggagttggtgatcctattccactctgtaggctgccattgtttcctttgtctcatggaagcttttcagttttataaggacccatgtattaagtgttgatctcagtgcctgagctgttggtgttctgttcggaaagttgtctcctgaccaatgtgttcaaggctgttcctcacttactctcctatcggatttagtgtatctggttttatgttaaggtctttgatccacttggacttgagttttgtactgggtgacagatatggttctatctgcagtcgacgc

SEQ ID NO: 649439 - DNA, 142 bp, Homo sapiens
cggcttggtagagtagaagagaaggagcatccgtaacattgatgaggagtttggctggtgatcgctggagagcgagaaactcgctcgctttcagcaagacagatacctccttactattgctctacatttgaaccttgctggg

SEQ ID NO: 649440 - DNA, 566 bp, Homo sapiens
  misc_feature (151)..(151): n is a, c, g, or t
  misc_feature (467)..(467): n is a, c, g, or t
tatatttccagaccagttggtatagggttggcttctcacccgaagaccccttccctggtttggtggaaagggtgattttagctttgtttcctaaaaaaagagagggtcccttggggggcccctttcccgtgtttgccagggggccctttgnccaccccttgttatagccacatggagaaagctttgtggatttatccctggggggtttcccctgtttgccacccctttagggaaggggggggccctttttatttaaaagactttttgcccccttttgcccaaggggatagattgggggggttccccctttattttcccccctttttttcccttcccttgtgatggggtcaaaccccgtgaaacccttccgtcatggtatggggtttaattggggttccccctttttggtttttttggggggggccccccctcccccttttttttaattaaaaacaggccttttttangggggggttggggcattcccccttttttggcctccggggggggcccccttttttttttccccttgccccccccccccggttttgggggggggtttttta

SEQ ID NO: 649441 - DNA, 330 bp, Homo sapiens
  misc_feature (321)..(321): n is a, c, g, or t
gatatgtatcaaagcaacatatcacgacacacagaatgcaaaaacagatgtggaatccagttgtcttctattgaaatagactttaggccagacacagtggctcaggggtgtaatcccagcacttatgaggctgaggtgagaggatcacttgaagccgggagtttaagaccagcctgggcaacatagcaagaccccatctctacaaaaacaagacttaaaagagatttacaaaaatgtgaaagaaggccattcttcttactgttttgtttttataaaaaaaatgtttttcataaaaatgtcatacatgctgcatacgaaggnggatggaca

SEQ ID NO: 649442 - DNA, 1624 bp, Homo sapiens
  misc_feature (607)..(607): n is a, c, g, or t
  misc_feature (624)..(624): n is a, c, g, or t
  misc_feature (987)..(987): n is a, c, g, or t
gagccgcttgcttgaggtggcgtcgtcggcatgtctgccctcgactgttgcccccgtgccatggtcaggcgcactttgcgtcaatggaccaacacgcatcatcatacattacatatgaaactggcccttcttgcgaggcgtcctgcagcctgcagcacccggagacgagagtggccgaaggacttgggcttttccaatactcaacttcgcactcccagcgtgcataatactggaagaccaagcaaccttgagatccccagtttgtatcttcatttctagtctttccagagggaagcctttgcgaagggtctgggggagacccatgtatttggactggatcgccccaagtgaagaagggggagaacagtcaaacatacacgacagttttctgattcgcagaggtttcggcggcatatgttcccctttgttcgtcgttccaagaggaataggcctatgctttgtgggacacgtatagtctcacacgacgcgtttagccctcgcataattctatttgtgggagacacgtcgtggggactcacgaactcagtagagttatccccgtgatgtgatattcgatatagagctctgtctaaagagacgtaagaanctcctagaatctaaaantacaacgcagaagggacacacggacactttattggaaaggggagagaacgtttgggcggcaaaatcgcatcaaaaggctttgtcctgtcccctggtttgtccccaaagtaccgggaacagccctaagggccgtttgggtgccttgaggccccctaaatttgcggcacctattctggaatggtggcccccttttcgtttgtgggcccccatgggtggaagtggtccgttttcgcccttttggggaatacgccgcagaaagaactgggctgagaggaatccttagatactaaagcgccgacaacgttttttacgcccaaagaggggggggctgctcctccaggtttgtgccgccctcttgttgtnataggagccaccaagacgccgaagagtgtccgcccttttttcccccgtttggattttgaagaggaggcactcccccccatattattaaggcgcacacgaaggttggtgttacccttctctaagggggacacaaaccacggcggccgagggcgaactctccccctagaaaccacaattctttcttctgtcccaccaacagcgcactctttttgacacggggcaactgccgcgtttttcttacaccaaggaaggcgttctgggatttagggacatctacctttattagggtgtttacaatctacgacggcgtacaccgctcttcttcttgcggacccaccacacaccgtgctgtcgtgggcgccaactccccccacaacggaaatacggcggtgtatggcgcttttttaccctgattggggcgcccctgtggttgttgagccacccacctggcctcgggcgcggcgtatacagcgccctttaggggcggctttggggggttacaacaaacccccacacacggtgttgtggtgcgggcttttggcgtttatattccctttacacttgcccgtgcccgtttccctttcaccttcacgtttcacgtctttcttatcgtgctcaagggagcagcgggggcacc

SEQ ID NO: 649443 - DNA, 923 bp, Homo sapiens
gggctgtttggaaagacccaggagaagccgcccaaagaactggtcaatgagtggtcattgaagataagaaaaggaaaatgaacacgttgttgaccaggcaacataacgggactactccaacagagaacgaacgaaacaacgtgacaaccgactctgtgaaagactgctgccaagaacgggccagacaggatgtctgcataggttctggccaaggagactgatcaggtcaacggaaggctgtgacgcaacgctgtatgcatccaaagcacacatgtaactcagtgctcatggggatgaagaaccagctcgcggatcttgcgagtggctggttccctgacagaagagcaacaaggaagtgatgaaggccatgcaaagtcttgtgaaagattccagagattcaggcacaccatgacgggacgttggtccaaagaaatgatgacaggctgggatcatagacggagatgttagagggacacttatagaacaagcaatggacggaatcaggacagacaactgggcaggaagcaagcaagaaaactggaacaaatggacaggagattcatcattaaagaacattacccaagcacggggacccttgggacacaacagcacccaaagataaaagatgagactgaaatggcaacgaaaccaaagacagcacaaaaaaaccaatacaaagggaaaggcgcacagggaaaggacaacacaaaaggggaatgcgaagcgaagcgaaggagaacgggaacaacagagaaaccaagaacaaagcacaaagagacaagaaagacagggaaataaaaaccagagcaaatcaaagaaaaacaaaaagagggacacggacaaaaccgcctgaaaagaaaatgaagaaaaaaaaaaagagaacgatgaatcaaaagaaaacaggaaaaaacaaaacataaaag

SEQ ID NO: 649444 - DNA, 2440 bp, Homo sapiens
  misc_feature (2222)..(2222): n is a, c, g, or t
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggaatgaatgaaaaaatnaaaaaataataaaaaatgaatttacaaaaaaaaaacatgaaaaaacctcgagttttttttttttttttttaaagttttaaaactttttattggcatattaaaaaaatggtgctttccaataattaaaactcatttgaacaaaaaaactgggtttaactttaaattcacttggggcccaccccaatttttcccccccactttttccttaaccaacatga

SEQ ID NO: 649445 - DNA, 229 bp, Homo sapiens
agaatgagctgggtccagcggacagcaagagatgccccaaagaagctgggcgcggtggctcgtatctgtaatcccagcactttgggaggccgaggcgtgcgggtcacctgaggtcaggagttcgagaccagcctggccaacatggtgaaaccccatctgtactaaaaatacaagaattagctgggtttatagtgagcgcctgtaaccccagctactcaggaggctgagg

SEQ ID NO: 649446 - DNA, 4643 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctgaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649447 - DNA, 193 bp, Homo sapiens
atgtcttgcatctcatcacccgcatgagccatcagcacagatgacctataactcaggcatatacttcctattctacaccctagtaagctcccttcccctactcatcgcactaatttacactcacaacatccctagtgctcactacaacattctactactcaccactcacatgcccagagaactatcagaactc

SEQ ID NO: 649448 - DNA, 898 bp, Homo sapiens
  misc_feature (233)..(233): n is a, c, g, or t
  misc_feature (341)..(341): n is a, c, g, or t
tgcggtgtgctgccggagtatgagtgctggtcgagaagcccagttgtccgggttcccggtctggggagaacccggttacccccctgtgcgcgtgcttaccgccgcgcccgatgtttgtgtaacccgccccccttatgcgccttcgtctcccccctccggttgtgccgggtccccccagtgtctcttgtgccggggagcccgcccccaataacgtttggttgtggcgctcaccncctaattcgcagttccctcgttgcccctggtcctcgggcaatatttccgcccgtggggttgttcgcgccctttccctgcccggggggccccccctcccggacaccggngcttatttcaattgcgcgcctctctaccggagtgcccggtccctccttttccggcacggccccctgtggtgctgcgtccctccttcgccccctcggtacgagtgctgccacacttcttgggaccacaccccccccccgcccaccccttctgtgacaccccaaccctctgcgggcgtcacacccccaggggggccacctccttctaccccaaaacgtgccggggcaccaccggcgtttttcttatcaccacaccccacgacctcccgggaggccaagggcccctcccgtggggccagatgaagcttgcgccggggcccactgcgtcagagacgacgcgcccaacacctggccccagaagcggccccctgcccagagagcgcgggccacgatcttgcggaacaaatcgaggaccccacaagattggcctcacccttccacccaacatggggcacgtactgcgcattcaaccagccccccccgccaggagcaccccccaccccccccctcgtccgctccccgcgaaaaaggggaaaaaaccccctccccccccacaaaac

SEQ ID NO: 649449 - DNA, 4672 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649450 - DNA, 4643 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggagagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649451 - DNA, 1200 bp, Homo sapiens
  misc_feature (726)..(726): n is a, c, g, or t
ggacttgggagctaagcccaagtgtgaaatctctggatcctatggatttggtttcttcccacagtttatctgtatgttctacgtgtggctggacgccccggtatctccgtccagcttggagaacactgtcacctcggtacgcttgagggtgctacgatcctgcatgtggtgtcctagcctcccgccgtccgcccatgtccggtcgcatcacgagttggcctcagcgggtccagacattcagaccgaagcgctggtgcgctcctaggcgatctgttggcgagcatagtcactagacgtggttgctgttatataaaagtagaaacttcgcattatggctagtgcattgcgtcagagagaagatgctcaggaaattctaataagtcagtattgtccaacgcatatagatagagtcgcgtgcatgtggccctagtgactctccacgacgattaagctgctattgcgcgctgagccccttgtaggtccacctagtgatgttgcagctttgaataccgcgcgatgacgtgcatgtggtccttgcgcgccaggcgctggtcccttggcatgtacgcggaagccacataccgcaagttcggcgtcctgatggagtaccaagtggagcgttagtgatgcccatagtggcacttcagcgtacgcgtgttgggcaagaggtggcaataagaccagaagaaccatgtatcacgtgaatggacgcgtcgaggattcccnatgtgagagcccttcagtcttgggcatgcttggccaccggaacaggcccttgggctccctgtgtcgcccggaccccccatagcaggcccctggcgctggccgcttggtcggtcctcttgtccaaagggaagagccccctgtggtgttcagggagggcttgccccgaggtgggctgctcagggccagactagaccgaaggtaggagacccagagcctgttctaggaagggctagtcctgttggctgtactgagaacactgcgctttggactcacaaaggaagacccagggctgaggcccctccagggccagggtcctgggggcagagatctccagggaagcaagcaaggcccaggcctcctagcgactcacaaacaaggggcatgtgtccgcgaaggaccctggaagtgcagaattccccttggaaaggttcttggttaagtctgacgaaagtttgaaggccgaatgaagaccct

SEQ ID NO: 649452 - DNA, 689 bp, Homo sapiens
  misc_feature (608)..(608): n is a, c, g, or t
  misc_feature (619)..(619): n is a, c, g, or t
  misc_feature (649)..(649): n is a, c, g, or t
  misc_feature (668)..(668): n is a, c, g, or t
agtgaactcccattcacaattgctacaaaaagaataaaatacctagcaataaaacttacaagggatgtgaaggacttcttcaagaagaactacaaaccactgctcaaggaaacaagagaggacacaaacaaatgaaaaacattccatgctcgtggataggaagaatcaatattgtgaaaatgggcatactatccaaagtaatgtatagatacaatgctatccccatcaagccgttgttgattttcttcacagaattagaaaaaactactttaaatttcatatggaaacaaaaaaagagcccatatagtcaagacaatcctaagcaaaaagaacaaagctggaggcatcatgctacctgacttcaaactatactacaaggctacagtaaccaaaacatcatggtactgatgccaaaacagatatgcagaccaatggaacataacagaggcctcagaaataacactacacatctacaaccatctgatctttgacaaccctgacaaaaacagcaatggggaaaggattccctatttaataaatggtgttgggaaaactgcctagccatatgtagaaaactgaaactggaccccttccttaaacctacacanaattaactcangaggattcaggacttaaatgtaagaccganaatcattccctaggcctangcaggaccattcagggacatg

SEQ ID NO: 649453 - DNA, 4643 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaaaaaaaaaaaaaaaaaaaaaaaaaaaaaaaaaaaaaaaaaaaaaaaaaaaaaaaaaaaacaaaaagcaacaagagtagagcggcagcagagaggcacaaggaaggtgtcgagcacccccggggggggcgaggggacaccaagggaggggagaggtggacacaagggtgcacaaaaagaaacatccggacaaaaacaatggggagagactctaccaaaaaaaaacacgcgcgggggaacacaaagagtgagagagaacagccacagaagagctctcgagggaacaacagggagccacataagagatgaagaggacggcctgaaaaagagtcgcgg

SEQ ID NO: 649454 - DNA, 2141 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggtgtgctagactgtaagttccttgggggcagggcctttgtctgtctcatctctgtattcccaaatgcctaacagtacagagccatgactcaataaatacatgttaaatgga

SEQ ID NO: 649455 - DNA, 2153 bp, Homo sapiens
agggcaatcctttctttcagctggaagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatgga

SEQ ID NO: 649456 - DNA, 403 bp, Homo sapiens
  misc_feature (259)..(259): n is a, c, g, or t
gacaaatataaatacaggcaattgtctgttctagagttgcttaacattgagaggctaatgaaaagctcaaatcagataacttttactggtatgtgtggctataggttttaaagtgaactttttcttcttctctggggaaagtatttttgtgtatgttttatagttcttgcttgaatgaagaaaccactttgctaaaaaactttgagacttggatttttaactgaaacagcctagatatacttagctaacttactgatanaaggataaaatagaaggaagcgagataaatttggagggccaggctggtctcacactgctgatctcatgatccacccgccttggcctcccaaagtgctgggatcacaggcgtgacgaccacacccggcctgtatgtctcattttt

SEQ ID NO: 649457 - DNA, 215 bp, Homo sapiens
cgtccagtatcttccctaagccatctgataatgttccagcaaacttggcagcagagtttgatactccgtgtgttacatttctgatgaggccccctacatttccatattttatcagtccagtaaccccttcagaaacttcattcaaaagcaagaaaaacggatatttacaaacttccatcgccagcttttttgttggattgacaagtggatcgatc

SEQ ID NO: 649458 - DNA, 262 bp, Homo sapiens
  misc_feature (48)..(48): n is a, c, g, or t
  misc_feature (74)..(74): n is a, c, g, or t
  misc_feature (165)..(166): n is a, c, g, or t
  misc_feature (185)..(185): n is a, c, g, or t
  misc_feature (227)..(227): n is a, c, g, or t
ccaggctcttgcctataatcccagcactttgggaagctgaggcggganaattatttgagcccaggagctcaagnccagcccgggcaacatggggagaccctgtctctacaaaaagttagccaggtgtggtagcgcatgctgcggtcccagccactcgggaggctnnggcgggaggattgcttganccacctcaaggtgggtgcagtgagccatgaccgtgccactgnactcccgcctgagcaatgaaggaagaccctgtctc

SEQ ID NO: 649459 - DNA, 120 bp, Homo sapiens
attaatgaggcatttattgaaatggcaaccacagaggatgctcagcgccgcagtggattattacacaaccacaccagcgttagtcttttgcaagccagtacagagttcatttatcccaga

SEQ ID NO: 649460 - DNA, 141 bp, Homo sapiens
gaggatctccggaaggcgcactgcaacacatcaatgttggtaagggatgctcaggtctcggttggcaatgtgcttgaggagtgtggtcttgcccttgcaattgggtcctaccagcccgtagcggcggccggctacaatgta

SEQ ID NO: 649461 - DNA, 1031 bp, Homo sapiens
aggagaaatataggcttaggtcaacttgtgttaatcggcacgagggaagcgcagcgcaccttcgtcatgttcttcgcgcctggtgtggtgaacactgccagcggctgcagccgacttggaatgacctgggagacaaatacaacagcatggaagatgccaaagtctatgtggctaaagtggactgacggcccactccgacgtgtgctccgcccaggtggtgcgaggataccccacttaaagctttcaagccaggccaagaaagctgtgaagtaccaggtcctcgggacttccagacactcggaaaactggatgctgcagacactgaaacggaaggagccagtgacaccagagcctgggaaagtgggaaacctggccagtgcccccgagctcaatgcaaggggctgtattgaggcttcttcaagcaagcaacttttgagacttgcacgtttgcacaagggtggaaccacttttatccaaagttcttcgcctcctcgtgggttgtgggttcacttagaaaggccctgggttccaaacctggggagcaagctggctctgggccttgaacattccgaaaactgtcaaggatttgcgcaaggttgaattgtacaccagcactatgaactctgctccgggaaaaccaggttcgttggtaatcccactctatctctggttcccgagatgcgaacaaaggtggatcaagtacaaggggaaagcgggatattggaggtcacttgaggggagtacgttgggagtcgcaggcttgcctgctgcacagaggacttgagcgaccggagacctgtccacggccttcaagaaggccccgtgtggtttggcaagcttggagccctgagtgttgtacaaggggcgcctgttttttggcactcacttgaggatagttcgatgacaccctctgggcgcaaggataacctttaatccaagtttattggcacagggtgggcacttgtaagaaccggggccaattgggcggaagctctcaaggatccctggacttggggggcaaaaaccgaaaa

SEQ ID NO: 649462 - DNA, 204 bp, Homo sapiens
  misc_feature (189)..(189): n is a, c, g, or t
  misc_feature (199)..(199): n is a, c, g, or t
gctacaagaggaccccggcaggcaggttcgtcggcaggcaggtgaaaggctggaacactcctgtcactcactgtcggctgctgaacagtggagccaaggccagcaggattgagggtgtgaaccgagggcttttggaggaggtggtgtacgtggatgacatactcgtgggtagaccgtggtgtttctcanaagatcacanaagat

SEQ ID NO: 649463 - DNA, 376 bp, Homo sapiens
cttcatcgcagcctctcttagctttcacttggactgaccctgacgccattaggctcagcaaattacctgggctgtactgccgcaaggcttcacagacagccccattacttcagtcaagcccaaatttcatcctcatctgttacctatctcagcataattctcataaaaacacacgtgctctgcctgctgatcgtgtccgactaatcccccaaacctcaatcccttacaaaacaacaactcctttccttcctaggcatggttcgtgcggtcagaattcttacacaagaggcaggactgcaccctgtagcctttctgtccaaacaacttgaccttactgtattagcctagccatcatgtctctaatagtttatgctgt

SEQ ID NO: 649464 - DNA, 535 bp, Homo sapiens
acagacctcagagagtttcccatccattgcgtgtctcgtcatctctgctcggacaagaccctatctgtcaaggccgcactgggtgtaagtgtcggcgtgcatcgcatggcgagctatggtgcggaggccctggagaggactgttcctgtccttccccaccatccaagacctacttcccgcacttcgacctgagccacggctctgcccaggttaagggccacggcaagaaggtgcgctcgacgcgctgaccaaccgccagtgggcgcacagtggaccgacatgcaaccaacgcgctgtccgcccgtgagcgacgctgcacagcgcacaagctatcagggtggatcccggtcaacttcaagctctaagccactgccatgtctggtgaccctggcacgcccactctccccgcacgagttaccccctgcaggtgcacgcctacctggacaagttcctggcttctgtgagcaccgtgctgacctccaaataccgttaagctggagcctcggtagccgttcctcctgcccgctggataccc

SEQ ID NO: 649465 - DNA, 102 bp, Homo sapiens
atgcttgggccgtgatgctcgtgacgcattcgcttggcctatctctgggtgtagcccctcctaaacaatggccacaggcagtggcctcggccccagctgcgg

SEQ ID NO: 649466 - DNA, 148 bp, Homo sapiens
  misc_feature (20)..(20): n is a, c, g, or t
  misc_feature (50)..(50): n is a, c, g, or t
  misc_feature (80)..(80): n is a, c, g, or t
cgaaacgcagcatcgccttnctgcacagctcgacagcgactcgggggctnctgctcgggtaccagcacgatgatatcggngtagtgcgcctgattttgcccggtccagataatctggatgcggaaatagcgctggtcgccgctgccgg

SEQ ID NO: 649467 - DNA, 218 bp, Homo sapiens
  misc_feature (19)..(19): n is a, c, g, or t
  misc_feature (57)..(57): n is a, c, g, or t
  misc_feature (65)..(65): n is a, c, g, or t
  misc_feature (85)..(85): n is a, c, g, or t
  misc_feature (133)..(133): n is a, c, g, or t
tgcatgtgctgtaggcagngttgaaagtcactgttagaagtttgactgaaatgttcnaagggaanggaagtaagaactcaaatanatgggaagaactgactgaccattcacttcaagtatcacataatccctnatcacaaaccgttccttttcagctctctttacctggctggggagtccacggatgagctctttgtagtgggaacatctcgacccct

SEQ ID NO: 649468 - DNA, 115 bp, Homo sapiens
gactacaggagctttcgaatcgacggtttctcctgtattgcagttaggagtagtctcatctaatttccttctctttcttcttcctctcacatgcttcagcatgtggttctctatg

SEQ ID NO: 649469 - DNA, 250 bp, Homo sapiens
actttgagaggatgaggtaggaggatcacacttgagcccaggagtttaagaccagcctgggaaacttaaggaaacccgatatctattaaaaatttaaaaattaagccacgcttaggtggcagacacatatagtcccaggtaacaaaagagattgaggtgggatgataactagagtctgggaagtcaagaatgcagtgagacataataatgggaaaaaactgtagactgggtgacacaacaaactatgtaa

SEQ ID NO: 649470 - DNA, 100 bp, Homo sapiens
gtagcggcggcaacagcaacaacagcaacaccagcagtatacaccagcagcaacagcagcaacaggcggctcctccccaaccccagccgcagaaagcgct

SEQ ID NO: 649471 - DNA, 134 bp, Homo sapiens
gccagggcgctactcggcgaggtcgacgccgaagtggtgcgcagcgcgcaaccgtgtggcgctgaagatcaagatcaacgaaggcacgtcgccgccatccagcacatcaacatcgtggcacaacgtgtcgagag

SEQ ID NO: 649472 - DNA, 770 bp, Homo sapiens
tgctccaaaaaatttttttttggggaataaggccctcaccccccgtcgctaattctctctgacagctggacccccttactcaaggcctgtgccttcaggtataaaagaggtttcctgaagacacgacctgactgtgacaacagcagaggaacccacgcccactgtgataacaaggtaaccgttatgttgattcttacaatgggagatggtgagttagaaagttccccggacatgggcgatggggagggaagaggcaataagaaagtcacgaggtagaattaggggcccttgaaatatgaccaaactctgagggaaaccaaagaccaatgtggaaagaataacttaattttaattcccatctcccgagagatttgaggtgtatttaagatgaaaaccggatactcaccaagaaacggaaactcaggagttcaagacccagcctaggccagatggccacatcccgtctctaccaaaataatttttaaaaattagcccagcatggtggcatgtgcctgtggtcctagctacttgggaggctgaagtgggaagatcacttgagccccggagttcaaggcttccagtgagccctgatggtgcccctgcactccagcctgggggacagagtgagaccctgtctctttaaaagccagaaaagaaagagaagactgagaataagaagatctctttgaaaattaaataagactgctaaaagtatttggtataccgtctggaaaataaagttgaggggatctctcccagattaagagcca

SEQ ID NO: 649473 - DNA, 105 bp, Homo sapiens
gcagtcctaaacaatcacaattacactgtactacccaagaagactgttgcttctctttttttagatatttttctatctctcacttctcagggatgaaaaatatct

SEQ ID NO: 649474 - DNA, 93 bp, Homo sapiens
gcggccgcctactactactactgctcgaattcaagcttctaacgatgtacggggacatgactccaaaaaaaagcacaaaaaaagttgtactgc

SEQ ID NO: 649475 - DNA, 362 bp, Homo sapiens
  misc_feature (2)..(2): n is a, c, g, or t
  misc_feature (359)..(359): n is a, c, g, or t
cngccgccactgtgctggaaagccatggagggatgcaactagggatggctgtcagctcatccctgcagatgaagaaagttatctcttaaagggggatcaagagaccacctttattgctgctacagtgagcatgccgacagccagagatgtctgggctcacgtttattgagcctgcccccataaatataaacagtccactacgtctttggaaagagacaaatacttgctacctccattcctcacctagcgcttctagtccagtgtggagagggttgtttctcaatatgatattcaaagaattgctgcttctgctcatggactatgatctgaacacagctccctctctctctctctctctntct

SEQ ID NO: 649476 - DNA, 265 bp, Homo sapiens
gctctgctgacagcactggaacacccaaaaggccctgaggacctcactgggaatacaacacacagggaagggaggccagaggtggcactgccacctcccaacaagcctgctgctgcccacgcacatggtcaggaaccacggcccgacaggcaacccagagccacactaactgctcagcgtttgacgtgcagaagttcagatgggctctaagcatgaaagactcaccagagtacaaatcttagtgatcctcccgcacaaaagcatt

SEQ ID NO: 649477 - DNA, 270 bp, Homo sapiens
catacggtaagacagtcgaccaggtagtagaggccacagaaagcagagatcatagctactagaataccagcaagggtaacaaagtagagacctatacccaaaaatataactatacgacgggctagtacacaccaccctagaataaaaaggcccagccaagaagtaatagtacaacagtagtaaaacaaagatagcaggggctacaaacaatagcgagtactagcctaaactaaaacgatagggtataacatatactagacgaaagcacgc

SEQ ID NO: 649478 - DNA, 122 bp, Homo sapiens
gatgtgtacaggtgtagcactgtgccggctaaccagaattcttatacctcttgctttaagtgttgggagaaaatggaaaaaaaaaaaagttagagctttagtactggtacacttcggggcag

SEQ ID NO: 649479 - DNA, 267 bp, Homo sapiens
tggagctgtagttggcgtgtgtgagggtgtacctgcggaactgtttattggcgagacatggtttgtttaaaaactgttttcacggcagctgtgtaatgcatatgctatgtctacagtaacggtttggacagggtagtctgtcctggtaagtcggagaaagaaccagattgcgtggctctatggagggggtgctggtgcctctgcttgagtagtactgtgacccgcacttcagctgtgatgtagagaatcctagtagctactggtatg

SEQ ID NO: 649480 - DNA, 235 bp, Homo sapiens
tggtatcaaccacttcgtcgcctaaaggcaactcgtcatcagctctcagccttagaatcccggatttgcctaagattccagcctaccaccttaaacctggacaaccaacgccaggcttggctaaccttctccgtccctccatcgcaataactgggagtacaggaatattaaacctgtttccatcgactacgcttttcagcctcgccttagggaccgactaaccctgcgtcgaata

SEQ ID NO: 649481 - DNA, 296 bp, Homo sapiens
agtctacagtaaaatctctacactaacagtttaaaggccggcagctgaagcattcagcctctgcagtgtagactactcgactgtagtagaggcatttggatacttacaagtcaagtgctgtggctccagttacccggctcccaccctaacatccatactatgttgtctggagagccatggacacataattattttcagcaaccagctgcagtaactccattacagcaacccatagtataaaccacaatgctcattgtaatggatattgaggtcattgagaattctaggttgcatgt

SEQ ID NO: 649482 - DNA, 993 bp, Homo sapiens
catatggctaagactgggcaaggcgtcggagtgacgggtcgatattttctggcattgtggtctactgctgagccagtttctcagtctaccacttctgattatcagtgggatgttagccgtaatcaaccctatatcgatgatgaatggtctgggttaaatggtctgtcttctgctgatcccaggggtgattggaatgcaccagcagaagagtggggcaattgggtagacgaagaaagagcttcacattctacagtcccaggaaccaatccctgatgatcaaaaggtctcagatgatgatacaacgaacagggagagggagctcttccaactgggaaatccaaaaaagaaaaaaaagacaaacgaagaagcacggtgaagataactctactgcacaggacacagacagactccagaaccacagagattagcgaagaccttccagtgaatcacctctaaaaaccgtccaacaaccaggaaaaagcttctgccttgaagaccataaagcactagtgatccagcgaagtactcgtcgaacaaatagccagcctatcaagactcttccagctgctactactaccgagcatctgtcatcttatccaaacaagtgattcttgacaggagctcgtaccaagtgccgcacatactcgaagaagacagataactcccacggtcgaataacaagcaaataggtgtgctctttacagacagtggggaataagcggattccctgccactacaaagagaaacagcgagcagaacggaagttgtcgcggatggcatggtcggagccctgtctgaagaagtcggagcacatagggacagtacgaggacagacgtaacagctcgagccagggagcctcactgcggacaacacggaaagaaacgccgaatcgcgggcaatggacgtctatcacaacgccggacggaacgcgacacggcacagagaagaacggcgcagtgccgaccaagacaccagcgaatcctgatcccgtt

SEQ ID NO: 649483 - DNA, 331 bp, Homo sapiens
tacaagatattaataggtattctttgaaaaagaggtgctggaaataaatacttagaaaatactgatttcacccataatcccagcactttgagaggctgaagtgggaggatcacttgaggctaggagttcaaaaccagcctagtcaacatggcaaaactccatctctacaaaaaaaaaaaaaaaaaaaaaaaaaagccaggtgtggtagcacacacctgtaatcccaactacttgggaggctgagacacgagaatcccttgaacccagaaggcagagattgcagtgagccgagattgtgccactgcagtccagcctggatactctgtcttaa

SEQ ID NO: 649484 - DNA, 537 bp, Homo sapiens
  misc_feature (8)..(8): n is a, c, g, or t
  misc_feature (70)..(70): n is a, c, g, or t
  misc_feature (72)..(72): n is a, c, g, or t
  misc_feature (89)..(89): n is a, c, g, or t
  misc_feature (92)..(92): n is a, c, g, or t
  misc_feature (95)..(95): n is a, c, g, or t
  misc_feature (125)..(125): n is a, c, g, or t
  misc_feature (129)..(129): n is a, c, g, or t
  misc_feature (134)..(134): n is a, c, g, or t
  misc_feature (137)..(138): n is a, c, g, or t
  misc_feature (141)..(141): n is a, c, g, or t
  misc_feature (148)..(148): n is a, c, g, or t
  misc_feature (160)..(160): n is a, c, g, or t
  misc_feature (162)..(162): n is a, c, g, or t
  misc_feature (176)..(176): n is a, c, g, or t
  misc_feature (179)..(179): n is a, c, g, or t
  misc_feature (195)..(195): n is a, c, g, or t
  misc_feature (197)..(197): n is a, c, g, or t
  misc_feature (214)..(214): n is a, c, g, or t
  misc_feature (218)..(218): n is a, c, g, or t
  misc_feature (222)..(222): n is a, c, g, or t
  misc_feature (241)..(241): n is a, c, g, or t
  misc_feature (256)..(256): n is a, c, g, or t
  misc_feature (262)..(262): n is a, c, g, or t
  misc_feature (300)..(300): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (338)..(338): n is a, c, g, or t
  misc_feature (378)..(378): n is a, c, g, or t
  misc_feature (385)..(385): n is a, c, g, or t
  misc_feature (390)..(390): n is a, c, g, or t
  misc_feature (396)..(396): n is a, c, g, or t
  misc_feature (401)..(401): n is a, c, g, or t
  misc_feature (407)..(407): n is a, c, g, or t
  misc_feature (460)..(460): n is a, c, g, or t
  misc_feature (473)..(473): n is a, c, g, or t
  misc_feature (495)..(495): n is a, c, g, or t
gttctggngtttagggcatagttagaaaagatttaagatgtcctttcccaacattctttccaatccattngngtagaataactccagtnccnggntgttccagtattgtagtttcaaaaaatggnagangtacnggnnggnaaagtcngggggggttccngngaatttaagccccngcnatagaatctcttctgngngcataataatggggtcngggnatcngcatcacgccgggcctccngctttagttgggggnatttgngcggggtccagccaaaaactccacagtagagtagaccnagagangtngcngtaagggccaggaggacaaaaagggnaatgtgaagcttggggtccagatggcttagtcagctttangataatnagaangacagntgggncccagnagaaaaagaaggccactgggtagaagcgcacccgttggtccacaatgtaaaanactgcccactgtncaatccccagaaagccagttgncttcacaaacttcttatacaatgtcagggctcggataagtaa

SEQ ID NO: 649485 - DNA, 472 bp, Homo sapiens
  misc_feature (56)..(56): n is a, c, g, or t
ccataacttgatggttttatctcgagatccagagacaatctgacggttatcagagnagaaggcaacactcagtacatccttggtatggcctacaaatcgtcttgtggtggtgcccgttgtgagatcccagaggcgaagggttccgtcccaggaccctgagagggcaaactggccatctgaagatatgaccacatcactaacgaagtgggagtgaccccgaagagctcgctgcgggatgccatagttggtctcatccctagtcagcttccacatgatgatggtcttgtctcgagaggcggacagtatcatgtccgggaactgcggggtggtagcgatttgggtaacccagccattgtggcccttgagggtgccacgaagggtcatctgctcagtcatggcggcagcgggtgcgagtgtcgccgcagcgacgaggatggcaccggatagcacagagagcccagcagcgctgcca

SEQ ID NO: 649486 - DNA, 655 bp, Homo sapiens
ggtggcaactatactctataagagaaattgctgctgcacccatgcgggcctggtccgtagaaatgctccttgctctggaggtacctcatacacgggctcctataactagctgcccagacatagaggagtgctgggcgccggctcctcaagagggagatctagccctagaagcttgagataggcagcacttagctctactgccaaagtgggtctctggttgagtgagctgcttctggaggaaggggctccctcagcttgcaaggcagagaattggaaaaggaggtaggaggacattaggccctctccttctgcttgaaaattctccctcgggtgcacggaagactcctggtcatttccggttccttgaaaccacttcttggttgctggtcccacgtcctcttggggggctggcctcggtaaccctgctcctgatagcgctgctcccggcgtgcagcctcacgctgctcaggctcccggcgctcctggtccagctgccgctgtgcctcctcggcccgccgcttttcctccagccgacggtctcctcctccttctctgcttgggccagaagctggctttacaaccctttaatctcagacaggcattgtcttctggtaccagagccacttgggcttgggtcccgtctggagcggcatcc

SEQ ID NO: 649487 - DNA, 247 bp, Homo sapiens
attcacgcacacagactgtaatacatacctcaaagtaaaaaacatataaaatctccttctacttcacatccctctccagacacgaccctacttctctggctccacattatacacgcctaaacttaagaagaattgtctactatcctagtaacccggagtcctctccctacttattgtctcaagatatactcccagtctgtctttcatccacaccagtcactccacccaaagctgatctggggatcct

SEQ ID NO: 649488 - DNA, 347 bp, Homo sapiens
tgcagtggttgcggtagatttagcacagtactcatcactctggatagattgagatgttctttcacaacagatgaacgatcagtatcactgtaagacacggatctttacaactgtttaatcagttttatttttgtacagtattagtgacccaagttattttgttgtcccgtttttgtaaatcaaatgaaattattaaagaggattctgacagtaggtatcttgtacatatgtatatatgttgtccaaataaaaacaataaatgataaagattgacttgctccacgccgttatgtgttgtaaaagggccatactttggtcataatgggcattgtgacacggtctctcaa

SEQ ID NO: 649489 - DNA, 101 bp, Homo sapiens
tgctatcaattcatgctttcccagttcaataaatagcaactcctatctttctagtgttgtcaggccaaaaaccttgtgtcttatagccattgattgaaagc

SEQ ID NO: 649490 - DNA, 375 bp, Homo sapiens
agattatactcgcatataccatatcactcttaggagtactcgaatatcgctcacacctcatatactccctactatgcctagaaggagtaatactatcgctgtgcattatagctactctcataacccttaacacccacttcctcttagccaatattgggcctataggcatactagactttgcgcggctgcggaagcaacggtgggcctaaccctactaggctcaatcttcaacacatatgggctagactacgtacataacctaaacctacttcaatgcgtctaatcgtgccaacaattatattactaccactggcatgacttttcaaacccctactattttttaacctcaacaacaacctatatgctgtgcccccc

SEQ ID NO: 649491 - DNA, 1340 bp, Homo sapiens
ggcctctgggtcctcggtcggtacagtctctgcacctcgcgctccagcaggtaaactaacattatggattttcttcaagctacccaaaactactcgatgaagcatccagaaagcacactttggcttatgtgcactggggctctcacggacctgtggcttacagcctgctgcacatgcgcgggctgcaccccctgctcctgcccctgcgctgacgcagctgcgccaccacgccgcccctctgcctctggccgacgattccttcgcactcgcgacgcggctgcccctggcctccctattcacggctgctctgcacagccaccctccctggctgctgctcttgcttgccccactcctgctacttcgccacctgggctcacacccccttcttctgctcccagcccttgccctcccttggcccacttactgcgcgcaccccactccccctgccactgcgctaccttcacccagcaccctctccgcctcccgcgagataattccacgccatccgctcccaggacccccccacaacgccaattccttatccatttcccacccaagcacgggacgccttaacaccccgctgcatcctggcctccttttaggcccacggaggaacttattccacccacttgcgcgcacctctctacccacccgtttgcccaaacacacacccccctacgcgcgcgctctgccgtaacggtcccactaggttcaaccttgggccagccgaccaccccctttcaacttggcgacacctctggtccaccgctcgccgaaaccatcccgccctataactcccacagccaccacccaaagtcacttggataacccccccccaacggaaaacacccacgcacgcgacccccctggctagccctctacccactttggccttcccacccctgtggccccctctacttgcctccccctcctgccccggctcgcttccttgcgcgccctctcgccctcccgcgcggctcgtctccccggccgtccacgctttccgcccccgccctcgcccccccgccttggccccgtctgcggttccacacctccgacacccttcctcacccttcacacaccccttcctcgccccccctcctcccctcctactctcacacctgttcccacacaactctcttcaattccccctatctactccgcaccttccacaccgaacaccaccctaccttacaaaacccctttaacaccccatcttcccttttccacaacaccatcactttcccccaccccatatcacccgcattctctcagctaatgtctccccccctacccaccacccctcatcacacacaactaccttcacacccacacacaca

SEQ ID NO: 649492 - DNA, 514 bp, Homo sapiens
  misc_feature (10)..(10): n is a, c, g, or t
  misc_feature (35)..(35): n is a, c, g, or t
  misc_feature (51)..(51): n is a, c, g, or t
  misc_feature (57)..(57): n is a, c, g, or t
  misc_feature (59)..(59): n is a, c, g, or t
  misc_feature (61)..(61): n is a, c, g, or t
  misc_feature (77)..(77): n is a, c, g, or t
  misc_feature (87)..(87): n is a, c, g, or t
  misc_feature (94)..(94): n is a, c, g, or t
  misc_feature (104)..(104): n is a, c, g, or t
  misc_feature (133)..(133): n is a, c, g, or t
  misc_feature (150)..(150): n is a, c, g, or t
  misc_feature (152)..(152): n is a, c, g, or t
  misc_feature (157)..(157): n is a, c, g, or t
  misc_feature (184)..(184): n is a, c, g, or t
  misc_feature (208)..(208): n is a, c, g, or t
  misc_feature (222)..(222): n is a, c, g, or t
  misc_feature (227)..(227): n is a, c, g, or t
  misc_feature (231)..(231): n is a, c, g, or t
  misc_feature (240)..(240): n is a, c, g, or t
  misc_feature (257)..(257): n is a, c, g, or t
  misc_feature (289)..(289): n is a, c, g, or t
  misc_feature (295)..(295): n is a, c, g, or t
  misc_feature (297)..(297): n is a, c, g, or t
  misc_feature (308)..(308): n is a, c, g, or t
  misc_feature (316)..(316): n is a, c, g, or t
  misc_feature (320)..(320): n is a, c, g, or t
  misc_feature (329)..(329): n is a, c, g, or t
  misc_feature (333)..(333): n is a, c, g, or t
  misc_feature (338)..(338): n is a, c, g, or t
  misc_feature (343)..(343): n is a, c, g, or t
  misc_feature (377)..(377): n is a, c, g, or t
  misc_feature (409)..(409): n is a, c, g, or t
  misc_feature (437)..(437): n is a, c, g, or t
  misc_feature (444)..(444): n is a, c, g, or t
  misc_feature (453)..(453): n is a, c, g, or t
  misc_feature (491)..(491): n is a, c, g, or t
taaaaaaaanaaaaaccttcaaaaaaaaatttaantaaaaaaaattttgantgaaantnantaaagggggggcaccnagtccttacnctgaaancaaaaaaccngccaactgggggctttcaccagccccgtngggtatcttaccgcaanancaaanaggaggctcagccttccccagtccccngagttcacattgattcaattctanagcccactagaccngcccnaganagggccaancaatgtcccgggggggnagagagggggggggggccacacttagccaaanggaaananagttttctcanaagagggnaggncttttttgngggngaggncgccnagctttcagtcctaaaggaagtgatttccctggnaaagggaaggggattttgccaaggctggggtntaaaggaagaaggaactgtctttcaggngtctccngcagacccnctacagacccgtgttcctgaagggagagtcctgaaggnagaatacccctgtgggagtggca

SEQ ID NO: 649493 - DNA, 242 bp, Homo sapiens
tgggttggacgcgacggcgtgcggcgagcatgaacgcccctccagccttcgagtctgtcttggctcttcgagggcgagaagaagatcaccattatctaggacaccaagggtacccaatgcctgtttattcaccatcatctaagaagaccacacactgggaaatcatcatttaatcacaactcctaaaagacccgcaatgtgctatttgctggctacaaagtcccccaccccgtcgggtggag

SEQ ID NO: 649494 - DNA, 321 bp, Homo sapiens
gcaatccccaatgcaaggagttcaaaccacgttccttctctctaggcgaaagccttctactaccccagcttcatcctcggcctcaagcacaacctagacccatctatggtgggtcatcaacaggcaactccagtttatactcagcctgtttgtttggcaccaaatatgatgtgtccagtcccagtgagcccaggcgtgcaacctttatacccaaatacctatgatcgcccttgccagtgaatcaatgccataggacatatagagcaggtaaagttaaatacctagaattggaattgctgaggtatgtacgcaaatatgccc

SEQ ID NO: 649495 - DNA, 744 bp, Homo sapiens
  misc_feature (244)..(244): n is a, c, g, or t
  misc_feature (407)..(407): n is a, c, g, or t
tttgtatataaagcctgttagagtggacataaatgagtatggccccttccccttgccctataagaactgttaacattctttcagtaccagtatgccattaatatgtatgtgaaaaagcccatcccagtttggttgataaagcacactagacagtctcccaagtagagcatcagcctcttggtaagatatgacgtataccagagctgagtgatagagtccacattaggcgctcgtacgccggcanagcctagtgctcatgcactaggtatgtcagatggtctgctatagtagagttagagctgcttttaagtccaatccgtaactcctgtttgagcttccaagtgtatatacacacggtgttgaaccgagatagcttgtaagagtgtaagttcattcgatattcttanactacttcacagatacaaaaaaggcacatcgtacacctggtttccttaccagtagcggctttcagctacacactagcttgtgcagagtttaaagatatgcagtagcattagtggtgcaatatccattcatacatggtatcaggagcagtgtctagtaaaaagaataagagcttgccagcaaaggtttactatagcaaggttctatgcagtagaattcatacaaagactgtaggcagcatgggggttgttagcgagtgagctgctgggaagatctgcattctgagttatcgtgaccattatcatgcggttttctccatgaagacgtatggtcttctcc

SEQ ID NO: 649496 - DNA, 165 bp, Homo sapiens
  misc_feature (147)..(147): n is a, c, g, or t
atccgggtattcgtggttcacccccacaagatgaccctctctctgaaaatgaacaaaaaaacgacgatgatatcctgtttgggaccaagattcctgaagttgaccaagaacactttttgaactcattctggctgcaaactacttaanaactcaaagtgctgagct

SEQ ID NO: 649497 - DNA, 251 bp, Homo sapiens
aaactaactgacattgattgtttactaagtgccagacactatggttagggttttatatcatttaactcatttagtctttactacaaccctctgaagataagacttttcaatcttcattttccatatgaagaaactgaaaagcttagattgttgaaagaacctgtccaagacttcataattaatagggtgagacaggaatttgaatctctatgtcggacgacagagccgcagttgttaggagctagttcttt

SEQ ID NO: 649498 - DNA, 523 bp, Homo sapiens
atcagacggcccaccgtttccgggtacagatcgcagccagtacgggacggtacattatacagaatttgcggcaggtcagtatgctcagcgatggcttcgaagtgctgatacaaaccttcttgcgacggacgattgtagtaaggggttaccgtcaggcagccgacgataccactgtcattgaagcgctgcgtcaggctaatggcttccgcagtagcgttagcgccggtcccggcaattaccggaatgcgcccatcagccagatccagcgtcatcatcaccacatcagcatgttcgtcatgatttaaggtagcggactcgccagtggtgccaacagaaacgatcgccgaagtaccgctggcgacatgataatcaatcagttttttcaagctagcccgacagacattacctttttcatccatcggagtaacaatcgcgacaatacttcccgtgaacatgggccatcctctgtgcaaacaagtgtctcaatggtacgtttggtatggcattaagagcaagcagacag

SEQ ID NO: 649499 - DNA, 491 bp, Homo sapiens
  misc_feature (22)..(22): n is a, c, g, or t
  misc_feature (145)..(145): n is a, c, g, or t
ctttccggcccctttgtggaancctttttccaagccaagggggcggccgccgccccccgggtggttcccctggccccctccgggggggggttttcccaaaacccgggttcctttccttgcctggttcaagggtttttttcccacnaccttccgtgtgggtgggggggcaatgggccccccggaaaaaatttcaagacccccccttccgtgttggggtccggggggtcctttttttttttttgccagccccccgtgggcaaaagcgggggggccccggggggggttttttttttttcctttttgggtgggggtttgccccccccctcccccccaaagggccttttccttttcccggggtaattggttgggggggcggccggccccccctccccgggttttttgggttggccgggggtttttggggggggccccgttttttttttttcccgggcccccgcctgggatttaagccccccccccttccctgggga

SEQ ID NO: 649500 - DNA, 223 bp, Homo sapiens
cggcgctctgacgatccctcataggtcgcaggcagctattaaatgtaaaaacggaccgtggtaaaagtgcttcataacaatatataattgtgtcttatgcctgtgagaaagaaaggctttttttttttttaaacaaaaggtgttatttccaggctacatgcaacaggggttggtataccccagtatttcatccctttccggatccggcccggcaaccctatga

SEQ ID NO: 649501 - DNA, 911 bp, Homo sapiens
gagcggatctggccggtcggcgcgggcgtgtcaccctggacactgtgatgcgcatgggcaaggccagcgcccggggcttctgaaccgagcggggtgttcattttttatgcatatatatcccatgatcttaggctcccaagtctttgactgccttcccatggcgatctataacgttgaacagatttttattcttgtataaactcacctacatgactgatggaggtttaacagtaaacccggtgcaagaccctttgggaacacaaaaaaaaaacagaaaacgaaacagacagaaacaacaacagaaccactcgctcgcacaagccggggggaagaaaagtacccgagcgacataaaaggggcggccaagaccatccctcacaccaaagacgagggcgagcccagccaggtaaacacaacgagatatagttaggcggacacccccaatacaagcagcaggccggcgaggataaacaacaccaccaagcagcaccgatacgagagaacgcatacaaacaacacgagagggcgggagcaacacagcaggagcggagggacgggaacatcgccgccgggagggaatgcagcgaaacaaaagcagagcgatgcaacacacacgaaggccgcgccgaccacagacacacaaatggatactgctcgcacccggacgacaaacaaaaactgcatcgagcgagccgagcacaaaagaaggcgggggacggagccgagcggatcaaacgagacgagaccgacaccggacgagcagcgagcgcaacaagaaacgacgaagaccaaccaggccagaacggcagccatacagactgcagatgacaggaccgcacgacgcgaggcaagcacagcagcagcacagagacacgagagaccagactgacggactagcgaaagtagcaaca

SEQ ID NO: 649502 - DNA, 141 bp, Homo sapiens
ggggggggggggggggtttttgcccttattatttggggtaaggttggctgggatcatgggttagaaagaattccctggggcccttaccccagaggcagactttttttggaagattttggtaataaaaccctggaacttcca

SEQ ID NO: 649503 - DNA, 3062 bp, Homo sapiens
  misc_feature (2977)..(2977): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctttgtttggggagtggtcanggcacaaatggcctgggggtttagctgtttctagcgtgagaggggcagctcctcagaccaagggcgcccccctctgagtcgaatt

SEQ ID NO: 649504 - DNA, 3158 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagaccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 649505 - DNA, 3070 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 649506 - DNA, 113 bp, Homo sapiens
cggcacgaggcgcagctcaagtaaaggaggaaaaaaaaaaggggaaaaatagaaagcggcggcggctgcagcagcgatccgccgccggactggcccaagccgggcggcggccg

SEQ ID NO: 649507 - DNA, 3447 bp, Homo sapiens
  misc_feature (2921)..(2921): n is a, c, g, or t
  misc_feature (3193)..(3193): n is a, c, g, or t
  misc_feature (3447)..(3447): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 649508 - DNA, 117 bp, Homo sapiens
tacctgtgtttggtgtgggatgactatcttatgagtgtgactgttgttgtgtggggtgactattttatgagtgtggtgaggtgactggtgtgtctgtgtgtgatcgtggggttgtaa

SEQ ID NO: 649509 - DNA, 3360 bp, Homo sapiens
  misc_feature (2834)..(2834): n is a, c, g, or t
  misc_feature (3106)..(3106): n is a, c, g, or t
  misc_feature (3360)..(3360): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 649510 - DNA, 170 bp, Homo sapiens
gggccagaactccccaatgttttattgaaaagtcaggccttcagctcagctgtctccattgggctcagcttgggtggggggccctgcccatagtagactgagcaagatcttcctgcaggcagctgggctggactccctcactggctacccttcccttctgtcgtcttctc

SEQ ID NO: 649511 - DNA, 441 bp, Homo sapiens
cagaccccgacgcagctaagtcatgctgcttggagggaacagacgaggggccccctgaagtcttcctggcaggaatctgtctaccactgtgggtcagcagcacacagcatattggtggtgactacagagccgtagtagtggggctgctgacactcccggtggaaaatcagcttcacaacagtcatcttcagctgctcctgatagagataggcggtagaatcctcttttccaacgccagtgatctcacaggttgtgccaaactgaggatcgtaatacatctagggcaggcagatgggctgtatactccgtgatggctgcgcactcctgccctcctaggaacggatcttccgcaaggcaacgtcgtggtggtcagcaagcttgtcagcgcagtagtccttgtgtaggatgaggtcaccacctcaaacttcttctccccatgct

SEQ ID NO: 649512 - DNA, 779 bp, Homo sapiens
ccgcagtgtcgtatgcagccatggcggcccagccggaatggcatggtcttgaagccccacttccacaaggtacttgcagctggcgcgtggtcgatcatggttcaaccagccggctcctgtaatgatcctgcaggaacgtataggcccggtcaagccaaggcgcgccggtgatcgctcccgcgccccgctgtctgggtcccatccggcccattcgtgcgtctgtccccacggttcgtgtaccacgacgaagggtgcgcgccgtgtcctgctggcttcgagcctggaaggagctcgagggtggccgagcattccactagaaaagagggtgtggtcctccggaaccactcggcactttctagtgggatccagaggagatggcggaacaaagtcgcaccggcatgtcctcgtggcattgccgaagcgtagtcagtcaggcttgacaggtagttaccgacttcacaatagcatcaatctctcgttccccgaggagatgccccttcggactcgcccaggaagggagacagtctctgtatgaagaactgagaattgtgacacccagctgagcggaccggtcatgcccggtccggaacggtctataagacggggaaagctcggagtcatcactgaggaagagaagaatttcaaagctcgttcgctaagtctccgaatggcccggtgcagacgcacggctcttcggcatacgggcaagaagagcaaggaagccgagaaaggttttgaaggaaataagccccgggcttgatcacagaaaaaaaaagttg

SEQ ID NO: 649513 - DNA, 1190 bp, Homo sapiens
gcagaaaagccttattttgtggagtacctagttcccttttgggtttgtctcttgactgctacgggcattgcccagggaaccatgacagtgaagatgactggccaagcttgtggactggccagcaagcttgggctgcctgagacgctttgaaatggctgccttctgagttggtcttgagggtgaagactgaccacccttctcacctgcacagtcacagtccctctcctgctggcctgactgcagctgtcctcccagctggccacctgaccagagaccaggagagaggccacagctccagaccctccagagtcccacggagcggaggaagaaggcttaccagagagaccctctgatgcatgagccaggccccagcccttctccctgcatccaggtgtgtttccaccgcaaaatgcctccacacaatgagcgactttggccctgcgtgggtcagcatgtggtctgaggtaaccctcaaatgcctccaccacacatctgtccacctgcacgggttcaaggtgagcacttgcccccttctctcctccagaccagtcgcctgaaattctgagcaacattccttcaagactatcatgtaacccttggtgatgctgagtccagacaggaaatgcagacttgggacccacctgtatcagcagaaagaggccttgtgccccgtttgtccgagtcccagaacggagcaaatgagaaaaccggcgagctgtcccccgaggagctgtagggagattggtttttagtataaattacaataaaattttgtgtatgtgtacagctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaaaataaagctcttttctttatcaaaa

SEQ ID NO: 649514 - DNA, 3030 bp, Homo sapiens
  misc_feature (2504)..(2504): n is a, c, g, or t
  misc_feature (2776)..(2776): n is a, c, g, or t
  misc_feature (3030)..(3030): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 649515 - DNA, 282 bp, Homo sapiens
gggggggggttttttatccaccgccctttttttttccgcccccgtttcccggggggccccccccccccttttttttcccccctttaaaaccccgggggggttcccccccccggttttttattgtggcccgggggggggttacttttttcccccgggaaccctttttcccctttggccttttttggggccccttttaacccgtttttttcccaaaacccggggggggccgggccgggttttcccgggttttttttcccccccgccccccggggggggggggga

SEQ ID NO: 649516 - DNA, 165 bp, Homo sapiens
  misc_feature (2)..(2): n is a, c, g, or t
  misc_feature (126)..(126): n is a, c, g, or t
  misc_feature (131)..(131): n is a, c, g, or t
tngagatcaccagtgtgtggctttcagagcctcctttctggctttggaagcatgtgattccatcttgcccgctcaggctgaccactttattttctttttgttcccctttgcttcattcaagtcagntcttnttccatcctacccacaatgaagggcccttttttt

SEQ ID NO: 649517 - DNA, 2175 bp, Homo sapiens
  misc_feature (1649)..(1649): n is a, c, g, or t
  misc_feature (1921)..(1921): n is a, c, g, or t
  misc_feature (2175)..(2175): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 649518 - DNA, 1366 bp, Homo sapiens
  misc_feature (10)..(10): n is a, c, g, or t
  misc_feature (75)..(75): n is a, c, g, or t
  misc_feature (84)..(84): n is a, c, g, or t
  misc_feature (840)..(840): n is a, c, g, or t
  misc_feature (1112)..(1112): n is a, c, g, or t
  misc_feature (1366)..(1366): n is a, c, g, or t
atatataatnacatataccatatacattccatctttttttctttttaatatattcatatttaaactcttttcttnaattttacncttcatctctattcattttccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 649519 - DNA, 221 bp, Homo sapiens
gggtgattgtatgtttgttcgtgtgtttgttgtggcaagagtcctcactccgtcactcaggccagagtgcagtggtacgatcttggctcactgcaacctccgcctcctaggttccagcgattctcatgtctcagcctcctgagtagctggaattacaggcgcacaccaccatgccctgctaatttttgtatttttagtagaaatgggttttcaccatgttg

SEQ ID NO: 649520 - DNA, 1089 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggttgcacctgtctaactatgacagggatcatagcaggttgcttaatgatacagcaggatcctggcttccagaatccctggacctggggcatccccaactggtccaaccgtccgggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 649521 - DNA, 897 bp, Homo sapiens
agataggcgacacgccggggttcgtttgaggcgggaatggctgctgtactgcagcgcgtcgaggcgggattgtccaatctgagtctgtgccgtgttgtgtgaggctttggttaaccccgtgtgggtcccatttgaccccttccagagggcaccaaaacgacacatacccttaaggtgtggggagaacccgggccccccaaggggaggaacattcccttctatttggaccaaatcttggggacatgaaaccccagggcaaaattttccccaggaatattaactatttccaagggtctgtgttttaacaacacggccatggcggcccttccttaacaactttgggaagtttttgtgaaccacgcactcaaggggacaaatttcccccaagggtggaacaaatcttttggggtcaagggtttggaccttcccaacctgttgggtgacagcccccggggaacaggagctcaccaattttccttttgggggaacacggggcccattttacggcgggaacgcgacttaactctcgtcgcgttaccacagagcaggcacttttttcaaatattacaaaagtgtcgcaacgcggatcctgttaacgcccctttaaagttttggcgcctattttttcaacgagcacacagcagagtgtttccccaccaaatcggggggacaagatcttccccctttccagaaggaacggacacggtccacagcgaggaaagacaagttttacaacttgtacggggccgggaaacaacttgtgtggaggcaacgcgagaactggcacaactgcgaaactgtcatagtgttgagttatcaaaaaatctctgtttggtcaacaagagagcattgtgggcggaaggaatttgtggtggaacgttagtacacgagaacctg

SEQ ID NO: 649522 - DNA, 199 bp, Homo sapiens
cctcaaagatagcccctccttttcactggctcttctgctacacatcacagtcgcgtccagcctccagtgagtgacttcaagagcgtctggtatttctttctgaagggcccggcatgtgtctgcgtccctgtaagcattctgtgaggaggtggagagacagcccaccctagtgtccactgtgagcaccctcctcttacga

SEQ ID NO: 649523 - DNA, 273 bp, Homo sapiens
  misc_feature (14)..(14): n is a, c, g, or t
  misc_feature (75)..(75): n is a, c, g, or t
  misc_feature (100)..(101): n is a, c, g, or t
  misc_feature (103)..(105): n is a, c, g, or t
  misc_feature (123)..(123): n is a, c, g, or t
  misc_feature (138)..(138): n is a, c, g, or t
  misc_feature (149)..(149): n is a, c, g, or t
  misc_feature (157)..(157): n is a, c, g, or t
  misc_feature (163)..(163): n is a, c, g, or t
  misc_feature (184)..(184): n is a, c, g, or t
  misc_feature (186)..(186): n is a, c, g, or t
  misc_feature (203)..(203): n is a, c, g, or t
  misc_feature (218)..(218): n is a, c, g, or t
  misc_feature (239)..(239): n is a, c, g, or t
  misc_feature (247)..(247): n is a, c, g, or t
atgtgaggcttaanaggagtcacaggcttcagagtacaagtcccctctgcctcccagctggacagtgcctagaanccaaggagttgagaatctcctgatnnannncctatccttacttcaccnccaggcctcttggcnccaggcaagancttagagnatgtcntggagaggtgggggtaagaancntcagcaaaactgtcacnctaagtagagccagnagttacgggtctgataaaaanagtactgnactaaagtaaagcccaagctgtgagc

SEQ ID NO: 649524 - DNA, 660 bp, Homo sapiens
ggacgattggcaggcagcaccctccacctttgccacctatttcttgttgtaaaacagatgtttgtttctaaaatataatgaattaatgattatcaaagtacaggcatacctcattttattgcagtttgttttattgtgtcttgcggatattgcattttttacaaactgaaggtttgtggcaggcctgtgttgagcaagactatcagtgccattttttttcaacagcatgtgctcatttcatttttctgtgtcttacacagaaacttaaaatatttcaaacttttcattatatgtgttttggtgattagtgacttttatgtttctattgtaattgttttggggtgccacagactgcatccatctaagacagtgagcttagttgatgtgtgtgtgtgtgttctgattactccactaactgatggttccccatctctctccctctcctcagacctcactattctctcagacacaacagtattgaaattagaccaattgataaccttacaaacacctttaagtgttttaagtgaaaaagtcacatgcctctcactttaaatcaaaagctagaaaatgattaagcttagtgaggaaggctaatgtcaacagctgagataggccaaaagctagactgcttctgccaaacagtcaagttgtgaatgc

SEQ ID NO: 649525 - DNA, 240 bp, Homo sapiens
  misc_feature (234)..(234): n is a, c, g, or t
gaaattgaagaccagcctggccaacatagtgggaccccatctctacaaaaattaaaaaagaaaaaaattagttaagcgtggtggcatgtacctgtagttccagctacttggaaggctgaagtgtgaggatcacttgaacctgggagttcccaactcccagtaagctggaatcacaccactgcactcgagcctggacaacagagtgagaccctgtctcaaaaaagaacttgaatnggatcg

SEQ ID NO: 649526 - DNA, 467 bp, Homo sapiens
  misc_feature (467)..(467): n is a, c, g, or t
gtggccggggaaaggccacaatttctggcacgtaaatttaggcgggggcaaaacaagggcctttccttggggtttttccctttgggtgtggaggaacgggccggcacccgggggaggggaggccccggggtttaacctttaatttttccacagcttttgtacacccagccgagaggaaacaaggggggcccccaaacgaaaggtgccccccaaaggggggcgccatttttactatatatcacaccccagtttctttctctacaatataacactcacacataggagacgcagcggacgtcacaacagcaatatccgtgggggggcggcggggccctttttcccccaagggaacccaaaacggacaacgggggaaaaaaccctttttccatttccggaagcgggttacctggacggggcgacggcacgcgttgcgccttgagagttaactctacagtgtgccgcatttn

SEQ ID NO: 649527 - DNA, 317 bp, Homo sapiens
  misc_feature (23)..(24): n is a, c, g, or t
  misc_feature (82)..(82): n is a, c, g, or t
  misc_feature (130)..(130): n is a, c, g, or t
cacaggatctgttcacgtgtganntgctgcgctacacatcagtgttaactccctacagattacactctatcccgctgctccngaggagcggctttgctaaatcgggtatatagtatatgcctttttcctngtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgattttttttt

SEQ ID NO: 649528 - DNA, 411 bp, Homo sapiens
cctccatgccgggctaatttttgttaaatacaattctttaaccttaaatcagctcaacaaatatataatcagcaatttagctgtataagattaaagatccattactttatcttaaataaaatatgttttaggccaggtgtggtgactcacacctgtaatcctagcactttgggaggtcaaggtgggcggattgcttgagcccaggagtttgagaccagcctgagcaacatggcgaaaccccacctctacaaaaaatataaaaattagccaggtgtagtggtgtgcacctatagtcccagctactcaggaggctgaggtgggaggatcgctggggcccgggagttcgaggctgcagtgagccatgatcatggcactgtaatccagcctgggtgacagagggagaccatgtct

SEQ ID NO: 649529 - DNA, 547 bp, Homo sapiens
cttgaccgaaagctatacagaaaacagctatagcaggaaaatcataaccagtaaacattattagacggtactcagtttcatgcgaataagaggttggaacgagaggaatatatggctagaaacaggtgagagagtcacactctgtcacccaggctggattgcagcggtgcagatctcggctcacggcaaacctccgcctcccggattcaagcaattctcgtgacctcggcatcccaacgtagctaggattacacggtgtgcgccaccacagcccacgctcaatttttgatattattttgtacgagccagggttttcaccacttttgcccacggctggtctcaacatggtaggcctcaagtgatccgactgccttggccttcacaaatcgctgggattacaggcaagagccaccacgcccagaccaccccttcccttgtttggagacagtttcatccctgttgcctaggctgcagtgtggtggcacaatcacagctcactgcagcctctacttcccaggctcaggtgatcctcccatctcagcctcac

SEQ ID NO: 649530 - DNA, 782 bp, Homo sapiens
  misc_feature (12)..(12): n is a, c, g, or t
  misc_feature (64)..(64): n is a, c, g, or t
  misc_feature (97)..(97): n is a, c, g, or t
  misc_feature (123)..(123): n is a, c, g, or t
  misc_feature (161)..(162): n is a, c, g, or t
  misc_feature (176)..(176): n is a, c, g, or t
  misc_feature (221)..(221): n is a, c, g, or t
  misc_feature (243)..(243): n is a, c, g, or t
  misc_feature (261)..(261): n is a, c, g, or t
  misc_feature (273)..(273): n is a, c, g, or t
  misc_feature (282)..(282): n is a, c, g, or t
  misc_feature (294)..(294): n is a, c, g, or t
  misc_feature (298)..(298): n is a, c, g, or t
  misc_feature (332)..(332): n is a, c, g, or t
  misc_feature (366)..(366): n is a, c, g, or t
  misc_feature (438)..(438): n is a, c, g, or t
  misc_feature (492)..(492): n is a, c, g, or t
  misc_feature (534)..(534): n is a, c, g, or t
  misc_feature (572)..(572): n is a, c, g, or t
  misc_feature (712)..(712): n is a, c, g, or t
  misc_feature (744)..(744): n is a, c, g, or t
ctggggttgaanaagtggggtgggaatccctggggcatcagtccacaggaggtgggggccagcnatggcttcaggggtgatatttccaatatatatnagccctgggcactctcgccctgctgntcacagcatggtcctcacaccagaagcctccgccttanntgggagcttgttanaaatgcaggatctcccagatctattgagttagaatctgtattaanaagatccccagtgatttttatnaaaaataaagtttgtaangaaaagctgaanaattctgantgcaggaatgangaanccctgggtaggtgtggttaaaaggaatggaaaangaggatgtgaagaggggatgatgaaagacatggnaaaagggagaagaccctaaacagctgtctttgttagtccccgcccacctggccgggatgaaaaaaacaaggncacctgcagtctgccctgcccttcctcccctcagtggctttgaaggaaggtgtncttgaagctaagctctgctggctgcaggtaaaaccacaggcnggggagttctctgagacctaggagctggggtgtacggngaagcggggccctggggagcctcggagattcctggtgggaaggcctgggcagaacagaaggcttgtcaagtcagagggccacctcttcctcctcaattctgccagagaaagctcctgtgctgggctctgaaccccttgcngggaggggtgcaggttatccctcttggagctngagggctgggtgcttggtatttaaacctaagagcttag

SEQ ID NO: 649531 - DNA, 166 bp, Homo sapiens
atataactgaactcctcacacccaattggaccaatctatcaccctatagaggagctaatgttagtataggttacatgaaaacattctcctccgcataggcctgcgtcagattaaacactgactgacacttacagcccaatatctacattcaaccacaggtcattat

SEQ ID NO: 649532 - DNA, 122 bp, Homo sapiens
agaacagacggatgaggaagtgccatctcctgggattgttgatagcccaatcccaggagaagggaaaacgatacgaaccagacggatgaggaagtgtccatctcctgggatggggctatcaa

SEQ ID NO: 649533 - DNA, 680 bp, Homo sapiens
  misc_feature (410)..(410): n is a, c, g, or t
tggtcccaaaaggggttttgggttggacccggaactgggaacaggacacacagcaggatgcggaccagggtcaaatgaggccaaaaggggggggggaacgggtctccgaggggccccaaagtgaggcgtgaggggcgtgggccataggctccgcgaggtggggctcagctcgtgggacccttctcgggggcgtgtggtgggaaaggggcgtggggcgccaaaaggctccaggaggaggctgcacgacagaaagtggcgtgaaacccaggggttcagggaaggcccaggctccgggaatcgggggtccaccggatactacgggagagactcccctgggcccccggggaacaccactagcgggtggaggggcgaccacggctctctgagagggaactcagtggcgttccccncaaaggggcgggcggaaaggggtctggaggggacccccccgtagtggcccctcccataaaaattcaaccccgaaagagtctggggccccgggacccccaaacaggggggggaatcccccagaagctcggggggcggccaaccacgaggaatgcctacgggcgcggccaaaaaacccgagggcagtatgaaggcccgaaacccactcaaggaaaccgcggggtcctcagaagaaacaccccttgggggaaacagacggacaaggggccgcg

SEQ ID NO: 649534 - DNA, 1239 bp, Homo sapiens
ggcagaggtttctggggagccaagagtggtaatggcgtctgtatgatcttcggagcctgttgcatcggacctcgcgccaagtcataacacagatgacaatcagcagccaggccaagcttggaacctgccagaggtggacggggacacggagacggtgattggagccaactttcaaagcagtattcaagcagagacctaccctctcatacaaagataaagatacagaccagacctactacaggatgcccctgaagaggttcgaaaccggtgaccttcaggacgcgacgtgggacacgaacacgacgacgaggaggcgtgctgccaagaagagacccacatacggggatcgtcccaacccggagaaccattaacaacctcactctttcagtggtcaaaaacaggccacggttaagaccagatttcctgtgccggccaacgcttgattgcaagattgacccctcctaaacagatgatggcaccgactgccacgattattggagagaaaggaaacagttgcactgcactgactgcattccctggcacgggctcttcctgtgccacaaacctggggacaccaacttcaaaccacaaggacacagagctggaacgacgccagtgcccacggacacggacccacggaaccaaaaacacgcctggaccgcaaagaagcaggggcatcccgcgaagtggggacacaacaattagcatggaagccgggaacacccgcttccgacccgtcaaatactgcacactggggcgcccagatgccaaggccctccaaggcgcgaagactgtacacacaggctacaaacagacaggggtgtggcacatcgacaggcaacgataaggcctcgtcaagcaaaaggtgggccacaacacccggtgggtagcactggccccagcgacagcgacgcgcaccacaccaacgagtgggggctacagataccgacaccgggcgcacctgggacatactcccacagaacagcggtaaaggggggagcaaccaatagtagcacacacagcgacaacgcaacataaggcccagccgacacaaaaagacgacgggtacaaacgagaagagggcaacaaacaacaccatacaaacatagcagacacagataacagaagccacggctaccacaggtagctcgggccccacacaggaagaaacacaaacagttaatgaacggtagccaccaagaccaaagcatgacgaaaacaaccccaggagaaacaacg

SEQ ID NO: 649535 - DNA, 376 bp, Homo sapiens
  misc_feature (256)..(256): n is a, c, g, or t
  misc_feature (269)..(269): n is a, c, g, or t
  misc_feature (345)..(345): n is a, c, g, or t
  misc_feature (365)..(365): n is a, c, g, or t
ggatccggttgcagtgagccgagatcatgccattgcactccagcctgggcgacacaatgagactccatctcaaaaaaaataaaattaaattaaattaaaagtaagagctaaaactataaaactcttagaggaaaacagagagataaatctttgtaaccttggatttggcaagggattcttagatatgaaaccaaaaggataagcaactaaatgtaatcaattggacttcatcaaaacaaaaacttttgtagttcanaggacattagcangaaagtgaaaagacaactcacagaatgggagattaataattggggaatcacatatcttgataaggaggacttggtntctagaattttgtaattgancacatacaact

SEQ ID NO: 649536 - DNA, 1237 bp, Homo sapiens
  misc_feature (1237)..(1237): n is a, c, g, or t
gcctcttttccgtggcgcctcgaaggcgttcatgctgcttcaagatgaagctgaagatactccttgccatgcgcgactgcgtctgtcctagacaagctcattgaagtggcacgtatggaacgcggacttcgttacttgctatgagacagctgtatgggccacagtaagtagctgctgacggtctgggtgatgaatggcaaggggtaatgtgggtccgaatcagtgctggagaacgagctagactaatggttccaccgcattgagagcaggggatgtcttatgacaccagtgggtcgtgtccgtcgtgcatacgtgatgtaagggggcattcgcatgttactaggatcgcaagggtaggaacgtagggaagaacagaaagtgaaaagtgcaagtttcggtaggtctagcactatggtgggagtggcagagatgcgtcgactgcgtgtactcaaacttgtgggtgaatatagtcaatagagaaaagggaggacgagagggattatatttcctagttgacctgacttagaatgaattatcgaggatagcacttccgccacggtcactggggagtcgctcgcgagaaatatgaccgcttaagcgaagacatccccgcaaaacactcttgttcaatattcttcctccataaggatgacatgagttgcacttgatccagaccaggattaattgatatggttgacctgcacacaggcccgcttaaccattggagaggaaaaggggtaggggcacaaccccgtaaagggaacccctaaaaggggcaccccaacattgtgagtatccaatcgccgatcccctatggtgttgactccaccacctgttttgcatccgttggcacagcaagcgaaagaacccgggctgggcagtataatttggctttccttggaaaggacaagatgccatggccggtatatctccagaggtaacatacatatttacgccgcacaaaggacagaggccatgggcggctcacattacttggcccttggagagccctttgatgggagcgcggcagtgaggaactcttgcacaggggcaagggccctacaaggggtgacgcaaacaccgccgacccaagggaatgacacagtgcataggcccggacaatcgagcgtatatgtcacatggaagcggtctcgacgccactacttctcttgcgcagagggcctagaccgtatagcgtgaacctaacatgttttcttgtgaaccaattcccgcagtn

SEQ ID NO: 649537 - DNA, 841 bp, Homo sapiens
  misc_feature (23)..(23): n is a, c, g, or t
  misc_feature (142)..(142): n is a, c, g, or t
  misc_feature (223)..(223): n is a, c, g, or t
  misc_feature (230)..(230): n is a, c, g, or t
  misc_feature (235)..(235): n is a, c, g, or t
  misc_feature (321)..(321): n is a, c, g, or t
  misc_feature (328)..(328): n is a, c, g, or t
  misc_feature (351)..(351): n is a, c, g, or t
  misc_feature (453)..(453): n is a, c, g, or t
  misc_feature (490)..(490): n is a, c, g, or t
  misc_feature (497)..(497): n is a, c, g, or t
  misc_feature (517)..(517): n is a, c, g, or t
  misc_feature (535)..(535): n is a, c, g, or t
  misc_feature (635)..(635): n is a, c, g, or t
  misc_feature (651)..(651): n is a, c, g, or t
  misc_feature (660)..(660): n is a, c, g, or t
  misc_feature (685)..(686): n is a, c, g, or t
  misc_feature (698)..(698): n is a, c, g, or t
  misc_feature (705)..(705): n is a, c, g, or t
  misc_feature (708)..(708): n is a, c, g, or t
  misc_feature (715)..(715): n is a, c, g, or t
  misc_feature (725)..(725): n is a, c, g, or t
  misc_feature (734)..(734): n is a, c, g, or t
  misc_feature (738)..(738): n is a, c, g, or t
  misc_feature (742)..(742): n is a, c, g, or t
  misc_feature (753)..(753): n is a, c, g, or t
  misc_feature (756)..(756): n is a, c, g, or t
  misc_feature (760)..(761): n is a, c, g, or t
  misc_feature (763)..(764): n is a, c, g, or t
  misc_feature (766)..(766): n is a, c, g, or t
  misc_feature (817)..(817): n is a, c, g, or t
agccttgactcaccttgccgaantcctgaagaatggaaaaaagacaaatgaatcttcaatatcggtttttcacctcaggaaattatttattaaaagttttcatcattattatttaggtatcttgattctccatgcttcaagncaaaaaaatcttcagcgttaagtccgtatctctctagagcttcattcagcttcactggaggctctaagttatgctcatttnctaaggnaaaanttccccagtgaattgccatagatttctttgtttggacatcagtgtgaatccttacagcttcttctgggtctacatgctggtatttnataaacnacctcggttcataagctccgatnggaatagactgaccaggtcaaaagatccaaatctttttcctatctcttcaaaagcagggcaataaccagtatctcctgcgaaaaaaaatcgattccaaggcnccaagacagaccagctgccccatagcaccttgttgtnatccatnagagtccttttacaccagtnctgggaaggtgtaaaganaaaagtgaccttatcatgtccggggacacaattctcctcccaccagtccaactcaatcacattctcacagccacatttttgcatccagtcaaggagaccnaaaggaacaaaccatntcaactcantaccaaatcgctcattcaaagcaannaaaaaattgtantacaaanggncatagtngttgtgactnataaggaangcanctanaaaaaaaaatnacntatnntnnanggggaacgacgaactcgctttggacccctgttctgcgatggtgaagcacgngagctaaagatgggatccgtgaga

SEQ ID NO: 649538 - DNA, 278 bp, Homo sapiens
gtagtgttctagaggatcccggaacacaaaagcggtggtctccgccgctggaaaccactccaaacgtttctccttcgcggagaaggctgatttggcctgaagaagccctgtgtgcactggccctgtgcaaccgaccccagagccagctcgggagggccccacctagggcctagctccgaaaccgcacaaaacgcgctgctaggagctgcattctgcaaagggaaactgggctcggggaacaaacctcagccccgatgcggcttggccgcttttgtgtt

SEQ ID NO: 649539 - DNA, 385 bp, Homo sapiens
cacatctgactctcttatctttagcgcttgaggtgtggcgcgcgcctagatgagcgagcccagagactattcagtaccacaggaaacgtccctggcagtcactatgatacctactttgtttgccaaacaatcccaatgtcaacagggcaccaatgcgagtacactgacagggaacaagagacattagcttttctagaaagcccagactctatgaagtagtgtagagattctcgaggaaacagcgacatctcactcactgaaaatgtacagcgcaagcaagccaggacaaggagaagagcgagaagaagaggaagaagagcagatcagtgagagtgagagtgaagatgaagagaacgagatcatttacaaccccaaaaacctgcca

SEQ ID NO: 649540 - DNA, 351 bp, Homo sapiens
  misc_feature (43)..(43): n is a, c, g, or t
attagtggcatttaactcatatatgaccttcctttaggaagcnttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcat

SEQ ID NO: 649541 - DNA, 108 bp, Homo sapiens
gagacatataagaagtatattgctgcatatcgtgccatggtcatcatttaagcacgaaagaagggccctcgcagggcacctgtctcaaagaataagaacgaaccataa

SEQ ID NO: 649542 - DNA, 137 bp, Homo sapiens
tattttttaagaatatgattaggagggatagatgtttagttggccaaccggatctaaacttttaattttggctaaacagaattggtagcatttagagctatatgctttagaattttttcgggggtacggagctcgaa

SEQ ID NO: 649543 - DNA, 428 bp, Homo sapiens
cgtgtgaccagggggctctcgctgcccggccagcacctgcccccggcctgctcccgcgggcagggcgcggactcaccaggaagtcctcctggcagtacaccttctcgcccacgctgtagaaggccttcccgcggagccggcgcccacaggagtcacaggtgaagcagtcggtgtggtacaggctccccatggcctggcacgcctgcctcgctccgtagatgccaagcccacacttgatgcaaatgcctggacagtgtctccttagtgcctcttcctctaccacccatggttcttcttcttgttccaacttgaaaatcacatcaggtttggtgaatgggtagcccactgtgattaagttgttatagttctctagcatcacgttccggtagagattcctctgagtgggatccagctgcttccattcctcc

SEQ ID NO: 649544 - DNA, 1035 bp, Homo sapiens
ggcggcctgccaggcccaggactgaggccgggggccgggaccctccccctcccacaaccaccacgaccacccgtgtgagaccagggcatcgtaggggcgtgatggcgtggggtaagggagccaagggatccatctttgcccaggacaaacgccgaggactgacgatgaccaccagaaagggacgaggacccatctctcggggacatgaggtgggtggagaagaggggacctcttccccctactctgcccccttcctgcacacccttgcgctggaggaggggagggggcaccgcctcccagccactgagggcaggcagggcttgtggggagggacaccaacagggtttcaaggggaccaggagtcagaatgtggggagacgcctctgccaaggcccatcccaggccctatgctgccatcccccagggctccccatcacccgagaggagaggacgccccaagtaagccccggtggccctcgggactacccgagtggccggctgcaaccaggactcatctccagggtaggacagcttgaggaatcttattatataatttatttacccaaatttgaaatagtctgtagggttgggggaaggaggtggatgctagccccaagccttcacagatgtggacaaaaccctgagttgcaaggcagaagggcgcccaagtacactcaacaaatcggactgggacagtcgagcacatcagagcacatgaactgtaccctggtcgctactgaccatctcaaggcttctcaacactgggacggagcgccgggcggtgctattacgaaccgggcagtaaagaagactgcagctaagccaaaaagaggagaaggcacagaccaacacagcacggcggcgcgcaaagatcccaccgggagccaggcagaagcgcccaggtagagaaagcgcaaagagggacaagcaacagggggcgccaaacacccgctacgcgagcaagcaggagtaggaagaactagcaggacaaaaccgagagacgcgtacacaagagcaacagaccgacgacaatac

SEQ ID NO: 649545 - DNA, 377 bp, Homo sapiens
gatgatatcaagattacttttcacaaaataggcacattatatcaacactttgctctgctttgtaaatttgccatccaggattttggggtggtattcatgtgaaattaaagcagattctttagcagtttcctatagctacagtttttttttttcattgcttctaattggatatagttcctatcagtccgtgcaacactgatgctattgtaataaagaatttgtgccctctagcttttaatcatttggtcttgcaccaaaatcgtttgtgtatgtggtagccatctagtagtgtgcatcagtgtcaatatttcaggtggtgctttgttccgtagtccagttttgctttgagtataatcacatttcatttcttgttttaa

SEQ ID NO: 649546 - DNA, 778 bp, Homo sapiens
gtgtactgacttcctgatccagccttctcccacctgtctgggagagcgtaactatgggatggtcctgcagagagagagggacctgaacacgttgcagctcgcatcggccagtaccctggtgaaacagaacagtgtatgatggaggagaacagaagctggatagccctgcgttgggctcagccaaggaggagatttgatacctcagacaccaggtgaacttgcgggatgagctcctccagctctactcagattctgatgaggaggatgaggatgaagaagaggaggaggaagagaaggaggcagaagaggaacatggaagaagaagaagcagaggaagacctgctaagatgtgctcatccctgtgatgcccctaagctgatacgcgggaggcattgtgcacacagtacaaaatggctcacagctggaagcctgtgcaggagaagctgaggctgctggaggaggagaatcattagctgagagacgagtgaatctcaaagtcgaaatcttgaggatgaggaacagatgctctaatactggagtgtgtggagcagatttattggaaggcagtcaacaagatggttgagctgttcggaggtgcttgggtgcatcagtgctggaaaattatgtaaggggaaggaaggaggagggtcgacggatgtaaggggcaggtgaatgaacatgaaacaatgttggcggaaggagaatttgactgttaaggagaaatgatgagagatcgaaagttctaggaggtgattaaacttggataatgaaagattaa

SEQ ID NO: 649547 - DNA, 355 bp, Homo sapiens
ggatcctcgcagtactcaacacagattgacatgaggcccgttgcttgcattcatcctgaagtggcttcggttagacctatatttccagagacaaccgcctgagacgaactgcacttaattctccgactgcataggaactccatctcaggaaacttgaccagctatttcttcaaatgaggaggtcaagaactacaactttccaaaatatacaccacagcgctctaattaaccacgcacccagcatagactctgatggaattgaggtgataacagaagttcttcagtatgaatctaagacaagaccttcagctgaagagtgcatgaaacatgtgtactttcgaagtctgggaccaag

SEQ ID NO: 649548 - DNA, 1270 bp, Homo sapiens
  misc_feature (143)..(143): n is a, c, g, or t
gatagctttctacaatccgttcgtctggcgcgcggagcccaggtaggtgagtgatgcattggtatcactaggctgcttatcctaagtacagtccttggttcatgacttacgttgcttgcatcttacttcaactcaaataaacnacacacgcgccggggcaaggcagaccccgttcctgtgtccttgaactcacaatcactagcgatttgtcatgtgacgtgggcacgtgtcccatttgacattcgtgcatcttaaattcaagagcaagtgcgcaaagtcgctagaggcctgcaggcatcatgcattaattcttatacatgtctcacgggccccccgtgggcccgttggaaaaagagaaagaatagcaaatacaacaaaaacacaaaaaaagaaaaaaaaaacagaaaaaaaaaaaacacagacaagaacacgaaaagaaagcaaaaagaaaaagagagagactaaaaaacaagacacaaaacaaaacagaagaacaaagacaacaaatacatatacaaacgacgacaagacaagaacaaagagaagaacgacgaagtagtgaagaaggagagacgaaaggcgggacggcgcgagacgcgctacggaagtgaaggacgaggagagacagagagagagaagagacagagagcggaaaagaagtgaacgaagaggagcgagaagcgagagagaaaggagaggagagaggagacgagaggaagaagagaaaagaggagagaggaagggaataggatgagaaggagggacagagagggcaccgacagaggacgaagagggaggagagcgggccgggagccggggagagcgaggctgctcgggaacgcgggagaggcggcggaggggaggtgcggggcgggaaggagaagaggggggaggggcgacagaggaggagagggggaggagagagggagcgacaagccaccgagcgaccgaagacatcaaaaacgcctgagagccgccaccggacgcacacaagggctcgcggcagagaaccaactgagaagacacgacggaagacagaccgagagacactcgaggagggctaggcgaggcagagagtagaggaagagacgaccgagacgaccagagagacgcgaagcagcacgacgtggcgaggcaggcgaggagagggaacgagcgccgagccgcgcactagacgagcagaagacagatccagcagcagagagagagtgaagcccgagagcacgaacgaggagataggtagtctcagcagtcagcgaggagcggtagc

SEQ ID NO: 649549 - DNA, 896 bp, Homo sapiens
gtacatgcaatggggtgatgtagggcttaataaccgtgccagtgaagaaaatgtatgctattctctaactgatgttacacaaaaatcaacgcagatctacctcaatgatagctcttgtcatccacttgaccacctctcgtaggaaggataactgtgagcgctagtactcacgacatcatagtgttacttcgatagatgtactgtcaagcatctgtctcctgaggccgtagcccgattgaagtcgttctgtaacttgcgtccgtggctagtatgggtaataggaccagtagtcatatagggatgtagacacccataaaatggatattcgggggcggtggaattgcggtcgtgttgcccaggttggggttcacgtgcttcattttgcggctctattgcagtcgtcgtgtctcccctgtgtgttccaacgttgatatctcctgggctcagtctcggctgggtgcgctggggtttgctgagtcttttggatggtgccatcatgggagaagtctgatatgggcaagtagagacggggggtccaaggtccttggggagaggtcgagtgtattgcaatggctctgcatcctgtgctccatcttgccatggtgcggccccaaaggaagcccggaacttccggggtcgtaccgcacggggggggacccaggaattcatgcttagccggaaccagaggatggacacagcgtggcccccggtgggcccgaggtgataggctcagtgtgacaacaggcttggttccccagtggcgaagtacctcggcaattggcgcgaatatggaaatgaaaaggcctttacacagaggccggacaaggaaggtgcaagctagcaaggacaagagacaccggggcctttatcacgtaaaacagaggagcgagataaaa

SEQ ID NO: 649550 - DNA, 500 bp, Homo sapiens
ctgggcgtatgtactagcatgtgagacaagagatgcatctgatcgctccaagaagatacacattttagacaatatatccatcttcaattctgtcgaaagttgatgtaaatggcaaggcgcagttgtgttgtaccttccgtgacttcatgcgcattcgcttgtggaggtctggatcaagcatcctgagacacgtccttcatcgcataatagtgctcctctatataccgttctggaccgttccatgcggttcaccgtcagaccaagtatctgagatggaccgatgccgaagagtctccacttcttggtgaaatcgatacaaaggatcgcgtaaggccaatcttggctgggaagaaacgggattcgtaattatgtacatgacgtaacagaattagttcttatcatagagatgcaacataccagtacttccgagcatctactttaacagcctcaatttctcaacagcatacccgagactatttaccaatacggccaggttagca

SEQ ID NO: 649551 - DNA, 615 bp, Homo sapiens
  misc_feature (1)..(1): n is a, c, g, or t
  misc_feature (139)..(139): n is a, c, g, or t
  misc_feature (146)..(146): n is a, c, g, or t
  misc_feature (186)..(186): n is a, c, g, or t
  misc_feature (241)..(242): n is a, c, g, or t
  misc_feature (244)..(244): n is a, c, g, or t
  misc_feature (265)..(265): n is a, c, g, or t
  misc_feature (267)..(267): n is a, c, g, or t
  misc_feature (280)..(280): n is a, c, g, or t
  misc_feature (306)..(306): n is a, c, g, or t
  misc_feature (575)..(575): n is a, c, g, or t
nccaaaatcaaaactaaagaagaacacttagaaaaaagggtggaagtgtatttttccttccctggggaaaccagttaggcagaaattctaacgaagcttggttttttccataggactagtttatgcaacagaatttctnttcagcnttttctctatgttagttttatctacctggcaagaaaaaanaaaaacaaccccaaaacaacccccccccacagaaacaacaaaaaaaaagggaatnnanaagttagagaaaacctttaanangtttctgtaaaancctttctgagggggttaagtacaggnactacccatcagcaacttagcggccaggggagttggtgcagaagcgctttgggtgaattcataccagaaccaccgggtgtgaatgggctacctcttccaattaccaaagggagggcttaaaattgaatttcagttttagcagaaacttcagaattacctgagcaataacatagaaaatgtactcgttatatagtagagaggtgtaattaacaccagaagaaataccggtcccaagaggaacgtttacaccatccagactaatgttagcngaaggatcaggggtagttttgcccaaacctttgacactgt

SEQ ID NO: 649552 - DNA, 366 bp, Homo sapiens
cccacctcagcttcccaaagtgctgggattacaggcatgtgcaccacacccggctgcatcagtgcttttaatagaaaggtctgagtaggagcagacctgtcccacagtatgtagtaaaggcctagttggaatgctagcgttgtgcctgggcgtttttttcactactgctaaaagtaagtgctgcggatttaccaggtgtaagccaccggggcccggccttggctgccttgttgtttaccccagccattttcccaagcgccatacggggcaacaatggtgacccaaggggggccaatttcccttgcccccaaattcaacccttgaaattgttcaacggggtaccgaagcttcgaaatttcggtaatt

SEQ ID NO: 649553 - DNA, 194 bp, Homo sapiens
  misc_feature (124)..(124): n is a, c, g, or t
tagagacggggtctcactatgttgccctggctggtttcaaactcctggccccaaactcctcccagcggagcctcctgagcagctgggattacaggtgtgagccaccatgcccagctccaacgtnaagttttgaagagttctttttatctcaggccctgatcccaaggatcgaagtaccactggagagagaagaa

SEQ ID NO: 649554 - DNA, 1016 bp, Homo sapiens
tcattgaataatcataatggctatagcaataaaactaggaatagccccctttcacgttctgagtcccagaggttacccaaggcaaccctctgacatccggactgcttcttctcacatgaggaaaaactatgctccgcctatctcgaatcatatagcagatctctccctcactagacgtaagccttctgctcactctctcaagcttatcgcatcatagcaggcagttgaggtggattaaagtcaaacccagttacgcagaaatcgtagcgatactcctcaatttacgccagcataggatgaatcatagcgagttctagcggtacaaccctaacataaccattcttaattcaatcgtatttattattatcctaactactaccgcatgccgtactactcgaacttacaactccagcgaccagcaagccctactagctatctcgcacctgaaacaagctaacatgattaagatctcttaatttccagtccaccctccttctccctaggatggtctgccccacggtaaccgggtttttgcccgaaatgggccattatcgaagaattcccagaaaatagatagcctcatcatgccccatcatcatagtcaccatcaacctccttaactctagttctacctagcgcctaatctacatccgagctcaaatcacaactaagtccccaagaaaaagaataacaagcaaattcttacgtcctacctgttgcgacccggatgggccccgcgaaaagagttcgtcctgaggaccccagggatggggacgcgggagcgccctccacgtaggcgtatcggccaagacaccgcggcccggaagcgcggttccccacaggaagagaaccctggggcgccacacaaccaccgcgcgggtgggctcctccacccaaattaagagcaaggccccggggacacagccccgtggtcgtagcagaacacccacgcaggggcacccgcaagggccacagcggcgcaaacgcaacggaggccacgcagaccaagtaagacg

SEQ ID NO: 649555 - DNA, 170 bp, Homo sapiens
aaaggattgacatacaccctgtcgtcagtcacgtgcttccacaagctggcctctgcctatgggtgcaggcagctgcaggctactggcaagctctttgccatcctcctcccccaggagcgcctcgtgcccagactgccccttggaccgtgtagtgccgtatgcaggtggcc

SEQ ID NO: 649556 - DNA, 139 bp, Homo sapiens
gatctagaggatcccgtaatattcagtccaaagttgcggtatacgtcttttggctttcatgagaatacgcaagcctcaaataaactagttttgttcactgtggttttgctcaatgttgtttcatgtaatgttagagata

SEQ ID NO: 649557 - DNA, 312 bp, Homo sapiens
taactcactggatggctgctgaggcagaacagcgtgggagacaggctctttcctgctcttatgtgagatcgtcgttctgcatcagacaacatgctgactactcagcagcctggaggctctccggagcccaggtgagcttgtacaacagccccagtgtgcccagccagctaggagtggtgggggcagtggctttcctctcaaaacagggtatctttgaggaggatgatgatgatgactgggatgactgggacgacgggatgcacagtggtggaggagccacgggctggtgggctgggcaccaacgggcacccc

SEQ ID NO: 649558 - DNA, 1745 bp, Homo sapiens
  misc_feature (789)..(789): n is a, c, g, or t
tcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgttgttaagggtgatctgccagattgcgaagctgaccaactcctgcagatgattagggtccaacagatgcatcgaccaaaacttattggagaagaattagcacaactaaaagagcaaagagtccataaaacagacctggaacgaatgttagaagcaaatgatggctcaggaatgttagacgaagatgaggaggatttgcagagggctctggcactaagtcgccaagaaattgacatggaagatgaggaagcagatctccgcaggnctattcagctaagtatgcaaggtagttccagaaacatatctcaagatatgacacagacatcaggtacaaatcttacttcagaagagcttcggaagagacgagaagcctactttgaaaaacagcagcaaaagcagcaaacagcagcagcagcagcagcagcagcagcagcagcagcagcagcagcagcagcagcagcagcgggacctatcaggacagagttcacatccatgtgaaaggccagccaccagttcaggagcacttgggagtgatctaggtaaggcctgctcaccattcatcatgttcgctaccttcacactttatctgacataagagctccatgtgatttttgctttacattattcttcattccctctttaatcatattaagactcttaagtaaatttgtaatctactaaatttccctggattaaggagcaaggttaccaaaaaaaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccagaaattccttagacatcatgaatatttttctttttttggggtgacagggcaaaactctgtctcaaaaaaaaaaaaaaaaaaaaaagggctggacacggtggcttacgcctgttatcccggcactttgggaggccaaggccgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacctgggagcggagattgcagtgagccaagattgtgccattgaactccagcctgggtgacaagaccaaaactccatctc

SEQ ID NO: 649559 - DNA, 1386 bp, Homo sapiens
  misc_feature (789)..(789): n is a, c, g, or t
tcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgttgttaagggtgatctgccagattgcgaagctgaccaactcctgcagatgattagggtccaacagatgcatcgaccaaaacttattggagaagaattagcacaactaaaagagcaaagagtccataaaacagacctggaacgaatgttagaagcaaatgatggctcaggaatgttagacgaagatgaggaggatttgcagagggctctggcactaagtcgccaagaaattgacatggaagatgaggaagcagatctccgcaggnctattcagctaagtatgcaaggtagttccagaaacatatctcaagatatgacacagacatcaggtacaaatcttacttcagaagagcttcggaagagacgagaagcctactttgaaaaacagcagcaaaagcagcaaacagcagcagcagcagcagcagcagcagcagcagcagcagcagcagcagcagcagcagcagcgggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagt

SEQ ID NO: 649560 - DNA, 641 bp, Homo sapiens
tagaggctgtaaatatttcaggtaaagagtactgggctatgcagtgtggagggagaaagtttcgtcggtggtggtgacgtgtattagatgataaggtgtgctagtgtagcgaatttatgtcccatgttttgcggtcttagattaagctgagcaaatattagtagctttccttgatgaagtaattactgataagtcctttctgtaaccaatattcacttcttatttcgtcaaattttcaaaagattcttatagtgatatttcttatgacacagtagtcatctcaaaggtgccagtcacttttcctggaaaatcataggaagtaatactaggcagaaagtgtgcaactgttaaattctttcacatcaccaactttttcacaatcaaagtatttgcttcgtagagtgcttagcaatgtccattatgatttcttttttccattggcaattttgggcttccctcacatcatggaagttagaactggaagggacatgagatcattgggtttattctctgatgtaatcgtttgtgacactgatggccaaaaaaataaatgattgtgccgaagtcgtacgtagctagtataacattggacatccaaagatgggcatcttgactcatagatgatccatgatttctcttct

SEQ ID NO: 649561 - DNA, 1015 bp, Homo sapiens
  misc_feature (18)..(18): n is a, c, g, or t
cctaagatcagcacttcnatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaacagcagcagcagcagcagcagcagcagcagcagcagcagcagcagcagcagcagcagcagcgggacctatcaggacagagttcacatccatgtgaaaggccagccaccagttcaggagcacttgggagtgatctaggtaaggcctgctcaccattcatcatgttcgctaccttcacactttatctgacataagagctccatgtgatttttgctttacattattcttcattccctctttaatcatattaagactcttaagtaaatttgtaatctactaaatttccctggattaaggagcaaggttaccaaaaaaaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccagaaattccttagacatcatgaatatttttctttttttggggtgacagggcaaaactctgtctcaaaaaaaaaaaaaaaaaaaaaagggctggacacggtggcttacgcctgttatcccggcactttgggaggccaaggccgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacctgggagcggagattgcagtgagccaagattgtgccattgaactccagcctgggtgacaagaccaaaactccatctc

SEQ ID NO: 649562 - DNA, 283 bp, Homo sapiens
taagatgggtcagatggaccctggggtaacaggagtggtacgagggctggggccccctcagtttgtgtaaccatgagttcctgatcacacgcataatttcctatctgtatctatggggtcctagactattaatagtaggcatcgcccaatctgcccatacctcatatacacaagaagaatcttgtgcaagacataggtcggacacatgggcacaccccagatatacccatagcttctaggaggtccattagatggtaatcacttacacacagtgctactacag

SEQ ID NO: 649563 - DNA, 1542 bp, Homo sapiens
  misc_feature (789)..(789): n is a, c, g, or t
tcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgttgttaagggtgatctgccagattgcgaagctgaccaactcctgcagatgattagggtccaacagatgcatcgaccaaaacttattggagaagaattagcacaactaaaagagcaaagagtccataaaacagacctggaacgaatgttagaagcaaatgatggctcaggaatgttagacgaagatgaggaggatttgcagagggctctggcactaagtcgccaagaaattgacatggaagatgaggaagcagatctccgcaggnctattcagctaagtatgcaaggtagttccagaaacatatctcaagatatgacacagacatcaggtacaaatcttacttcagaagagcttcggaagagacgagaagcctactttgaaaaacagcagcaaaagcagcaaacagcagcagcagcagcagcagcagcagcagcagcagcagcagcagcagcagcagcagcagcgggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagtcttctaaatgtttctttttctttttgagtgtgcaagtatgggacatgtctaaagttagggcataggtgcttggatcttgtgtgacagaatagcggagttgctcctcgccatacaggctaaaaccatttcttgtgttaaaaatcgcacgggtttcca

SEQ ID NO: 649564 - DNA, 189 bp, Homo sapiens
tatgtgctcaagagaaactgaaacaaatgtgcatccaaaaaaacttggatattatgaaccctgtttcattctatccaaaaagtataaacaacccaatttttcaccaactgaggaatagacagattacatgtggtatcttacaatgtaatattgtttgataataaaaaggaatgcggtactgacacaatg

SEQ ID NO: 649565 - DNA, 1063 bp, Homo sapiens
  misc_feature (7)..(7): n is a, c, g, or t
  misc_feature (18)..(18): n is a, c, g, or t
gcaacanaccctggtggncacctgtgaccaaaggagtgttcaagaattacatccctcctctgtccccaggccccagacttcttcccagggccaccagccaagcccagaagtgcccagtcagaggtaccagccagcccttttacccatcatctctcccagcgtgcccaatgggtgccaagaccagacactctttacttaaacgccaaagtagaggaaatggaagtggatgacttctatgatggaatcaaacggctctataatgaagataatgttctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaggaattccaaaagatccaaactttttttaaactttaaaaaattctcttgggtagtatggtcagttggcactttttttcgtggccataatgtgtaacggtagcttggccccggtcaaaaatttcatttaaaatttcatgggccagcaattcctggttccccctcagaatcctgatttaaatttccctggtggctttggctggcttctcccatttaatagttactggaactttatggcattgtggatctatattggatttccactggcggttgattgaccaatttatttcagtggtgacagccatgactcaggtcccaattagtctggaaagggtccttgggaattggtcccatattattcagagatgcgcaaaaaggtctcttttcccgcgtgttgggtcccttcaaattttattcaactttgggttcctttgggtgacctaagggggttaaggggcggttcgactaggttgtggacttcgcttgtta

SEQ ID NO: 649566 - DNA, 357 bp, Homo sapiens
  misc_feature (77)..(78): n is a, c, g, or t
agacggagtctggctctgtcgcccagactggagtgcgtggcgcaatcttggctcactgcaagctccgccttccgtgnncaggccattctcctgcctcagcctcccgagtagctgggaccacaggcgcctgccaccacgcctggctgactttttgtacttttagtagagacggggtttcactgtagacaggatggtcttgatctcctgaccctgtcatccgacagcctcggcctcctaaagtgttggatcacaggcgtaagccacggcgcccggcctctcttactttttcttacgtgtaacactttattcccagagtcgaccaaacacttagaaaggacctaggaatacctgtcacat

SEQ ID NO: 649567 - DNA, 1414 bp, Homo sapiens
  misc_feature (7)..(7): n is a, c, g, or t
  misc_feature (18)..(18): n is a, c, g, or t
gcaacanaccctggtggncacctgtgaccaaaggagtgttcaagaattacatccctcctctgtccccaggccccagacttcttcccagggccaccagccaagcccagaagtgcccagtcagaggtaccagccagcccttttacccatcatctctcccagcgtgcccaatgggtgccaagaccagacactctttacttaaacgccaaagtagaggaaatggaagtggatgacttctatgatggaatcaaacggctctataatgaagataatgttctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaggaattccaaaagatccaaactttttttaaactttaaaaaattctcttgggtagtatggtcagttggcactttttttcgtggccataatgtgtaacggtagcttggccccggtcaaaaatttcatttaaaatttcatgggccagcaattcctggttccccctcagaatcctgatttaaatttccctggtggctttggctggcttctcccatttaatagttactggaactttatggcattgtggatctatattggatttccactggcggttgattgaccaatttatttcagtggtgacagccatgactcaggtcccaattagtctggaaagggtccttgggaattggtcccatattattcagagatgcgcaaaagaaaaagttctcatataccaggtggattgtggtctcatttccaaattttaatttaaaattatggtttcattttgtgtttaccttaaagtgatgcttaaaagtggcctgtaatcaggacacttaggtttgtcgaaagcatctcggactttgtttaacagattgtgataactattcaggtgctcaccaaagaactgtttacaattaattcaaattttctatgaaagttccatcattttatccagcagggagatgtctagatgtggggacgcatgattagtcgcaatgttcatgattagacctattgtagtaagattttataattacccctgtccagctatgttttaagagcggccgacttggtgaaagtttgtcatgttgtgaaaccgggcaaaggtaaaaaaaaaaatgcggcgataaatggcggaaatgcaagacgttaagccgcatgtcctcaacttgctataa

SEQ ID NO: 649568 - DNA, 381 bp, Homo sapiens
  misc_feature (180)..(184): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (223)..(223): n is a, c, g, or t
  misc_feature (245)..(245): n is a, c, g, or t
  misc_feature (247)..(247): n is a, c, g, or t
cctttgtccttcccttggggattacaagccagacttatcgtccctgcggctcccacatatgcctgaccccagccttaaacatagcccctgccagaggccttgctgggtggagcctctgtgtgactccataatcatcccaccacaacactcatctgtcaaacaccaagcaatctcagcctnnnnnccttcagctatnancnttctggggctaacttctctgccnttgtggttggagcctgaggccncntggaactcttgctaacctgttcagagccaggaaggagactgcacagttttgaaagcacagcccgtcaggtccggctctaaaaaaaactctctgcagcctgtgtaagctattataattaaaatggttttccggga

SEQ ID NO: 649569 - DNA, 1056 bp, Homo sapiens
acagattataatctagtccggtacctgtcatggtaactgtgaactcagtgagttcagattacatcctcgtgtttaccaggccctgacttcgtccaaggacgaacagctggccaatagtgccagtcagaggtagatgcagccttttgcccatcatctcccatgctggcagtgggtgcaagcatacgtctatgagacgcagggtggatgtaatggaagtggatgacttctatgatggaatcaaacggctctataatgaagataatgttctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaggaattccaaaagatccaaactttttttaaactttaaaaaattctcttgggtagtatggtcagttggcactttttttcgtggccataatgtgtaacggtagcttggccccggtcaaaaatttcatttaaaatttcatgggccagcaattcctggttccccctcagaatcctgatttaaatttccctggtggctttggctggcttctcccatttaatagttactggaactttatggcattgtggatctatattggatttccactggcggttgattgaccaatttatttcagtggtgacagccatgactcaggtcccaattagtctggaaagggtccttgggaattggtcccatattattcagagatgcgcaaaaaggtctcttttcccgcgtgttgggtcccttcaaattttattcaactttgggttcctttgggtgacctaagggggttaaggggcggttcgactaggttgtggacttcgcttgtta

SEQ ID NO: 649570 - DNA, 728 bp, Homo sapiens
  misc_feature (700)..(701): n is a, c, g, or t
ggccccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtgagcaggagcactgagattcatgtgggttttgctcagctaaccccgccgaccccacgcggttttccctgcacataggcgtggtctgaatattttgattctaatagttcctgggggtcacccctgcagctggtgaaccgttgatgccccctgtgtttgggaccttgacatttcgatgtgctgtatttcactctggagtcagagttctggacttgcttcattaaatcacaacagtctcagaaaacanncgcacatatcaccgttacacagggggg

SEQ ID NO: 649571 - DNA, 443 bp, Homo sapiens
ccgcagtactgctcgagagatacaaaatcaatgtgcaaaagatcacaagcactcttatacaccaagtaaacagacaaacagagaagctaaatcatgaatgaactcccatacacaattgctatcaaagagaaataaaatacctaagtaatccaacattacaaggagacgtgaacagacctcgatcgacggagaacaacaacaccactgctcaacacaaataacaagaggatacaaaccacatggaagaacattccatgctcatgggtaggaagaatcaatatcatgaaaatggccatactgctcaaggtaatttatagattcaatgccatccgccatcaagctaccaatgactttcttcacagaattggaaaaaactactttcaagttcatatggaaccaaaaaagagcccacattgccaagtcaatcatgagccaaaagaaca

SEQ ID NO: 649572 - DNA, 487 bp, Homo sapiens
ccaccccttccaacagacactcactgggaagtgcgaccggcccggcgcacctgcgtgggagcaagagccgtcttaggcctcggcacggtcgttggcaggtccatgttggctgctctgagccagattttcgagaagacaggacaggtgatgttgcagagatgcctgcccaacgccagcagacgcacctgctgctcagtggttgaggttcttgagctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtgagtgagatgcggggagtaatgacccgcgggcggccgc

SEQ ID NO: 649573 - DNA, 781 bp, Homo sapiens
cttccaagcactggaaacaacacgatggagagcaatgtgaggcgtcactgcaaacaggccgtagtaactcaggcaaatgacaagttgacatactgactaggtcctgtggtttcgctgaatggagtcgggtgcagtgaaagaagatcagtcgtgcccagtgttagggggaaggaagcagtcttcgaccgtgttgtttgtgggaggactagttgaggcaggtgaggatgcatgagagggtctccagaagcttccactgactgctgtgggcgtgcaccgaggcaacagggtctggcgtctgtctaccacagtgctggagtgcgaagtggtagtgatctcggctcatgtgcgaacgctcgtgcctcccaggttcgaagcgattctccgtgcctacagcctcaccgagatagcgtgggattacaggtccagcatgggagctctccgatctccaggagggcaagagtccaaggccatcagcgactcggacgggggtgaactagccctggtacggcgaacaccacagagagctgcaccatgcgtggggccccaggcaagagggactccaaagttcatcatcagcatgaatgagcaactttgagcccagcgtcgacatgggccgtgcccgtcagcgagagcaacgtggccaagctcaccaacatcgtaccgggaccagagctgcaccactggctggatggccaccaatgaactccagcaaacgacatgatcagtcctgcgagacgcgtgcactggcgcatgcagctcagcactcgaggtgaaccacaaa

SEQ ID NO: 649574 - DNA, 205 bp, Homo sapiens
  misc_feature (189)..(189): n is a, c, g, or t
ctgaggtgagtctagcaggatccgcaaaccctaatatagcatcattgtcatgcatcttcatgcaggtcaaatgttcttaccttcatttaacatacatatgttaaagcttaagcagtcttaagcagtttaacatcacatttgctgaaggcccacaacagctcaggcacagttcacagcattccagtcatntggtcacatcaggcac

SEQ ID NO: 649575 - DNA, 506 bp, Homo sapiens
ggccccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgactaagaggagaggtaaagacataaaaccaggagggagcccccggttcacatggcagcaatgcagagtgaaatccagacactgcctgtccatgatgttcgtggcaacagcgatcaggttcagctggaagtctgttttgttgatgcactgttttggggactataactttaaaaacaaaaactggctaattttgtcagttcgcggtggcagccttcagataaaatg

SEQ ID NO: 649576 - DNA, 128 bp, Homo sapiens
gtaactctagaggatcgccctgggtgctgcatgtgcacactgcccgttgtggggacatggaccagacccccgcatatccctctttcaccgctccaagcacccaaacagtgacctgaatgtatggacaa

SEQ ID NO: 649577 - DNA, 209 bp, Homo sapiens
catgtcgcgtcgtggcggcttaccccgagtatgttttccttgatttgcggtatgtgctcaaattagttgttagctatttcatagagctatagtaagatttttggaactaaattttcaaatctaatttaatttttaaattatttagattcctactgagctctggggcactgtgcttggagctgttggaaaagaaaaggaatttggtcttg

SEQ ID NO: 649578 - DNA, 107 bp, Homo sapiens
  misc_feature (89)..(89): n is a, c, g, or t
  misc_feature (100)..(100): n is a, c, g, or t
gcggccgcctactactactaaattcgcggccgcgtcgacgaccttactcaactgattatcaccctccctgtcatacaatacttcctggnctcgatttccntgggggg

SEQ ID NO: 649579 - DNA, 355 bp, Homo sapiens
cctgacagaggagtattcgtagatgtatacaggtgctacattatctcctttcaggatggcatatctgcagatgatttttagtgtctggtgccaagggcatcatatttttggattgaatgttttctgttgtaaaatggttggtgtggacagacgataagctccaccattacccctgaagcttgtggactggggccatttgggtgaggggcttgttacacaccgactcattgtctgatctttcacaataaatagcagacaggtgaagagctttttagagaagtggaacgttggtacccttggatttgcctggtttctgattttcttttgttgtctttaagtggaggttcattaagtt

SEQ ID NO: 649580 - DNA, 134 bp, Homo sapiens
gatcgacgaggaaaacagaggggtttttttttacgccaaaatgggcctgtggacctcctctgttttcccaatgagtccgaggctaccggaagttatcttagggcctctcctgtgtgcattaagtgtggcaagac

SEQ ID NO: 649581 - DNA, 156 bp, Homo sapiens
actatacacagttatggggagagtgagcaggagatcaccggcagaaacgccggtagtaagccgaggccacggcggctgctgggcgacagcttcgcaagcttcagagatgctgcgcctgacgaggagcagatccaaacttccattcttcattatgac

SEQ ID NO: 649582 - DNA, 1640 bp, Homo sapiens
ttgaacagggcgttgcgcgagtgcttcccggtttgttgggcgtatgttcctcaggggagtgtcatgcttgttatattgtgttggaagccgtgttggtgtagtggtgtgtggtgtatgcgggttgtttgtcggtgtcgatggggatatctgtcgttttgggcgtttcgggtgatgttctagtgtgggtgcgtttttgttgggtggtggatcctttgtggcccggttgtgggtgtgctggggtatggagttgggtttgcgctatagctcgtgttgtgtttagttgccagccatggtagtgtttaagttattgtttttttgagatatcctttgtgtgtggataaagggtgaatatgtttgtaagccggtttgtggtttgttggggccggtgactatggtgtgtgccgacgtggggagttccggggtgttgcatggatgttggcggctggcacgtagatgcgtgtggcggtgtgaggccgcggtttcgtgttgctaggtgtgggggaagtttgggtgtggatgctggtaatgttgggtgcagaattgggcgttcctctttctagcgtgggatagtgcctcctttgaagttcggctccgtttgtcgatgggttattggtgtcgtgcgaggcgttgagggtggtgtgggcgctgtagcggcgccggtgtgcgaggtgggagttggtttatagtctcctcttttcagttggggcttcagtcgggaggctctcttctggtgcgtatcggcgcgtgttgcgtggaagttcctcccctgggtcttagggtgtaaagcggggttagtctaggtgatagggggttagggctgcgttcccctgactagtttctttggtgaaatgggtttggtggtggataatggggcctgcttggtagttgattgagtgtggggagataagttttgttatcagggtggggcaatttttgattgtgtgagtgattgagaagcgactggggttaataaggttcgtagtaggggcgggcaagtggggagggggaaaaagcgttggtgaatgctcgtgtgcttgatcgtgcatggtgggtgcgttgggctgagatatgcgcgggtttgtctcttggaggtctcgcgcgtagttgcgtggcggttgtgttggatgggagagatgtagggtgggatggacgggtaggtctcgtgtggttctcatgcattgcgcgcaggactctttgaggcagtccgtggtgtatgggttgcagtgtgttatggagactagatcgctgcagttagtctatgagagggagtcagtgtcatgaggcttagtcaatatgtctcggggtgcgtagtgaggtctgcaggcgcttttacctcatttcagcagtagcagccagtgcagcaggcgtgtgagaggtgcgaggtcgtgtagtattgcttgggtaaatatgttagatgtgccagttctaacttagccgcaaattagtgcatgaatgtcattctcgcttgttgagatagttaggactctgtataatagatagtctctattctagctaccaaccactccttgatcctgtccgcttcattagtggctgttgtttgttgtacttccgtttagacaattgttcttaatggcttgtacgtacatatggattactcgaatatgtgtgttaatcaaatt

SEQ ID NO: 649583 - DNA, 462 bp, Homo sapiens
tgactgtagtacaagcaaactatgactatcccattattctttcccagtgataagtggaggggtcatcatatgagccagtttgggttaatgagacataacaggaagtctgatgtggcagtttgggaaaagttttatctgataaaaggagagagagatgtggaaaaggctatatccctttttcttctggctggggacattctcatgtgaaaagctgatccagagacctgatctggctggaacgggtgacctagccaaacctgaactacctacctcgggacttttaaggagaaagcccatatttttccaagccacgttaagtaacatatgctggttatatataggcaagggcaacctcaataacacagggggacacggcgtaacgtatttcagttcatagctttaacttaaggtaattaaactttatacttggtatccccctaaaggtcccaggtagagagccgg

SEQ ID NO: 649584 - DNA, 428 bp, Homo sapiens
  misc_feature (17)..(17): n is a, c, g, or t
cccaaaggggccccccnaaaaagaaaatggtgggccaaagttttttttttttaaaagaaggggggcggaaaggtggttttttgaaattccccttttttttaaatccgaagagggtggtaatcaaggaaataggaaggtttgttctccccgcgccccattttcttaaaaagatttttcatatccaggataataagacccaagctagtggctgcactgttggtctgctgcttatttgtatttgttgggcttctgtttatgttgtagaagctgaaattctagcaacatgcttcaattctgttattttgatacttatgaaaatgtattaggttttactatattgggcttttgaaagccataactcttaagaactttgtttttgcatattgtttgctaattctttactttaataaacctcaaaacctgaaaaa

SEQ ID NO: 649585 - DNA, 613 bp, Homo sapiens
gcagcactttgctatttacagccggggctcccgaggcggcagaaagttccggccactctctgacgcttgggttgggcgaagcgaggaccgtgccgcgccatcgctcgaggatatggagctactgtctccaccgctccgcgatcgtatgaccatgagcgggccccgagggatctctctgtcgtccttatgccgacatagcggacgacttgctatgacggacccgtgttgtcgactccccggacctgcgctatcttcgaagaccttggacccagacagcctgtatgcacgtggcgtcgcgctcctggaaacccgaagagcactcgatacttccccggcgggcgagtgacatcccaggacgctccggaagcgtcagcggtgcaggacggaggcaatgatgcagcgctgccctaggcgggcactcactcaggccgggccgctggcctaactagtgggcctgcaagagtgtgcaatgcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatc

SEQ ID NO: 649586 - DNA, 603 bp, Homo sapiens
aaacagctgccagaggcggataaagtccgttacaagaatgaaatcaaatcgtgggaggagcacatgatggagatcggaagagaagatcttttgcggagaaagacgaagagcgccctcaaagccaaagccaaaaccaaaaccatagccactaaaaacaggaaaaagacatccaaagtgacagtgataaaggcaaaagcgcccaaaaagaagaaagatgctagtggaaaagctgtgtatttctaggactctgatcaacagagtgtgttgtataaaaaccacaaccgtcctcaatacagtctgcgcttttccgttcttagagctgcatttatatagtgttcatgaaggttttaaaacctgtgaagatgccttcttcatcttttcaataaattcctctttttgctggtttttctgaatcatgcaagcgatatttgacctccccatgactgctttcatagtattatattgtataaagtgatataacatttcttaaattgtactttactgacacgcgtttgcttagaatgagtttgctttaaaagaggacgccatgttgtttgtatgtctttacttacaaaataaacatccactttttctataaaagca

SEQ ID NO: 649587 - DNA, 513 bp, Homo sapiens
  misc_feature (371)..(371): n is a, c, g, or t
gactctcgagtatccacacctcctaccccacgatttgagattttctgcagggctccctagagagttctctcagcaaattcacaggccccagtgagaatggggaatttgggaaggccactggaaatcacagttctcatatatatctccatggcttaccctttaggagagcaggaatttggaactgctagtcctctcttaggagagtgcccagagaagaattcatcatttaaatagcttcaggggtcagcagatcatgggattgaaggctgcagagagggctggggactggagtctaccagagtccaagtcttgagtgaaggcattcaaagtaccatgccagttaaacacagcctcctgtgggcagaatttgngatttgccagttggtgatgccgcgcaagagtgagtaaaaagggatggaggtttcatataccagaatatgaaggatgggaaaggttgggattgaaaaaggaatttgtcagtgaggaaggtaccgggggtaggaggtgggtacc

SEQ ID NO: 649588 - DNA, 139 bp, Homo sapiens
cacgaggaaaacaccaaatggcggatgaccccggtgcagcgggggggcccgggggccctggaggccctgggatggggaaccgctgtggcttccgccgaggtttcggcactggcatccggggccggggtccccgtcgtgg

SEQ ID NO: 649589 - DNA, 102 bp, Homo sapiens
gctctcgaggatcccggctttgtatgattatgggcgtgattagtagtagtactggttgaacatgtttgtgggtgtatatagtgtaattggaggttatggcat

SEQ ID NO: 649590 - DNA, 113 bp, Homo sapiens
tacagactctaaccactgttcgtcacgttccgcaggcttaaggagcgtggatacctggctccgagtgcttgccaagccccagaacacagctgaggttcagaaggtccagctca

SEQ ID NO: 649591 - DNA, 265 bp, Homo sapiens
tgtgaccgagcatctggtagagaggggcttttattcttaggagacaaagccggtttctgtgggtgtaggattctccagggtctccaggctgtaggacccagaggcttaatcagaattttcagacaaaactggcacctttcttttttcccgttggtttatttgtagtccttgagcaaaccaatgtctctgttcgaaagagggaaaataaaccaaccggaagaagaaaatgatccggatcattttcttcttccggcaatattaaccc

SEQ ID NO: 649592 - DNA, 263 bp, Homo sapiens
gatgttataataagccgtgcaccatttgtatgtaaatactccggcatcttcttatccatcaaaaatcactttaactttactggtccctttactcttccacataaatggtatatacaaccactcaggtccaaggaaaaagccggttagtcatatcatgggacttacatggaattggtagatatagaaaaaacagatatctttatgagtcttcctcatcataaaaatagtatgtctccatttcacttatgtctttaagtgtatta

SEQ ID NO: 649593 - DNA, 1540 bp, Homo sapiens
gatgtctgtcgaacggctgtgggcgtcttgctgcctctgggtaggggcgttaaaatccgttcttgcagaggcacacgtctctgtgcgacgcagcataatgcagtttagctcttgcagcaagtgacgcttgtagatggacaaaacgacaagaggacgcacacacagaccgagcaactgctctgacggaacagcaaaccaaggaaaatttacacagatgcttttgttgaaactaacttcggcatagcagggaccaaaacggatggaaggcatattagcacttaatccattgacacttacccacgcgctggccacatggaagcaacgccccttgggcgggctttcggaattgtctaccgacaacacgcctgcatggttacctggcaacgaactttccctttacacacgcattcccttagacccacggacgggaaaaggccccaccaatgtgggaaatacaatccaccccttttttggaccaggcactcttttcaaacgtggcaaccggctttgcttgagcaccgaaccttgggagctaccttttgggccatcgcgacggacttcccccccagttgagtgagggaccacacttaccctcacgaagtgggcccatttttatgcaggcccgctacaatttgggcaatggcagttggacctgcacgtcctccaacgggggtagcagccaacttaacaggcccttgtgtcgggacacacctttgtgggccggaagccggcatggtttggccttgagaaaggacaaacctttgggcggcgtttgcacaccgacactcactttggacagcttggcacgtccgtaaaacgggtatacgccttttcctgctacgccctgtagttggcacgtttcgtgtcacacacgaacatagcttctggggcaccgccaaacgcaggcaccatctgcggttggacacatttccggcctaggaaataactttttataccactcctcagctggacaacgcgggaacggtctttcccaacactatcggcgtcgttacatctgtacattctgcacgctttggggcagtgtgaacacaacactcattcatcacacaccgggcacataaatcttatactcctacaagggcgacacgttaccaaccaccccagcatttcagtcggcaacaacgttgtggtattagtcacagcgtgtctttcacacccacaggtccgtttgatattttactttcacactaacatatacttcattggactgaccctcatgtgctacactcgacccccacttgatctgtggcaaccaacacctaaaaccgaaacgcccaatccaacacttatacactatatcactatcattgtataaattcccccttcaataaaaaggcgacacctccatcacaacgacattactagtcgcacagtaccgttaaaactaactccactttccctatgcattacttatctgatccatcatcctttgtcctatacatcactcctatctctacccatattagttaacacctgaccaacagactgcgacagacccacctattattcacgtctcaca

SEQ ID NO: 649594 - DNA, 80 bp, Homo sapiens
  misc_feature (31)..(31): n is a, c, g, or t
ttcaaaactctttggccaatttcgggttganctcctcgggagaccgccgccgatgacatggtcatcgggtctgtgtggct

SEQ ID NO: 649595 - DNA, 443 bp, Homo sapiens
  misc_feature (297)..(297): n is a, c, g, or t
  misc_feature (352)..(352): n is a, c, g, or t
  misc_feature (372)..(372): n is a, c, g, or t
  misc_feature (391)..(391): n is a, c, g, or t
gaacagggtcagcatccacggcaatggtgccattccagacactgcatgtgtcagcctcatgactacaaaccagaccagatgggcttggctattgtcatgcccaagaagccacagctcagagaggtttggtgacctggccatgaggacagagctggtagtagagctggggctttcagacccagggcagcccagcccttttccatggagctggagttcttctggccttctggccttctccctttccaagcttctgcccatgtgtgtgggccagtcagatggtgaaggaattaaaccacntaaaaaaggccagacaagggccggggtgtggtgggcttcacacctgttaatcccngcactttgggggaggccganggagggcagattcacttgnagattcaaggagtttcgaccagcccttgggcccatgggttgccccccccctt

SEQ ID NO: 649596 - DNA, 864 bp, Homo sapiens
  misc_feature (232)..(232): n is a, c, g, or t
tggaagttgtccaggaaagaccgaggcagacgtggctccctgctgcaacgatgtgatagacaggctgacaaaggttccccgatgagcaagggtctgccaacccggcactggcactacaggggacggggctgacaggcccggccgcgagaggctgaacgggtgcagaagggccggaagccctgatgcgtggagctggatgaggaagaggctcgtgatccgccccccttgccgngggagggcccagcgcatccgacaggcagctagcagctgactctcctagtgggttcagcaacaggggcggggccgctgcccagtgcaggactgcctcagaccaacacagggcgcagctcctcccggcggtgggggccagggttcaccagcagggcagcggctgagcaagggcatatcagcgtcctccggtggtgggggccgggatcaccagcaccagagcctcgcaagggccccttccctcctccagaccttccttggccggtgacggctgtgacagtgatggcaggttcagtgccttcagcgcagagcgtggatgctctggaatcacccggacacctggccttggagggaccctccagccaccaggaatctgctttggagggaaatgtctattatttctaccgggaatattttagagacttggggcatggctggctcctcccgccagccatgcaaacctgcaccttccgcttgattcccgatccccctgcgtgggccgcattcctggtcccatgcctgcgtccatagatggggcctggctagtgtcgtgtcttcatttgaccccaaacagcgtcaatgcgggttatggggagccttggtggagcattattgagatcggatatcgatcagtgc

SEQ ID NO: 649597 - DNA, 362 bp, Homo sapiens
cccggggcacaccatggaggtctcctgttgaatggcctttcgagcctatccgagggacccatccctcacctgggcaggaccaacatgggcatggccggaggttcagaagtcgaataaagagaaagggacagagagaatattgggagaaatattctatcggatggggggaaaactttccaattttgatgaaagacaatataaccatctaagaaaatcaacaaaattcaagtaagactttgagcatcccacttttgagattgtgtaccagccgcaagcccttatgacacactttttccccaaagtagagggctctgacaatgttgatcccaagagagatgggaaagagcattgaatgaggattc

SEQ ID NO: 649598 - DNA, 467 bp, Homo sapiens
ttgctctagaaggatccctgccttgatgtactgctaccaggaggcaaggcagaatgaatcgcttgaacccgggaggcagaggttagagtgagccgagatcgcgccactgcactccatccagcctgggcaacagagtgagactccgtcccacaaaaaaaaaaaaaaaaaaggcggccttggataatacatacccaggaggggtggtgtgtcaataaattttatcctagaaccacgcggggggcagatctggccatagtgggccaggcccccaaggctaaggtatgctaccatgtattcttctacccaatccagtctaagagcacgctgatatattggacctccatgggttccctcttcccagttaaaatccccccattcgcccaaggtggggggtccctaccatcccaataaggaggctctcacattatgaacccagtccggggttaaaccccctgtgaggccagttg

SEQ ID NO: 649599 - DNA, 1064 bp, Homo sapiens
ggggggcctcgcctgagagagtgaggaccggctgcgtggaggagctgcaggactgaggtacagagtgccagtgcgcccaggacaggacccagcctggacttgactccctgggatcccaggaatgggcacaccctttcctcaccaccctgagtgaggcgctgccccctcacatgagacctctttgccccctgtggccaggcagatgcaggctgctgctggtccggggaggggcccacatggaggttggcacgtgcccggtgaagcaggatggcctgatgggcctggcgctggactcccctgtgtgcacccgcttccggacgcttccacctgtgtggctgactgcgccggtgccccgctggggactggctgctgggtgctcgctcctgcgccctgttcgccggggacttggctcgcgtgcccgacgggtgcagcaccaatggagcagcatgttggaggctgctgggtgctggaaccaggtatcctgagcgcctgctgcccggtcgacaccgcaaggccctggcgtgtgcccagcctggcagcccgcataaccgggggaggaccgccgtgtggaccatgctggagggagcctcatggggggccagccaatgtcattccccccggattgcgttcgcacaaggacacggaggtgctgcctcacgtgattctgacctgccatgtgcacccattggagtgaccaacaagttgctggcacacagggcgcgcccatgtggcggcactgcactcccctatatgacacggaaacacagaccccctatgtcgcttaagggtgtcgtccagtagctgctccttgtcgtcggtgattttccgccataggtattggtttgacgtcactcatacacaagtgatagggatgttcaccctgtacatgatcacctccggtattggtacagaccacatgtggtcccttggaccggtcccatataccgctatactgtgcctgggatgatccacacagttacgctgtccactcgcgtgatattgtctggtgtaacaaaacgatatccgtatatatatccggagcatatcatcgtcatgtggattgc

SEQ ID NO: 649600 - DNA, 1787 bp, Homo sapiens
  misc_feature (1091)..(1091): n is a, c, g, or t
cgggcacttgctgaaaaattccccaggtgctattgtgtactcgtgtcggtggcgctggggacctctcctgtaaaggcagagcggcagggcggcccggaagttcgtgtgtagctcgagaatcttgccctgggtactaagtccatgttgcggcgttggcaggctgcatgacgcgaagctcgggcgacccagagtgacgtggagctcgactgcggagtgcagcgtgcacctggggattgcgttggcgccatgcgtggcgccaggggggacactacgcaagtcactagcaatcatgggacgttctctatgttgtgaggaaggcgttctgtcaataggcagagagtaggtaggttcaccaatgggtgagcgcatagaagacaatctgtatcgtagaaaagcaagagactggtctcctaattccgatctagacgtcgacgttgtgtgtacctcgtgtagtagagagactaagattgcaccacacacttaagcaataggtagagagcttggttgtttccctcctgtacacagtagtggaaccccattcgtgacctaataacgaagtcgcgtatgggggtaaagcgccaggtgactctctctctctctacgcaagagttggaggtcatataatctcgaccgtgttgcagatgccgttgggggctgagtgcaatgcccattgtgttaatggaggaccccgagaaggcggattggggttccacacgacatggcgacttaggtggggatccaacaattgtggacccgttttcaacgggtggcacaccaaaacgcgaacctgtgctgcgtaaggggggatcttttgaacgacattaggttacctagccgggttcgacactacaggcgtgcacaccacaacgctgggctcacaatgtagcgcagcagagaccaagtgggggccatagcaccccctctgggtgcccttgggattaggtggaacggggaaaaaagaaaaacctgtgggtaagattccaaccacggtttgttgtggcggggtaaaaaaaaaggccctcaaccaccttctccaactcacttttcggcgggcccaatttttctttaaatggcgtggagaggaagaacgntcatggaggaaggtgtggcctgggcccggagaatatcaattgacaccaaaggcttaaaacaaagttccttttgtacagtatattatggcacagggatttatagtgcgctggcaaggttgttaaaacccccaagggggagagattccactccctttaaaattgcgggagacgccaccagtattctggtcccaagcggacacaggcacaatgttttggtgagttgttcgcacaagagcgcgaaagaaagatgtacttgggggagaacagggggtatgtcgaacggggggtgtgtagtggaacaaaagaatgtggtggggagtcttataaagtggcgccacggctgtgtgtcacgcacctgtgtgactaactgacaaaacccccaccaagtggagaccggcgccgcacgtagtggtaaccggcgtgaggaacaagacagcgcaccagtggcggcggaacacacaagggccggggaaaaagggcgacaccaatcttacgtggacagaccaatggccaggcaggagagtgaggccacaaaccacagggcgacgacacaactaaacagaagggagaggacgagaggactaacaataggtataagtgacgcagaacaatacgcggctagcgagcatatgagaaacgaaccgcgatcagactgatataatgaaaggcagaagagacttaagcaaagcgccgacc

SEQ ID NO: 649601 - DNA, 412 bp, Homo sapiens
  misc_feature (88)..(88): n is a, c, g, or t
  misc_feature (90)..(90): n is a, c, g, or t
  misc_feature (100)..(102): n is a, c, g, or t
  misc_feature (104)..(104): n is a, c, g, or t
  misc_feature (106)..(106): n is a, c, g, or t
  misc_feature (109)..(109): n is a, c, g, or t
  misc_feature (118)..(118): n is a, c, g, or t
  misc_feature (125)..(125): n is a, c, g, or t
  misc_feature (130)..(130): n is a, c, g, or t
  misc_feature (136)..(136): n is a, c, g, or t
  misc_feature (143)..(144): n is a, c, g, or t
  misc_feature (155)..(155): n is a, c, g, or t
  misc_feature (185)..(185): n is a, c, g, or t
  misc_feature (190)..(190): n is a, c, g, or t
  misc_feature (199)..(199): n is a, c, g, or t
  misc_feature (214)..(214): n is a, c, g, or t
  misc_feature (221)..(221): n is a, c, g, or t
  misc_feature (250)..(251): n is a, c, g, or t
  misc_feature (262)..(262): n is a, c, g, or t
  misc_feature (265)..(265): n is a, c, g, or t
  misc_feature (283)..(283): n is a, c, g, or t
  misc_feature (285)..(285): n is a, c, g, or t
  misc_feature (385)..(385): n is a, c, g, or t
cccccacaaatggggccttaaaaataaaggtttttaggttttggtttttggtcataattttttctccccgttccccttttgttttttngntttgtttttnnncngnccntgtcaaaantttgtgntgganggaacntgtttcnntatggcctccnttgcccaagttgaaacaggggcccatcatnatgtntgtttccanaacagtgccttggtnatcccanatccccggaccccgcctgggacccccaanntgtgtcctatnaangggtgtggggtaaggtantnaaaagggcggtagttggtggtggaacccaaaaacggacgccggtgcttggaggggttcttaaattatatttaaaaaagtaactttttgtataaataaaanaaaatgggacgtgtcccagctccagga

SEQ ID NO: 649602 - DNA, 468 bp, Homo sapiens
  misc_feature (11)..(11): n is a, c, g, or t
  misc_feature (464)..(464): n is a, c, g, or t
cgtagcagcgngcacacataataaagaagaagataggaagcgagtttccagatgagtgccggctgggggagctggggtgggatttagtctgtgtgtggaggtacggagtgagtgatccctcgagtctgatagttcgttcgcctcggagtggtgggttgggttggatcgggggccagtggtttcgtggatgggcgagtaaggggggtagcgtccagtttggaattttaggcgagttaaccgagtaggcaggtcgaggcgatgagtggggagtgttcagatggagttggatgggggattgctgtgaggtcggctatggtgtacctggttaaaggtagccgaggaaggtgatgtggtatttcgaagtgggggagaggagtgcgtgcggtgtgggaagctgtagggatggaggtagtgtggaccggtcgagttataagggtttgctggcattgatgtggctgcgctgntacg

SEQ ID NO: 649603 - DNA, 466 bp, Homo sapiens
  misc_feature (413)..(413): n is a, c, g, or t
  misc_feature (423)..(423): n is a, c, g, or t
  misc_feature (444)..(444): n is a, c, g, or t
  misc_feature (452)..(452): n is a, c, g, or t
ctttctgaccccatagatttgcctcttctgaacatctcatataaatggaatcatacaatatgcagccttttgtgtctgactttttccacttagcataatggaaggttttcaaaattcattcatgttgtagcatgtatcactgtttcattcctttttatggctgaatactctctcattgtatatatactgctttagttaccttttcatcagttgatggacatttaggttattatcactttttaactattacgaataatgctgctacaaatgttcatttacaagcttttgtgtgagcatatgctttcagttttcttgcaaatatacttagggagtaggaatttctggggtcgcatgggtaaacatttgggtggcactttgtcctctctgtatgttttaccattttggagggaacngttaggatcntttcccaaagcaccggcaccnttttatcntcccaacagcagct

SEQ ID NO: 649604 - DNA, 261 bp, Homo sapiens
  misc_feature (11)..(11): n is a, c, g, or t
  misc_feature (257)..(257): n is a, c, g, or t
cgtagcagcgngcacacataataaagaagaagataggaagcgagtttccagatgagtggggagtgttcagatggagttggatgggggattgctgtgaggtcggctatggtgtacctggttaaaggtagccgaggaaggtgatgtggtatttcgaagtgggggagaggagtgcgtgcggtgtgggaagctgtagggatggaggtagtgtggaccggtcgagttataagggtttgctggcattgatgtggctgcgctgntacg

SEQ ID NO: 649605 - DNA, 1342 bp, Homo sapiens
  misc_feature (474)..(474): n is a, c, g, or t
  misc_feature (547)..(547): n is a, c, g, or t
  misc_feature (586)..(586): n is a, c, g, or t
  misc_feature (633)..(633): n is a, c, g, or t
  misc_feature (652)..(652): n is a, c, g, or t
tgatgttactaacagaagcacagaagaactagtgaacactagtaccttacttattgggccgtcctgaacatgagacgtgcttaggttacaaactacgtacaggccgtcactataagttctgcatccctcagtgtgtggcacgacgtgctaggcctagaggcgtgtacgtatcgctatagcagaccgcgactagtcatatcacaccggtcagtccgcttccaccaggcacacgactgcctactattgctaatagtcacacttcattttctttcctattcatgaacattacacgccattgcactagagtaccgagaggagacattctgagccacaacatgtatctagcctacgcgctccctatgggtaattcaggttgtgcgcgcgcaggaatagtgtgtcagatgctcacgcactgggagataccatacacaacactatagacttatcttcgaggtcttgtagcggcatcacacntcggtcgatctctatagcgatcacttgctggttagcagcatcttgacataataagcgcttgcgatcgcgtacntgtgcacgccgagagatcactccgtgttgtggcaatgancgattcctagacccaatcacacgtctatggcaagtgtggaaactaangttcccccgaaaaactgcnataggccagggcacgttccccgcattatgatctcgttcaccaacacgagatccctattcctccgcgtgtaatcggagctcgtttacgactaatgggatggggttcctacgcttacttaataacctctaaacgggagtgaacacgagtgccataattgtttccactacaatccaccaacaagagtatgaatttgaaaatttatgtacaaatacctaactcctctcagccacttgaaaggaacggcacacttagacgcattaagggcgcctctcccatactcatcgggtgccaatgactttcctctgttctttgaacgtacaagaagtaaggtaccgattcccaataccactttgtcttctccgtacatacgtgcgtccacactagagtgcgcttatcgccttttgcctaggggaattctggatagcaaatcacaataggataaatctggggaacgctcggtggacaagcatgcgggaaaccagcggaaggcttgtagcctcgttcaggaaccccccgcgccgggacgcattgtggagaggggagtgtaatcgggccacaaatggcgattgaatatgggcaaacgaacgcaataagtttctggtggaaggtaaaatgccggtgtgcccaatctgtcaatgcaatgggggttgaggtaatgtgcggtgaaaagtgggataacgaaggggggac

SEQ ID NO: 649606 - DNA, 377 bp, Homo sapiens
  misc_feature (171)..(171): n is a, c, g, or t
  misc_feature (269)..(271): n is a, c, g, or t
  misc_feature (313)..(313): n is a, c, g, or t
agccatttttctccccaggggcaggagggggagacttccaccagcaacatggaatcttcagtggatgcagctgaccaaccctcctgacttctcagtcttttcccaccactgctcaccctttatgttcagatgtattcagcactagataaccatacttattacctataagtnatgtgtgtgtgtgtatgtggggggggggataattttgtactttaagaataaatatatataagctatatgtgtaacccctttcaaacaaaaaaactatnnntctgtgaaaaaaatcagcattatatttcggcaggctgtggtntttagattggtggagctcctgaccagctggaaatccctgtccccactttgaccgtattccctca

SEQ ID NO: 649607 - DNA, 539 bp, Homo sapiens
cgaacccaccaacgacaccaagcacttgccgggcagaccaggcgtcgtggaggcgcccgcagcccccccatcccccccgcaaggacgcataccgagagtgcgtaatgcttggcgcggtgaccagaactgtgcgcttcctgactgctcagtagcatgatgccacactctggatcccaggccgggtccctgatggattctgggagggagcgtcctcttttttgcctcccagatctcgggctctctgataaccctgaggctgggttttaaaatcacggctcttccaagttacacgaagagtccatggtcaagggtcaagggctggtcttcgacccatcgggatcgtctttcttgagaaatgcctgagagctaagcctaggagctgcccagggacaggattgccaaagagctggagccgagcgcgaagggctgggaggcgcgtgggaggccccttacacaccggaccggggctcctcaaattgtttctgtgtctgttgattacgctgtctattattaatcagtatcgtcccctgttttactaa

SEQ ID NO: 649608 - DNA, 1519 bp, Homo sapiens
  misc_feature (1413)..(1413): n is a, c, g, or t
taaacaaacccggtcctggggggggtgtgggtattaactactaacgttgagatgatattcttttaccgggggaaggcgcttggtgaagtaggccttatttctctggttcctttcgatccagggcaggaattgtgaagtagactagaaaccgaccgggattacctccggctcgtgaactcagaatcacgttaggcacttataatcgattgaacacaaagcgaaaccttttaatagcggcgtgccacccatggggaagtgttccgtgaatccaacattcgaaggtgcgtaaaccacatatgtggtggaatagtgagacctcatagaaaatagagatgtgcgccgtggtaaatccccctagggtatacactgtggtcacccgagtggggctcaaaggttactgtggactcaagtgtgagctatatagatagctccggcattacgcacgttgcgcatgaacagctcgtaaaaccatgtgtatacgtgctctcagaaaaagagcatgtgcgagtcacactagcctcccaaaaggcatcccccccacaaaacctgaaaacaattaacaaaaagagcaagagctaaccaggtaccaacatataacgagacccgagaaagggagaaatagcgggaaaaaagcgacaacaccagaaggatgagagacacattaaacaagaccaacaacacatcacaacaggacaacccacacacacaagagacgaaccactcacagatcacgcccaacaatgacggcccacggagagattacaaccatagccccccccgcgcacaccctcatcaacccaatcagccgacaggcaaggagggatcacaccaacctcaacacacctcagcggcaatcaacaacaacaatcagcacacaacagaacacagacgatgacaacagcccacatccagagagacgacaacgacccaactgaccatacaaaacacacagatgaatcccccaacaaacacttatacagctgcaaaacccaacaagagtgaaaataacatgcaccacacaccccctcgatggacaacacggagagtcataagtggggatcaaagcggacagacaaacaggagagaacactaagaatgacggcaccccactcgagactgcaagccacgcaaagcacaccaacgaccacatagtaccagcaggcacgacacaacaacggcaggaaacatagtcgccagcactcatccgtgtgtccaacgcgctgtttgtgggcaacagcaccaaaacacggacaaaaacacgacggcacctggtctccgatatcactacgagctacttgcacctccgactacaccacaaaggagaagacaatgcatcacactgaacggaccacacagacaacgaagacacacaaacgagaacacccagacgacacaaccagtaccctcacatantgtctacaagaacaaactaaacagtgaaatagtatactaggtaaagctaaagatgagacaagaggagcacgactaaccgcacgaagtcgagcacaacgaaaacacc

SEQ ID NO: 649609 - DNA, 128 bp, Homo sapiens
ttggtggcatattcataagcatgttgtcatgcatcaggtggtttggccctctccggtgcgatgtcatctgtggtgttccttgtaccatttacccagcaatgatatgatagggatggtttttttttctc

SEQ ID NO: 649610 - DNA, 347 bp, Homo sapiens
  misc_feature (78)..(78): n is a, c, g, or t
tggcccatatgtcatgcctcaagttcttgataatgtgtgtcagaccagacagttagcgtttatccaaatggtgtgaanaattcatactcatctttctttaaccgaaagtgtctagatccaatgtggctcaggttcacctcattctcctcaaataagcgcaatcctttggcgatcgcagttgtcttcaatatagctgtgtttccgtgtccaaagtcagagagtttcctgcacaagcttgggttttccaggacccatgtgcacattctgcgctccccgagagtgaggtctctgcgctttataggcgcctcaggcacagacatgttcgcacacagcacgtgggtctagag

SEQ ID NO: 649611 - DNA, 457 bp, Homo sapiens
ttttttttccttggtatgtatgtctgacaattactagaattaaaaatgaatcccagcagttccaactggccagaatttgaggagttagagatgtccagccgctgtactatactcagctatcattcgagtgtagtctgtgggtggttgttttattaaaagttgtaagtgaaggccaggaacagtgactcatgcctgtaatcccagccctttggggggctgaggtggtcagatcacttgaggtcaggagttcaggaccagcccggccaacatggtgaatccccatctttgctggagatgcagcaattggccggacatgggggtacatgcctgtggtcccagctccttgggaggctgggtcgggagaattgcttgaccctgggaggcggaggtttcgttgggccagggtcgcacctctgtacttcagcctgggcgacagagtgagactctgcctcggtca

SEQ ID NO: 649612 - DNA, 923 bp, Homo sapiens
gctccagcagcaatggcagtgacggctgttgtgctgtgcgcggacgtggcttgtgctgtgtggtggctgtgagtgaccatgcaatgccacgcggcttctgtgctctggatcagtccgacgaatgtcgaccgtgtggctgctggtgctccatcctgtggaacgcctggtgtggtgccttctggaaatgagagatgcatgtgctgaagatggaacagatatttccaggtgaggctcacctggtgtcccaagtccagcccatggatctcccaatggactatccaatccattaaacttgccaatcgcaccacaccacgattcctacgctggtgccatatgggccgcaccacatcaccccaacagaattcccggtgcccgcaatccagtataccgctaagcccatttgatagtcccgaccgtagccacggtatagtggacactcccagtttacactgcacaacaagtatcagagacaccaccaaaacggtttccaccggaaggagtctccaaaacgaaaccacaggcgtcaaactcctccatttactcattaccactctacccgcgatggaagatactacctcagagtcagtgctgaagacaacaccccgagactatcttcggaaaatgtgtctagaatcccgacacgcaccaaacgttatagcatacccagccacatgaattcccgctcgacccattacaccaccatgtaaacacccctcataacgcgtcatacttaccatcgacctcggccacgccgttaaagaacatggcaaagcccatgcatgcactatcaagggatacatccagtgtgatacataggacacaccgaaaatccgaaaagaagatgacaggatgatgtggacgctgggtcattgagcacgcataactacatgcatcggaaaccacatcctctaaaaggactaaca

SEQ ID NO: 649613 - DNA, 467 bp, Homo sapiens
  misc_feature (10)..(10): n is a, c, g, or t
  misc_feature (20)..(20): n is a, c, g, or t
  misc_feature (35)..(35): n is a, c, g, or t
  misc_feature (54)..(54): n is a, c, g, or t
tgcgaacaantaaatgaatnccaatcctaaccgcnaaccgctggccaactgccnaagcaagcaaggtcaaaaagcgccgaaaagcaagcaagaaactgttgcgaagcgttcccatcgaatgccccagcggcgccttcgtccctgttccagaccgtaccagcgttgttcgggtttaagctgaggtaacaaccatttctcatagccgtcgagctggttctcgttgccgccgaatttataacgccaggtgacccgactccccggctgcacggctccggttttatcgacatccgccagattcatcatcagacgcggagccatctggaaggggttaaaaccggaatccggttcctgaatcacttctccggcaatccgcaaaggtgcatcgcccacgtcaatggtgtcgcccgttttcaggttaagcagtccatcaggcgtggggccagcaatacgctgcccgctgcggttta

SEQ ID NO: 649614 - DNA, 207 bp, Homo sapiens
  misc_feature (153)..(153): n is a, c, g, or t
cgatctagaggatcccagtacaagaaagaacggtgacacccgtcaggtgcgtaccatgtggaagaggtcaggatggcaaggtcatctcctcccgcgagcaggtccacagaccacccgctgaggactcagctaccccggccgccacccaggagncagggaggcagcctgcccatctgccccacagtctccggcctctccagcctcagc

SEQ ID NO: 649615 - DNA, 322 bp, Homo sapiens
  misc_feature (52)..(52): n is a, c, g, or t
  misc_feature (277)..(277): n is a, c, g, or t
  misc_feature (279)..(279): n is a, c, g, or t
gggcttgcagactgcaaatgaaaaaagcatgaagcatgaatcctgccaaacnctgcagcctgaagcgcagaaaaaagccgaggcagccgctgcggcactgaagaagaaagcggaagggtcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaangnggctgctgaaaaggcagcagctgataagaaagcagcggcagaa

SEQ ID NO: 649616 - DNA, 157 bp, Homo sapiens
gagcgagaaacatggcaaactgctctgtgctttcaaaccaaagtgtaccccccaaccccaaatttgtctaaacactggccagactgttgtgggcattgttttctacaaccaaattctgggtatatatattctttcttaaaaacatagatagttacag

SEQ ID NO: 649617 - DNA, 145 bp, Homo sapiens
  misc_feature (44)..(46): n is a, c, g, or t
tccgatgctgacttagatatgagctttgactaaaggccttccannnctcattacactcatagggcttctctggtgaggaatcctcttgatgctgaaccaacgatgagcaccccactagcaaaggccttcccagactcattacacg

SEQ ID NO: 649618 - DNA, 349 bp, Homo sapiens
gtgagcccaggggcgctttgcttaccgtcctgccggcccagccgtcgctagaggccgcgggccctgcggaacctcctaaacctggcggcgggaactggctcatggccccgcggcggtccgtcctccttggccgtcaggctcaagccccgccgcgacacccacctcgtacggcgtcttctgcaaggggctctcccgcaccctgctcgccttcttcgagctggcctggcagctgcgcatgaacttcccgtacttctacgtcgcgggctcggtgatcctcaacatccgattgcaggtacatatttagagccatgactaagctaacggcctccggggccagcatgatggccgc

SEQ ID NO: 649619 - DNA, 201 bp, Homo sapiens
  misc_feature (55)..(55): n is a, c, g, or t
  misc_feature (94)..(94): n is a, c, g, or t
  misc_feature (187)..(187): n is a, c, g, or t
aatgcgggtcacggcgccccgaaccgtcctcctgctgctctggggggcagtggcntgaccgagacctgggccggctccactccatgaggtattnctacaccgccatgtcccggcccggcgcggggagcccgttcattgcagtgggctacgtggacgacacccagtcgtgaggttcgacagcgacgcngcgagtccgatggc

SEQ ID NO: 649620 - DNA, 259 bp, Homo sapiens
  misc_feature (16)..(16): n is a, c, g, or t
ttccaatgttaaaaangccggcgccttcttgtcacatgtgcccttggggccttgagccaaatgctggagaacctcgtacggcgtcttctgcaaggggctctcccgcaccctgctcgccttcttcgagctggcctggcagctgcgcatgaacttcccgtacttctacgtcgcgggctcggtgatcctcaacatccgattgcaggtacatatttagagccatgactaagctaacggcctccggggccagcatgatggccgc

SEQ ID NO: 649621 - DNA, 979 bp, Homo sapiens
agcggaggccgccgccggggctcgctagtcgcaggcgccgcgtacccgtcgccactcgcgccagcccgtgcgccctcggcgcgtaccctgtggtgctcgcatcccatgctgtcggtcgaggtgtgcgctcggctggccccggatgagtgtcccgatgtcgtgcttccgggacgtattggtgacctcgcatgcggatacagcacgcgcttcccggggagtcatacaagctggttgcgcaatcgagggcctcggacgggccctctcgggtcacgcaaggtattcgaccgttctcctactaatatcgccgcgccgggtctagccagggtacacaggacgtgtaacatgactagttttaagtaccgagctaaggtggcaaccaaatagtggagcagtacccgaccgtttgtttaggcctatgaaatagtcaggcaatcaataaagcccgggggaaagtttgccccagtggaggtcgaagaaacggtcgaaatcgttaagggcctcactacatagttaaccggttatagatacggagatgaaagaagaacgtttcaattccggaggagcttgcagagcgcttcgccaagaggcactcgcggagaaaggagagcacagatggaaccccggttgggtttacaatgcggcacgagtccagatcccaggaaaatgtgaccacacgatagaggagacgattcccggtggacttccaggtgaacctccgcgcaagcagaagccttgcataggcaacagaattgttccaattcggaaagtaaacctgaagtcttaaatcgaaaacgcggcgttcgcgagaaagcccaaaagttaaccgaacttgccccaaatataccggaagtataaaccccccacaagtgccaccccggatcaaaatatacactaagaccacgcttttgcccaacaatagtgttacagtctgtgccccattgaattccccccacggagggagacactaaagtgataacag

SEQ ID NO: 649622 - DNA, 143 bp, Homo sapiens
tatctacagtcgaactatactctctgtgctgctgagctgtcacactactgtaagtcagatgcaaagcgctcaaggctgtgagagagtcagttcagatagcgtgcagacgtgttgtgtgcggactcaagctgagagtgtgtctt

SEQ ID NO: 649623 - DNA, 512 bp, Homo sapiens
  misc_feature (312)..(313): n is a, c, g, or t
  misc_feature (467)..(467): n is a, c, g, or t
ctttccctttggaaaaaggggtttgggggctttttgcggaaaacgggtggaaaaacccaaagcccccccgggaaatgggggcacctttggtttcggaaatggggcccggactcccttgtcgccacgcagctccatggactagatgtagcgtatgctggctggagcctagccctgtgagggcagccttagcagccatctactcaggcctcctgcggaggctccaggccgagggctgcctgcccccttccctgacttcagttgtggtaatcgtgtgtggaggcaacaacatcaacagtctcgagaagtgcatgnncaccggcccctatttggaaaaaagcccacctttgggaccagtgttcttgaagggggttacccatgcctggccccaaagacccctgagaggcccatggacagtcctgtgtctggatgaggaggactcagtgctggcagatggcagtggaagctgncctgtgcaactgtgctgctgcctcaatacgccagccctcctgact

SEQ ID NO: 649624 - DNA, 203 bp, Homo sapiens
  misc_feature (7)..(7): n is a, c, g, or t
  misc_feature (18)..(18): n is a, c, g, or t
  misc_feature (36)..(36): n is a, c, g, or t
  misc_feature (45)..(45): n is a, c, g, or t
  misc_feature (49)..(49): n is a, c, g, or t
  misc_feature (55)..(55): n is a, c, g, or t
  misc_feature (57)..(57): n is a, c, g, or t
  misc_feature (78)..(78): n is a, c, g, or t
  misc_feature (91)..(91): n is a, c, g, or t
  misc_feature (99)..(99): n is a, c, g, or t
  misc_feature (101)..(101): n is a, c, g, or t
  misc_feature (114)..(114): n is a, c, g, or t
  misc_feature (121)..(121): n is a, c, g, or t
  misc_feature (123)..(124): n is a, c, g, or t
  misc_feature (147)..(147): n is a, c, g, or t
  misc_feature (153)..(154): n is a, c, g, or t
ctccgtngcgcacacttnaccccttataaggcactnggggtcctnttgngtcttngnataaaaaataaatggcaaaanaggtccagcttanaaccaaangnacaccttggagantggaggncnnttggaggagaacacaccctttgngtattnnaggaatatgcagtaaaatctgtcaagctagctccaaggagcctttccct

SEQ ID NO: 649625 - DNA, 163 bp, Homo sapiens
  misc_feature (144)..(144): n is a, c, g, or t
tcctcccgcgttacgctcgctggacttggacgactggccaagggagctgaccctcgtgctgacgtgctattggcaacgagggggccaaccgcgtgtgggaaatgcgacgcgcgaggcctgtgccaatgccctcgctgggactcnttcgctggtaatgcgtgag

SEQ ID NO: 649626 - DNA, 506 bp, Homo sapiens
cataatagtgatgagtaagatgggtgtgtgtggggagaagggaggaagaggagatggggaatcaggaaattagggggcatgttgaactcaaaatggctcctggtgtaccaaagagaagaaggcacatagttggggaggtcatacaggagtctggcacgtgtgtctgtgacggtgtaaatacaaccctctccacggttgtccggtgaatgcttttttctcatggtatcaagggcagagggttctgaatcaaatatccgtctgacactttgcacagaagcagaaactgttggcaatgtgtgtacaaggagtgatgtcagtatttcatagacggatgaagtgtgcccatttcaacaaaaaattgagggatcactgctgtaaaaagtatggcccctggaaatcagagtgactggtcactgtacttcctgtctcgagtccagcgcaatgttgcagagctcgacgttttacgtaaatcagggattcctagagggcctgggacacccctcgtg

SEQ ID NO: 649627 - DNA, 192 bp, Homo sapiens
caatttcattttgtgattctatatcaatgaagttagagatatgcaatacaatagtggttgaaattttgttttctataactagccaatgatataccccaaacaaaaaatataagtagagaacagattttacagtgaaaacatttttattttgacaaaaatataacctttaaaaattaaccaaattaacctttt

SEQ ID NO: 649628 - DNA, 139 bp, Homo sapiens
tgccttacacactcagggagacctcgggttgtacctaggcctagtggacaaactttggtagagggttcggtacgacttacgacacctggccctacgtcatagtccgtaccctcagtaacagtgtagtagctcttcctgt

SEQ ID NO: 649629 - DNA, 419 bp, Homo sapiens
acctctcaccatgtagcgtcacaggctgtgcactcacctagtgtgagccccataagagcagggtttgcttctgcttcagctaccgccatgtcttccctcaaatgtgtggtcaccaaatgtttgccaacagggtctctagctatttatcttttgggcacataaagccctttcaacatcacttctgcacctatctttatactcagatctcacctcgtctacaacaaagttttctgtgggtacatgcgcacacatgcaaaggtacagtcgtcattcagtgcagtctgcacacttctacttcatcaaagcacaccagagtgctggctggtgagcccaatgcttctcatgctcccttctgtcacactgcagcatgtctctttaaactctggctcatccatcggttagttatctgtcagcaaact

SEQ ID NO: 649630 - DNA, 112 bp, Homo sapiens
tctggtgggtgaagcggagagtaagaagatacctgctacaactatagtagcttgagtaggagtagggctgagactggggtggggccttctataggctagaggggagtcaggg

SEQ ID NO: 649631 - DNA, 358 bp, Homo sapiens
tagcttagtgcacggcatttgttatcaaaagcttttacttaaggacagctccagcctgcatttattagcaagttagggttatatttatttttattttgaaaaacaaaagtgggagaaaggtttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgcta

SEQ ID NO: 649632 - DNA, 799 bp, Homo sapiens
gcgtggagcgggctgggccagctgttgagtggaatgtcatggccagctcctcagacagtgaagatgacagtttcatggctgctggaccaggaagacactgtgctggaagggacaatggatcaagatgaggcagccccacccagtattggcaggctgaggagactagacataataggtccatgtcggacgctgccagcaagaggttatcggagtatatcctgtactttctctcaccagtctcaggaacacaaaactgcggcccttgtctagcaaacagtggtatcgacttatcaacggtgtagcccatcagtgtaatcatggtaacatgacaggctgtccagcgacggaaacattcacatggcgacagccgtacctatcctatatcctggaaccccaatcacctcagcgctatctcgccacacgtgcatgctatacctgatgcatatcaagtcctatgtaactgtgcaacgacacgcgctgctagccgcgaagacagatggaactggctacgctcacccatcgacacatcctgaagacctctgacacctagagcgagcacagccagtggaatcccgaccccgatgggcgatacaagagcgccaatacgcgtagcacgcacagccctctgacagcgcagctgctgggcgccgagcgaccacgcggagatatgggatagcttgctggactgcgcgcgctggacctccgcgccagcgcgcgttacgtcgcgtaaagtccgggatcgaagaagattgcttagagagacaacagcacccctgactcacaccagagaacaatggta

SEQ ID NO: 649633 - DNA, 899 bp, Homo sapiens
gaactactgcattattttataaaccatagaacatatacttagagtcacatggattattaagttggttcactaattcttattctattctttcctgtaatgtgaggatacttgtctctcgccttgtttttcaattgccttagtgtgcaattgtatcttacaattatcttattaattttttatataccaaacctagaataatactgtatacatagttggttgtccacagtagaaattaaattgaagtctttttttccgtgcatgatatggttaggcaggtaagcaaaataagaatgataaatatcgtttatattttgtccttaatcacaggacagcagaaacttttggatacaaggaacagcggcttaagtggagaacgttcctttttttcctaactacacctatttgggagcttatttagagacgagccaaactagagaaagttctctccatgaggagctgatcctttcatcccaaagaatgcaacagaattgtttacattttggcattgagccttctagtcagtttgttttcctgtaactaactatactacacatgtatatgatatattaatataaatgagaatatatgattcggcgcctttcccaaagtactatccttcaggcatatcatgtttattttttgacgttagtttgaattagctgctcagtatttcattatgcataggccttttttgtctttttcttctctgtaggacaggtctctctctgaggtccggctggagtggcgaccggtcctggtccactggacctctggctccctggtaagtggaccccgggtcgacccttggttttgggcacgggggcgccccccccgggatttggttccgtggacggggacccgcccgggttttaccttggggcgtgttgccaggccccggg

SEQ ID NO: 649634 - DNA, 262 bp, Homo sapiens
gcagctggagcaggcgcaggccatcgacgacctcatgcctgcccagaagtgaagccgcggcccacacccgacaccagccctgctgcgtccggacgtattgtgctggcagtgcgcaccatgcacccctgatgtgtcccgtctggcgagcccgttagccttggtgtagaacttgcgtcacccgtggtagagtgtatgtttttgagggctaagatactgctgatgctgaaataaactagggttttggccgtgaaaaaaaacaaaa

SEQ ID NO: 649635 - DNA, 114 bp, Homo sapiens
ctcaaattttgtctggctagtaactccaccgcttctccaatggattcatccagtttcttggagaaccatatagactaatgacagcatctggagcacacggacgtatcaaggatg

SEQ ID NO: 649636 - DNA, 283 bp, Homo sapiens
ctattggctttttaatacccataggatgtatcatgatgtcgcttctctccttcctgatatttaaaagacttactgagttttaaatggtataaatttctggcatctggcaggtgctaaataaatgtttcctggatcgaaatctacagtctcaaggagtcaaggctacaattcttaagttgcttcagatgactggttctatctatttatcaatacatccatcgatacactcatcgcccttaccacgctactcctacctatctccccttttatactaataatctta

SEQ ID NO: 649637 - DNA, 292 bp, Homo sapiens
cgacccagcttattatacagttatcatctgtaccaatgtcaaatgtttggtacaacaatagtaatttccatgcatcgaagatccatcgtgtacagttggagtcacttctccaattgtgactcacagtgagcctgaattctagtacatctggaaacaaagaaaatggcgcagacatatttttatataatgctaataggatacctgttatttcattaaatcaagcatcaataactagcttactcacagcgttagattggtatcccaatactttgctccgaacaatggagccttg

SEQ ID NO: 649638 - DNA, 355 bp, Homo sapiens
  misc_feature (76)..(76): n is a, c, g, or t
tttaaaaaccagcgtgtagaggctgcctaccgtaaagagctggtttatggtgaagacgatgccacgcgcgcgacgncgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggccacactggttgagttggatgtctatctacaaacgtctgcgca

SEQ ID NO: 649639 - DNA, 585 bp, Homo sapiens
tcttccagatttttatgagccttgttacccactggcagcccttagcacacaatagctcgccttccccaaatttgttatgcgaacgggtgtaactcatgtggcccccccgcataatccaagggctagtcatcttccgcagctaaatactctccccggtagaatgttcccaactttctcgtaaaacacagtccgtattatcttcgcatacaggagttatgcaatgcacctggaggctttcaccatgagttctgaatagaaaaggagcaagccgagaatcctagatatattgcacatgcacgtgtcttacttacatatatttagctagggttctctatttttatcacctcaactagcatacgcctacagatgtagcttgcgagtgactcacgcttcagccattttccggatcggcatctccagcgctcaacatttgtttgtagtccacaggtcttccaaatcggaccttcacgtcactctaatggctcaactttccatcactatctgacttatccgccaactaatatttcagctttacagccaaacatcactttggcttcgagcaaattcctaccagctggaacatga

SEQ ID NO: 649640 - DNA, 223 bp, Homo sapiens
  misc_feature (2)..(2): n is a, c, g, or t
  misc_feature (106)..(106): n is a, c, g, or t
  misc_feature (136)..(136): n is a, c, g, or t
  misc_feature (166)..(166): n is a, c, g, or t
antttatttcacacattgacattaaatttttatggacacataataactgtacatatatatggggtagaatgtgatgttttaatacatgtactcaatgtgtaatgancaaatcagggtaatttgcataatgattttnctgtagggagaaaattcaaaatctactctnctggctattttcaaatatataatatgttattgttaacctatactcatccctacctat

SEQ ID NO: 649641 - DNA, 196 bp, Homo sapiens
gctcctgctgaggggccaggcggacctggaggaacccgcaaataagttttttccttttggaaggatagagattattccacctccttaaaaaatttagccaataggttcctaagatatggctaaccgttaagttttaaacgtatttttattagctaaggattttaagagaaaatttgaggccttagaggagtgcctt

SEQ ID NO: 649642 - DNA, 613 bp, Homo sapiens
ccacgccgtcgctagttctagatcgcggcgccgcccttttttatattattttttttttggggtgaacaaagtcttatggaaagtcccatcacctccaaagcggggggcccaccctcacatcaacaacccctccctagaaaccaacccttcatggcagatcaacccaccagcgagatggaaggtacggcatcgccgggtacccatcagaaagagacgaaggagtaacactccggacaactcgagtaggcacaaaacctcaagcgcgggtcaggcaactcacacaaatcagggacagtccaacaacacacagacagagagaatggcaagtagctggaccgtgcaggcacccggaaaggacacagaccaaaccgagtcgaacaaagagtgggaataaacatcatggaagagcgaacaacccacaacatgaggatacctcagagaggaacttagtcccaagcagcaataaaaacaaatacagccggacaaagtaatagtgaacaaagaagataaaaacaaaaggaataagagtacaatcgacaaaaagagagaagatgaaaaaacacattaacaatgaactagacaacacagcaaaaaacggagagatacaccaaca

SEQ ID NO: 649643 - DNA, 150 bp, Homo sapiens
atgatttccgcgcctgcctgatctccatgggttacaacatgggagaagcagaatttgcccgcatcatgagcattgtggacccaaccgccttggggtagtgacattccaggccttcattgacttcatgtcccgcgtaacagtttacaaatt

SEQ ID NO: 649644 - DNA, 588 bp, Homo sapiens
  misc_feature (42)..(42): n is a, c, g, or t
  misc_feature (65)..(65): n is a, c, g, or t
  misc_feature (69)..(69): n is a, c, g, or t
  misc_feature (74)..(74): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (99)..(99): n is a, c, g, or t
  misc_feature (110)..(110): n is a, c, g, or t
  misc_feature (125)..(125): n is a, c, g, or t
  misc_feature (131)..(131): n is a, c, g, or t
  misc_feature (133)..(133): n is a, c, g, or t
  misc_feature (139)..(140): n is a, c, g, or t
  misc_feature (152)..(152): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (178)..(178): n is a, c, g, or t
  misc_feature (184)..(184): n is a, c, g, or t
  misc_feature (199)..(200): n is a, c, g, or t
  misc_feature (210)..(210): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (236)..(236): n is a, c, g, or t
  misc_feature (239)..(239): n is a, c, g, or t
  misc_feature (256)..(256): n is a, c, g, or t
  misc_feature (272)..(272): n is a, c, g, or t
  misc_feature (339)..(339): n is a, c, g, or t
  misc_feature (365)..(365): n is a, c, g, or t
  misc_feature (380)..(380): n is a, c, g, or t
  misc_feature (388)..(388): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (528)..(528): n is a, c, g, or t
  misc_feature (556)..(556): n is a, c, g, or t
gccagactccagggatggagctgctattgttggttccaaaangggtgacactggcgaaggctttnttcntcagnttntncantngctggaactttccantgttgagtttnctgctcttgatggtntgtgtnanttcttnngggaagcgtttntntntnttccacagggaccagccgtncttttnatagtgctcccaganntttggcagtnccacagtgtntntnttctctttggtnttntttcgctttttttcttncatcacaaaggttctnttgggcaggtgagcgaaggggtccttggccttgggctcagcagccagcgcctgctcacattcatccntctcctcctcaggagcaggggcagcngcctttttctcttcnttccactnagcctggggcttctgcttctcttcccgtgaacccttctctttccgtggtgtgtcctttttaggttgggtctctgcaaactttttagcatcaaactgggccatcttctcacacagtttcacttcccccaananancccggnactggggctggttaatgcaggtgaggancagcggttggtattgggaaaggctggcggaaa

SEQ ID NO: 649645 - DNA, 1003 bp, Homo sapiens
  misc_feature (422)..(422): n is a, c, g, or t
  misc_feature (515)..(515): n is a, c, g, or t
  misc_feature (641)..(641): n is a, c, g, or t
ccctggctgacatggtgaaaccccagctgattttttaattttttgtggagatggggtcttgctgtgttgctcaggctggtctcgaactcctaagctcaggcaatcttcctgccttggcctcccaaagtgttgggattgtaggcatgagccaacccacctggctggttttttccattttgatgaggtccagttgatcagtttctcttttatggatggtattttcatagtatctacaaaattgttgcctagcccaagatcactcagattttctcctcattttcttctagaacattatagtttgaggtcacatttgggtatgcaatgtagttcatctttgtatgtagtgcatagtatggagcgaggttcaattttttgcatatgggcatttggctgttccagtactatttgttgaaaatactacnttttaatgtttttcttttgaaaatgtaatacataaacagaaaaattcaaaagtataaaaagttcacggtgaaaattcagtatctcacattttncccccagttccttttttccagatgcaatcattgttaccccaaagagattccatgcttacacttgtctccctgctgctactttttttggaacagtgtcttttagtaggctcaaagtgaccttgttanaaagttaggttggtttacatatccacacttccccctctgtctcactgccttcatctcgtatggctctcctagttcctctctagccatcctgccctctttgcttctttcacacacaccaagtatgtttcccccctcccccagggtttttgtgcttcttaatcttttttgcttggaatcgtttttctgtcaggtatctgtaagacttgcttctttacacttttttaggcttcattcaaatttcaccttcttggtgaggtctagtttaaagctgtaaattgtgtcccccaactttctgtcgtctttcctgctttattttcctccatttcagttgtcaccttgtaagcatgatgaagtaagagatt

SEQ ID NO: 649646 - DNA, 383 bp, Homo sapiens
gtcggagtggcgagctggcagtacgggctctggagcagtttgccagtgtggtggaggccaagctgataagaacacacgaaggggattgtcaatgaacagtttctgctgcagcggctggcagacggtgccatcgacctctatgccatggtggtggttctctcgagggcctcaagatccatgagtgagggccaccctacgggccagcatgagtgctctgtgacacctggtgtatcgaggatgcatctaggatccgagagggcatggacgccctgcagtctgacccctggtacgaagagctctaccgcagcttcattggcttctgaatactccggacagagactgtttcaatattgtgtctcgtataagacacggttttcctttcg

SEQ ID NO: 649647 - DNA, 406 bp, Homo sapiens
ctcggtagctgtgactagcggcttgatctggctctgatctcaggcctgaccgggcttgccggatccttcgtacctagttcccaagaccaaggcccagtagaggagaagtgcacgcgttggcggcggtggtgcttgctgtgtgcgggtttgctgggagtggctgcagggatagcagggtgactgttccttcctgtcggcgggcatgttgatgttgctgagcagcttcgtcattaggacagagatgcccactaccttagaaatcagacgctttttggcttctggaagctttggcaccatgttgggggctggatgccggacgccggggcggggctgggtttctgctatctgagcctctctcactatgttcctcgaccgcctggcttgtgggtgccgaggctgttcttct

SEQ ID NO: 649648 - DNA, 87 bp, Homo sapiens
ctagaagattcagcaaagtacttttgtgctcttgggccccttcccctcatgggggatacgacgctgagctacaccgataaactcact

SEQ ID NO: 649649 - DNA, 164 bp, Homo sapiens
ataggaagaaatatacttagatagtacttagggaaatagaggtacaactatcatgactctgtttctttcctcgcagtctctctccttgggtgtctgagtgcctatgaaaatttttaagggcttgctagtttatgtggacctgaataaggtaggacctatagagt

SEQ ID NO: 649650 - DNA, 2423 bp, Homo sapiens
  misc_feature (7)..(7): n is a, c, g, or t
  misc_feature (19)..(19): n is a, c, g, or t
  misc_feature (121)..(121): n is a, c, g, or t
ctattanagactgttttanaataagttattaatatttgttgaaatggttccagataacaagaaatatgatgcaataaaacctgataaataaaagcaatataaagattagaatggttttgantaggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtaaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaa

SEQ ID NO: 649651 - DNA, 953 bp, Homo sapiens
tgaagagcaagtgggatgagtccatcttcacgaaaggctgcatccaggcgactggaaagctggtctcccgcggtaacatttacattgtggctggcgtcttcatcgccatctcgctgtttgcagatattaggcatcttcctggcaaggacgcctgatctcagacatcgaggcagtgtaaggccgtgccatcacttctgaggagcagaagttgagggagccgagctgagtccacgctgggaggccagagcctttctctgccatcagtccctacgtccagagggatgatggagccgacaccccctagagccagtgccccatcttaagcatcagcggtgacgtgacctctctgtttctgcgttgcataggtgcatgaaagaccaagggtcccccttgttacctgccacaaatcttgtgactgcatccctctggtagtctacccagagacagatgaatgtgtctttatgtagggacgtggtgactctgaaagacagtagagggtctcctgtggctgtcaggacgggcttgaatcagaccgccctgacagactcaagcatgtctgcagtgacaccctggtcccctcatccactggcatccagacatctgcttggggtcatccacatctgtgggtgggccgtgggtagaagggacccaacaggtgtggaccagggcatctctctcacgatcaatgcaaagcagcatgggggcctgccgtaacgggagtgcggacgtggccgcgaatgggaccatctgagtgccagagcagacatgcgtgggacatgcacatatcaggggcgacgtaaggccgggatgcgtcagaccaggatcaagtagaaagaaagcctgacaccaagagcgtggacaggtagccagagggagtggccagacacagggccccgggggcacacaagagcaacacgggacccggacggcgcggacggagaggagaagccggg

SEQ ID NO: 649652 - DNA, 1033 bp, Homo sapiens
aaagattagggaggaaaagtcgcttaaaaatatatatatagaaacacataaacaaattctacaaacattcatgcttacggctataactgaaaaaacggatgagccatcatagtattcctatcttactgaaagcgaagggttatttgtctaatctaaggcaaaaatgagggtggaaattgagtacaaagaaagatatctgggccctaagcatgctctaaaatcccaccatccaataaatcctgcaacttcattttccaatttcattatcactctcttaagtatttcaaaagatcagcatcgtcaatatcagtgtcccaatgactcaccagctctgacagcctcattctccaggacaaccctattaaaaataaaacggatatatttggaggggacaggcgttctagggccctctttgcccaacaagtgtagaatcttagtagccagaacagtgtgttcacagtcctcaatgaattcacaaaggtgggctaggcctgcttctttactctcagggttctcttccacaatgctgattatacagtccacaatggcccgcttgtactcaaagcctccctggcaaaaaagaagataaaactgccattcattctagggacacattttggagaaatgcttacactccaaggtttatgcttataatattcaaatttcatttcccaccttttatgaaagaagcaaaagtgtttttttctccaagtggggaaagcaaagcaatggcatgtttagtaataagacagtaaccagacttagtgtactacttgagaggcatactgagatgataaggaaatcttaaaacactatggtatttcatggcaatcctaagaatttaagacagcaacttcctatgattaaaaagtagtctacctacatcatctcggagcatgttggagaggaaagtcatcatgacactgtgctttcgagggtatttctgacagagagcactaattgcctgtacaaccaccaccttgaactcatctgagatttcagacacaaaagaagatatctgcttcatgagccc

SEQ ID NO: 649653 - DNA, 4271 bp, Homo sapiens
  misc_feature (7)..(7): n is a, c, g, or t
  misc_feature (19)..(19): n is a, c, g, or t
  misc_feature (121)..(121): n is a, c, g, or t
  misc_feature (3684)..(3684): n is a, c, g, or t
  misc_feature (3742)..(3742): n is a, c, g, or t
ctattanagactgttttanaataagttattaatatttgttgaaatggttccagataacaagaaatatgatgcaataaaacctgataaataaaagcaatataaagattagaatggttttgantaggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtaaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaatgtgatgtgtgtgcttatttctgtgaaaactgggtaacagttacgaatattgtgcactgaacatgagaagagaagaaatcaaggaggaaaatgatgatggggggaatcaagtagaataaatacttgacattcaccttcccaagtctccaaataagtaaatactactattggcactagttggctgtcttttaggggctatttctccaccctgcaaagactgcatatgggtcaaggagggaattaaaagcccttcttaatgtggacacacatggttggctaagctactcactaggctgagacatgctctcagacaccagccttatgctacaggaccttcaaaaatgatgtattttaaaatgccaacaatctactacataaccaagttctatctaactagatagaaactttgaggagaagagggtcaagattcttcacaggagaccaggtatatgaactctcacaagtggtcacattattccaacagaaagcttgagttcctttttgtgctactgctatacacactcagtttctcttttaagattaagtgttcagcaaattttactcagagatttagttttaaaattaatatttctgcagcagtaaaccattttataaatatatatattcacacacacacaaacacacacacacaaacactcatcattaaattctagaaaagcatcacattcttaaactgagcatttgaagagttgaagagctcacaaggaaatgcattctgaatcacgtatctcctcccttctgagggttagtacctgctgtagggtcatcatcaggcaaacgaacaagagtgtaacatattcctggttggttataaggaaggctgggggctgggatacaagacagcacttcataggaatctgatggctccatctgcactgtcactttttccagcagctggtcattgagagtgttggtgcagtcaaactggaacacgatgtgattggtaaacatgtgcttgatacatcgaacaaaatattctgtctctgcttctgtaagttgaacaggctcagaagacttgaacaagggtcctatattcagaaactcaggaatggcagccaattgttcttggaaaatgtcttgcctggaaggagccaacttctctggcttagtagccacaagtgtgatttctgctttctgttcaaagacaggagccatagcaagaggaattgatttcatgtcaaacggtttttctgaaggctccaacgtgtactggtgtaaggctttttccatccctggtacngagaccgtcaaaccattaaagatatatgtggcatttagtgccatctgcctctgctgcngcacattcagatagaaggtagctctgtctcgtacctcgtcatcagtatccatcatacacctctgtaagagtacaaggatgcttgggagaagactctcattctgagccccaaatttagccaaagcactcacagcagcagctctgacagcctcattctccaggacaaccctattaaaaataaaacggatatatttggaggggacaggcgttctagggccctctttgcccaacaagtgtagaatcttagtagccagaacagtgtgttcacagtcctcaatgaattcacaaaggtgggctaggcctgcttctttactctcagggttctcttccacaatgctgattatacagtccacaatggcccgcttgtactcaaagcctccatcatctcggagcatgttggagaggaaagtcatcatgacactgtgctttcgagggtatttctgacagagagcactaattgcctgtacaaccaccaccttgaactcatctgagatttcagacacaaaagaagatatctgcttcatgagccc

SEQ ID NO: 649654 - DNA, 4584 bp, Homo sapiens
  misc_feature (7)..(7): n is a, c, g, or t
  misc_feature (19)..(19): n is a, c, g, or t
  misc_feature (121)..(121): n is a, c, g, or t
  misc_feature (3684)..(3684): n is a, c, g, or t
  misc_feature (3742)..(3742): n is a, c, g, or t
ctattanagactgttttanaataagttattaatatttgttgaaatggttccagataacaagaaatatgatgcaataaaacctgataaataaaagcaatataaagattagaatggttttgantaggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtaaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaatgtgatgtgtgtgcttatttctgtgaaaactgggtaacagttacgaatattgtgcactgaacatgagaagagaagaaatcaaggaggaaaatgatgatggggggaatcaagtagaataaatacttgacattcaccttcccaagtctccaaataagtaaatactactattggcactagttggctgtcttttaggggctatttctccaccctgcaaagactgcatatgggtcaaggagggaattaaaagcccttcttaatgtggacacacatggttggctaagctactcactaggctgagacatgctctcagacaccagccttatgctacaggaccttcaaaaatgatgtattttaaaatgccaacaatctactacataaccaagttctatctaactagatagaaactttgaggagaagagggtcaagattcttcacaggagaccaggtatatgaactctcacaagtggtcacattattccaacagaaagcttgagttcctttttgtgctactgctatacacactcagtttctcttttaagattaagtgttcagcaaattttactcagagatttagttttaaaattaatatttctgcagcagtaaaccattttataaatatatatattcacacacacacaaacacacacacacaaacactcatcattaaattctagaaaagcatcacattcttaaactgagcatttgaagagttgaagagctcacaaggaaatgcattctgaatcacgtatctcctcccttctgagggttagtacctgctgtagggtcatcatcaggcaaacgaacaagagtgtaacatattcctggttggttataaggaaggctgggggctgggatacaagacagcacttcataggaatctgatggctccatctgcactgtcactttttccagcagctggtcattgagagtgttggtgcagtcaaactggaacacgatgtgattggtaaacatgtgcttgatacatcgaacaaaatattctgtctctgcttctgtaagttgaacaggctcagaagacttgaacaagggtcctatattcagaaactcaggaatggcagccaattgttcttggaaaatgtcttgcctggaaggagccaacttctctggcttagtagccacaagtgtgatttctgctttctgttcaaagacaggagccatagcaagaggaattgatttcatgtcaaacggtttttctgaaggctccaacgtgtactggtgtaaggctttttccatccctggtacngagaccgtcaaaccattaaagatatatgtggcatttagtgccatctgcctctgctgcngcacattcagatagaaggtagctctgtctcgtacctcgtcatcagtatccatcatacacctctgtaagagtacaaggatgcttgggagaagactctcattctgagccccaaatttagccaaagcactcacagcagcagctctgacagcctcattctccaggacaaccctattaaaaataaaacggatatatttggaggggacaggcgttctagggccctctttgcccaacaagtgtagaatcttagtagccagaacagtgtgttcacagtcctcaatgaattcacaaaggtgggctaggcctgcttctttactctcagggttctcttccacaatgctgattatacagtccacaatggcccgcttgtactcaaagcctccctggcaaaaaagaagataaaactgccattcattctagggacacattttggagaaatgcttacactccaaggtttatgcttataatattcaaatttcatttcccaccttttatgaaagaagcaaaagtgtttttttctccaagtggggaaagcaaagcaatggcatgtttagtaataagacagtaaccagacttagtgtactacttgagaggcatactgagatgataaggaaatcttaaaacactatggtatttcatggcaatcctaagaatttaagacagcaacttcctatgattaaaaagtagtctacctacatcatctcggagcatgttggagaggaaagtcatcatgacactgtgctttcgagggtatttctgacagagagcactaattgcctgtacaaccaccaccttgaactcatctgagatttcagacacaaaagaagatatctgcttcatgagccc

SEQ ID NO: 649655 - DNA, 207 bp, Homo sapiens
  misc_feature (78)..(78): n is a, c, g, or t
  misc_feature (109)..(109): n is a, c, g, or t
  misc_feature (130)..(130): n is a, c, g, or t
  misc_feature (166)..(166): n is a, c, g, or t
tgtgtgtatgtgtcttcccgggaatccaaaccaccccaccctcctcctgtcccgtggtttcatcatatctctttgcanaccccatgtcttccccagttgtcccctggantttggggggacatccccctcnggcatccttctcaaggggaagccaagagaggcatcnggatgggtgggtttctgattgtggcaacgtttgcaaccgtt

SEQ ID NO: 649656 - DNA, 1001 bp, Homo sapiens
ccgggacgcgtgatgggtgtcgggcgtgaccaggcctgagctccctgatctctcctcagtgacatcgtctttaaaaccctgcgtggcaatccctgacgcaccgcgtgatgcccaggaagacagggcgagctggaagtccaactacttccttaggatcatccaactattggatgattatccgaaagtgttgttattgtgggagcagacaatgtggggtctccaacgctagatgcatgcatgatccgtcatgtcccttcgctgggaaggctgtggtgctgatgggcaagaacaccatgatgcgcaaggacatcgccgagggcacctggataagacaacccatgctctggagaaactgtctgtgctcatatcgcgggggaatgtgggtctttgttgttcaccaaggaggacctcactgagatcagggacatgtgtgctggccataaaaggtgccagctgctgcccgtgctggtgccatggccccagtgtgaatgtcactgtgccagccagaacactggtctcgggcccgagaagatctccttttatccaggctttaggtatcaccactacaatctccagggcaccagtgaaagtcctgagtgatgtgcagctgatcaagactggagaaaagtgggagccaggaagcacgctgtgaacatggtcaaattccccctttttctttggggtggtcgtcagcaggtgttcgacatgggtactatagaacctgaaagtgctgatataccgaggaaatctgcttctcggctctggagggggtcgaaggtgcagtgtcgccgcaatggtaccactgtggtcgtacccaatattacagcggaaacagaaccggctgcgggaaggatacctcccctctgaaggacgctctggggcactgactggggcgccgtgttgcaccactctgttttgcctagcacagcgtcgcgcacgagcgtctcaacccacctcagctaacagggtccccctccattcgcggcgtgactatttcatca

SEQ ID NO: 649657 - DNA, 2683 bp, Homo sapiens
  misc_feature (7)..(7): n is a, c, g, or t
  misc_feature (19)..(19): n is a, c, g, or t
  misc_feature (121)..(121): n is a, c, g, or t
ctattanagactgttttanaataagttattaatatttgttgaaatggttccagataacaagaaatatgatgcaataaaacctgataaataaaagcaatataaagattagaatggttttgantaggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtaaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaaaaaaaaaaaaaaaaaaaaaaaaaaaaaaaaaaaaaaaaaaaaaaaaaaaaaaaaaaaagtcccctggcccgatttttccaacgtggggactgggccctggggttccccaattttaatcgcctggaagcggatacccctttggcagctggcgtaatagccaatgaggccctaccgtttgccctttccagcagtttgcgcacctgaatggcaaatggcaccttgtaagcctttatattatgttatgcccgttagattttggt

SEQ ID NO: 649658 - DNA, 711 bp, Homo sapiens
cggacgcgtggggtctcgctttgtcgccaggctggagtgcagtggcgtgatctcggcttactgtaacctccgcctcctgggttcaagcaattctcctgcctcagcttcctgaatagctgggactacaggcgcctgccaccaccacgcccagctaatttttgtatttttagtagagacggggtttcaccatattggccaggctggtctccatctcttgaccttgtgatccgcctgcctcgacctcccaaagtgctgggattacaggcatgagccaccgctcctggcccacttttttatacaaacagcttaggtagagtaagccattcttttttttctttctttctttttttttttttggagacagggtctcaccttggttgcccaggctggagtgcagcgggctcaaacatggttcgctgcagcctcaacctcccaggctcaagcggtcctgctgcctcatcctccaaagtagctgggacccacagacattgcaccaccattgaccccagctgattttggcagagatgggtttggccatgtggcccaggctgggccttgaactcctgggctcaagtgatcctctcacctgtggcctaccaaagtgctggcgtacccgggtgtgagccaccatacccggcccgagtgagccattcttatctctaagggcatggtgggaaccctcctggagtctatgtccttagacaccaccag

SEQ ID NO: 649659 - DNA, 131 bp, Homo sapiens
ctttctctggtatcatgcttgtgtattccttccccttgagtgtgggtggactgtgacttgcttctaaccaagagaacacagtgaagtgtatgcgatgtgatgtcatcattcctgtagttacgttacagaag

SEQ ID NO: 649660 - DNA, 643 bp, Homo sapiens
tactgggtcataccacttttatttatatggttatctatgttacatggtttattcaatatagaaaaaatatgaatacattcatagtattctcttttaattgggtaattccacattgtcaaatattgactgtttttatatggggtgtcctacccaattaaaaaaaaaagaggaagaatgacggggcagacagttctgtgtgtgtgccagtgtaatggatataacagcaatatcatatatgtctcttttttgaaacacctagtttgcgaaacgaccaagtgattaaactactgtttacgggctcagggaactgtttctcaagacaatagcaaattaattcattctttccccaagaaaaactcttaaggtgaaacctctctaaaaaacctctatgtgatcgcaggagagaactatgtgtatctccttaaacaggggcgtcagtgctgacacagaaatgttggcttggtagaccccatcggcaccaagggttctggcaccaaaagaaaatctgaggaccattttaaccatcaatttatgttcggagagcacagaaaagaccacatttagaagtccaggttccttctaaaacactccttgttcacaaatacgactcacatggattatatctcagactcatcaagcgtca

SEQ ID NO: 649661 - DNA, 446 bp, Homo sapiens
tgctgtttacatccgtactgacgctggaagaacatccaatggacaagatgctattgacgccacacccagcctaatggccgaggaacctgggcatcgccagctcttgtctccagtgccctgtctccttaggacctcaatctgatcccaaatctggctgtgtcccacagggtgtgtgggaagtggggggaacagtagaggatggctcgatgtcaagcagctacctctttgccccgatgtttcttaaaagcacaaattacactgcctgaagtaagcagttcccactttccctggggagccccaagaacagagtcaggcaaagggtggggagtccagggatcttggggacccctcctacgagagctgcagtctcttccctcaggggaacataccagaatgcatatcgatcagctctcagccaggcttcgacaatctcgcaggccccacta

SEQ ID NO: 649662 - DNA, 243 bp, Homo sapiens
tcgcttggtggctccgtctgtctgtccgtccgttgcgggtgccatcatggcggacgcggccagtcaggtgctcctgggttccggtctcaccatcctgtcccagccgttcatgtacgtgaaagtgctcatccaggtgggatatgagcctcttcctccaacaataggtcgaaatatttttgggcggcaagtgtgtcagtttcctggtctctttaattatgcttctaagcacatttcattcccctt

SEQ ID NO: 649663 - DNA, 160 bp, Homo sapiens
tgagatcgtagagagggataataaaatttacagctccatatttataaacttctggtctagggtggggcaagaactctaaagatgatcattctctcggctcgggatgacatcagatcaatggtgatggaacccacagtggtatccaggcatggtcatccct

SEQ ID NO: 649664 - DNA, 197 bp, Homo sapiens
tcacgagcaactactaactccggtctgatcaagtcccctcgacagcttacattttccttctacaaatccttgccctcccatggatatatgaacaaactccggtttctcatgatacgttagtacggttagctctgtacagtgatcacattggccagtggaaggactaaagagggatcctcttagtagtcgagcctgca

SEQ ID NO: 649665 - DNA, 373 bp, Homo sapiens
accggcgtgccgttccgcgtggtggtgggcgaccgcggcctgaaggaaggcaagctggaattccggggccgccgcgacgaagccgccactgccgtggcaccggccgatgtgctggctacgttgaaagcgcgtctcgcgcagtaatggagctgacccgcatgcgccgctacctgtctgccagcccgatagccgctgtgctgtgcgcaggggcgttgctcgcgggcacgcaggcggcgtgggcgggggcccagaaagaggagtacctggcggattcggtgcgcagtgcgctgtccgctgccgtggctgacagccggccgctgcgcccggtgttcgcgaacaatgacgagcaactcggctatctgcgctggcgggt

SEQ ID NO: 649666 - DNA, 615 bp, Homo sapiens
  misc_feature (1)..(1): n is a, c, g, or t
  misc_feature (430)..(430): n is a, c, g, or t
ntcatgactggagacagctagggttagttatctcctcaagaaacaaagcaaaacaaaacaataaataaacaaataaaaagagagtacatgtagggttgaactggagaagttagagggatcatgaaaaaaaattccatcttccatagctgaacaatataattaaaaaaaaaaacaaaaaaacatcagttttccagaaggacccatttccgggtcttcaagattttcttcagccaattaaagaaaaaaagacagaagactttcccccattcttatataattcggatataaataaaggcatactggttatgtaaaaagtataggtgtgtgagtgtattataagtatccattacagattatatagcataacggggcgttatagcacacaatacattataacacaaaaagtgtctaggaattataacatttgggnataagttttcccctttttaaaattgcactataaacagacttgagaattggggttcattataaaaataaagaactaactcttataccaaagtatcatgaagttatggttacacaaaatatggcccagcccacaaaatacagacaaggggaaccaccggtgttccccttggtctggtcccttgatct

SEQ ID NO: 649667 - DNA, 137 bp, Homo sapiens
gtgatgtatgcgagggcatgatgatagcgtgagaggaaacaaagagttaatgtatcgctgatggaatagtgcaagaaaggagctgccccacccatagtgtatcatctacaagtaggtactccggaggaaaggacccc

SEQ ID NO: 649668 - DNA, 144 bp, Homo sapiens
acacaccgatatcgagctggtaccgacgaaggcgatcctgtgtggctacaaggagccccttgtcctgcctcatcatcatgtgtgaacaaattccaagtattccatcttccttggaagatcttcctctgtgccctactgatatag

SEQ ID NO: 649669 - DNA, 834 bp, Homo sapiens
cccggagacgtcgaacaatgtaaacatgaaatgaggagagtagacaaacagaggagacgatcgaaaacaaagccaaggacagtactgaccatgagaagaccctcgtacgaaagacccagcgaatagtaggagaacatggataccacggcagaacatgacaaagaaaaacacaacacaatagaacataaatacaaaaaagcatagcaaacaaaagaaaatacaacgaaggaacaaaacagaaacaacagaaacacaccaaaacgaaaaagaatgacacaaagaaaaaagacacaaacaaacatacacgagagagaaggcatgaacacacagatcacaaaaagacagcaaacataacaaaatcaaacaaacaacacgaaaataaccaaaagagctgcacaatgatgaaacacaaaaacgccatagacaaaaagagcaaccgagacaggacccaaccaacaagacacaacgaacccacacaaaggaacaaaaggaaaaaagaaacacacaccaagacacaccaacaacacactcgaacaaaaaaagccaagaacagcaccaatgccagcgaaaaacaaccaaaacgtgggcacgaaaccaaccaaacaaatagagaaacaagaatgcaaagtagaaaacacggaagcaaaaaacaacacaaaagggaaagaaccaatggacaaaagcagaacaaaatgcaaacagaaaggaacagcaccaacaacaagacaaacaaaggggcacacaccaaagcacgaaagcgacacagacgaacagaaaagaacgtaacagacacagagaaaaaacaaaaaacaacacaggaatgaaagacaccaa

SEQ ID NO: 649670 - DNA, 338 bp, Homo sapiens
gtgtgctcgactgcaagctcaagagggtgtcaaagggaccaagaaaggcaccacccctgtatggtggcaggcaaaggcgttaaatagccactaaaccatggtcgctccactttcaggagaggaagggcatcctctcccaaagaagcaggtgacagtgcctgcctggccttggggaccacggctgtgcttccactccgcgccctgtttcacagacagaagtgctgctgtggtgggcacgtgggaatggtccatacgagaaccacacaggggtttctgagccagaccaaggtgccagctggacacttcccctccggggcacataaagggtccctgtccat

SEQ ID NO: 649671 - DNA, 227 bp, Homo sapiens
gttatcgatgccaccatttcctccatcacgatctggctgaatcacttcttttatacttggtctagagtagaggtctagcacgccgcagcaaatttccctgtagctttatctatgatccctggtaggcagatcatgatccataggcgagatcaaagttagtttccgaacaaggaggcaacgacggacatcacgagaggtgtaggctgaattctcatgtcttccttcta

SEQ ID NO: 649672 - DNA, 392 bp, Homo sapiens
tcacccccctcagcctcccaaaatgctgggattacaggtgtgagctactgggcctggctgggacaaggcctttaaccattatacactacccctctttgtctcttttaaccactgttgctttaaagtttattttgtctgatgtgagaatagctacccctgctcgcttttggtatccatttgcatgaaatgcttttccacccctttactttatgtgagtccttatgtgttagatgaatcccctgaaggcagcagatagttgattggggagttcttatccatctgtggttctgtatcttttttttctttttttttttttttttgagacggagtctcgctctgttgcccaagctggagtgcagtggcgcaatctcggctcactgcaacctctgccc

SEQ ID NO: 649673 - DNA, 1061 bp, Homo sapiens
aacaatggcaggtcgaggccgggtttaagtcggccgaggggcaaatggtagctttaaaccaaatgtgtcagcaagcatattaatgtaagtggaatgcaaactccaattaagtgtgttagattggatagacaaaacccagctatgttcattcacaggcttcacatatcgagtccaaggatgcagagtgaatgcgagaggccagaagccaggcaccacccacacatctgctacagctgttcacatctgacagcacggcctcaggcaggaggactcattagagatggagggacagctcagtgaccaagtggtgaggttaatgggatgacacaacaatgctaaacataaaagcaccaaagaacacaactccaaaatgtgactggaacagaaagaactaagaggagaaatagacaatcacagtgagagatctgaacacttgcctcagcagcaaataaagtgagtgttgttccagaatgtgtcctgactgaccactccctctggccccagtgaccatcctgccggacggccgtctcctccctggttgagcagccttgagcaagggtagcagtgggcagtgtgtggaggccagaggcctctcacgtccacccaccccaaaggcactgccctgggggacagctgagtgaggagagagggagacacccttgaagcagggaggggagagttggagggagtcacatgtgggagtgaagcccaggagaggaggaggggcagagcatgtgccgctgggggcagacaggctgatggagggagagggggagggctctgagcccagggtgagaccatggctggtacacattggctttacagaccatctttctatgtttggtaacccacttccttattttaaaatcggcaaatagaaaagacaaaacaaaaaaccggacttttttcggggcgaaacagattagggccgagtatatgtccgacccttctgtaagggggaatggggcccaatggagatatcaacgcgtctagggggccggggagaaggcgaactcgagacgaccccaatacgtagctacatcaactcatcgcagcgccca

SEQ ID NO: 649674 - DNA, 305 bp, Homo sapiens
  misc_feature (75)..(75): n is a, c, g, or t
gccaggtctagacgactgtgtggggccgtccccatgcacataggggatagagatattgacgcgctcgcgaccgcncgcgcacttctctatgatgcacgagaagtgctggcggggaccagcactgacgccgaccgtactgacaacttcgactgctcaacctgccgcgcccccgcacggattgccacagtggtggctgtccctttgccgatcctttcgttttttcggaggatgttgcgaagacatgtctgtctttgtcccagacccgcccttctaaaacagaaaagtaacccaaccgcaacaagaca

SEQ ID NO: 649675 - DNA, 176 bp, Homo sapiens
tgacactaccgtctctaccaaaaacaaaaaaaattagccaggcatggtggggcatgcctgtagtcagcagctgctcggggggctgaggcacgcgacttgcttgaactgaggcagggttgcagtgagcccagatcgtgccagtgcgctctaacctgggtgacagaaagagactccat

SEQ ID NO: 649676 - DNA, 402 bp, Homo sapiens
gcccgtgtgtatgactctagacggatccccccgcttgtatggaggcgaaaaattacgaagacgacttgcaaagttgagaagctcaaaccattagaggtagagctgcgacgccttagcagacctttcagaatctatgttcatgattttgcctacatgaggaagcgagaagaggagatgcgtgataccaacgagtcaccaaacactcgggtcctatacttcagcatcttttcactgttctgtctcattggactagccacctggcaggtcttctacctgcgaccgctcttcaaggccaagaactcgattgagtaatgactgaggcatatactcctcccaccttgtacctcagccagcagaacatcgatgggacgtgcctggactaaggaaatccaaagcaagcta

SEQ ID NO: 649677 - DNA, 122 bp, Homo sapiens
tgatctagaggatccgggggatgcgtgtttatcagaccaaagcgccgggccgcccccggcgggcgagagggctgacgggtggtttgatctgataaatgcacgcatccccccgggaggcgggg

SEQ ID NO: 649678 - DNA, 865 bp, Homo sapiens
  misc_feature (781)..(781): n is a, c, g, or t
  misc_feature (823)..(823): n is a, c, g, or t
caccaccaggccttccttgcaagagttcctgaaggaagcactaaatatggaaagaaaaaaccattaccagccactacaaaaacacactgaagtacatagaccaatgacactataaagcaaccacataaacaagtctgcaaaataaccagctagcatcatgatggcaggatcaaattcacacataacaatactaatatcaaatgtaaataggctaaatgccccaattgaaagacagagaagtgcaagctggataaagagccaagaccgattgatacgccatgtttaagagacccatcacatgtgcaaagacacacataggctcaaaataaagggatggaggaaaatctaccaagaaaatggaaatcagaaaaaagcaggagtcacaatcctagtttttgacaaaacagactttaaaccaacaaagataaaaaaaaaagacaaagcaaggcattacataacagcaaagggttcaacaagaagatctaactattctaaacatatatacgcacccaatagcagaggacccagattcataaagtaagttcttagagacctacaaagagacttagactcccacacagtaatagtgggagactttaacactccattgacaatattagatcattgagataaaaaattaacaaagatgttgaggaccttaactcagctctggattaagcagacctgatagatatctgcagaactcttcactccaaaacaacagaatatacatttttctcatcatcacatggctcttaaaaatgatcacataatcggagtnaacacttcttagcaaatgcaaaagactgaatcatacagtctntagaccattgcacatcaattgactcagattagaaatccccaa

SEQ ID NO: 649679 - DNA, 117 bp, Homo sapiens
  misc_feature (20)..(20): n is a, c, g, or t
  misc_feature (22)..(22): n is a, c, g, or t
  misc_feature (31)..(31): n is a, c, g, or t
  misc_feature (39)..(39): n is a, c, g, or t
  misc_feature (104)..(104): n is a, c, g, or t
ttcagggataaaatgggatngnggactaaanaatcaggntctggtccaatctgccagtcttcctgaaaaatcgaaaatacaccaggctgctatatcagagccancctggccagcact

SEQ ID NO: 649680 - DNA, 90 bp, Homo sapiens
gtaactttgaaaacattttatgtgcagccccctttaaaggatgcccatgtgctaatccatgaacctgtaaatacgtttacttccatggca

SEQ ID NO: 649681 - DNA, 161 bp, Homo sapiens
cgatacgactcgagctcggtaccgaatctcggacaggtggtgcagtcacagaaggaggagtgattcaatgtgcccgaaaggaagaacacatggcagaagtaagagaagacatgtatgtttatcagaagtgttctgagacgaaagagagacccaggcggtcc

SEQ ID NO: 649682 - DNA, 746 bp, Homo sapiens
taaccctgcaaaaacccttttttaacttttggagagcgggtccgctataacggaaaccttgtatgtttccaaacatcttgtagagtgtttcggggcgcaatctgggcttattggtcggcccgatgaaaaagcacatcactgggcgcactgcagaatgccatagactgaaggatattaacatgccacccctcaggcgcaggaccaggtgcagggtcagactcttcctggagatgtgtacaccaagaaacgagttgcggccattcttctcccagcgtgctttgccgtgcaaagattgacccctcgtgcgtggctcgggggggatcgcctttcttaatcttgggatttctgggcctccacattttcccagtggttgctcacgggggcctcccaccctccagagttgagtggctcttgtcacccggcatagagggggctcttccaccaaaagaactcggtcatataccacccctcttaagaacgccaggacaccagggtcgccggggtccaaacctcccttcgtggaatgttcgctagccgaaacaaaaattccggcccaatttccccagtgtctttgaccgtgcaaaaaatagagccccgtgcagggcccgagaaggaaatgcctcctaaacaccgggacctgggcccttccacatttctccaaaaaggggacacaggggcctccactacaaaggaagaaggcctagccggacaagggcatccaaaaaaaaacgtgaaaaccacactaa

SEQ ID NO: 649683 - DNA, 81 bp, Homo sapiens
ttctccggaacacagtttttctttaatttcagatttcaactattgcagaaagtgaagattcacagtcagtggatagtgtaa

SEQ ID NO: 649684 - DNA, 150 bp, Homo sapiens
cccaggcgtatgttaccctaatcactggtggtgatcagccaaactctcaggaacatccccagtttcaggcgattggccttccatttatggtaacaacatctaaaatccagtgccctctgattttttggtggtggtggtggtggtggtttg

SEQ ID NO: 649685 - DNA, 219 bp, Homo sapiens
  misc_feature (3)..(3): n is a, c, g, or t
  misc_feature (10)..(10): n is a, c, g, or t
  misc_feature (61)..(61): n is a, c, g, or t
ccngggtggncgggtcgcctggggccgggaatttggggccggactggccgatatggtgaanacctgtctctgctgggaatgcagtaattggccagacatggtgacgcctgtggtcccggctgctcggggggctgggccacgagaattgcttgaacccggaaggtgggggttgtagtgggctgggattgtgccactgtactccagcctgggcaacggagc

SEQ ID NO: 649686 - DNA, 449 bp, Homo sapiens
actctagagcatactatgctatgtgggtcagagcagaaggaggctggtttacctagagatcattcacttgcaggggagtcacaatgagcacaagctacctcaaggctgtgtgaggaccaggggctcctcaccatggtcagggtcttaagccaggagttctaaatcttgctttttgctcaagccagaagagccccttgccatctacctacattcatatagtcatttgacagacacacatagggacaggttcagaaacactggacactggtgcagtcacacagcaataaggccactatggctgggacctgtccccaaggcccgactagctccagagctagttgggccactcttcccggctgtccacagggctgtagcagatacgaggcctggggaataaagatatgagggaaactggctgggcgcggtggctcacacctgtaatcccaggc

SEQ ID NO: 649687 - DNA, 873 bp, Homo sapiens
gatgatcagtaacggctaaaaccaggcttatcccataaatcccgctgagcctgtcatagctatcaaattatacccagataaagcttctggtggctaatgacatggccatcacccatcgaggacacgggcaggaggggctctccgggagcatatggtcatgcggaggagacactgatcatatggaggctctgaagtactaatgtaggtcgatgccatacaacgacacttgtaaactctataaccaagtaaatgaatgacttatgtataaataatgaaattaatgcagaaatggacaagttcttcgaaactcatgagaacaaagatacaacatatttcaatcagggggacacatttaaccgcagtaactggacggaaatctctagcactaacgctaaacgccagcataaaaaagctcgaaagaggtgcaggttagcccggattaaataaattgacgcactcatatataagcaatctataattgttaaaacaaatctctatctctagaggtgaaagaaaccctacttttacgatgacgaaatgtcgcttgtacttaactgcacgaacaggcatataaaatagaaaagttatagaacccgccccacacgccctttatgattaaaaagtaccagtgtaacggtagtttatggcacgcctccccaccaaagatacctgaaaaagttcccctaaatggacttgtctcctatccatccgccgacagccaaccctacttttataatcccttaacggctttgattgtcatatgtaataatctcgctgggtctgcctatatactctcctcaagcactcatccgagatgtccacaacctcgcgaaacctactcctgctctcgtttaaaacgcactgcacccctcg

SEQ ID NO: 649688 - DNA, 168 bp, Homo sapiens
ataaggttaaaacttatataagtaaccccccccctatctgggattttcaatttttttttaaaacggcttttcccaatatgagactatgttaaagaccctattcatgcctcttagtttcttgctttctctgtgatgggggtggattaaaaagctctgttttggccgcca

SEQ ID NO: 649689 - DNA, 813 bp, Homo sapiens
accacttctcctactgccctcctctccccctgtcttgcctagtttataagacaggagaaatgggagaaaacaaaaagtgagaaagaaacagaagataaatagccagatgaccttggtgccatcacctggccctggtgttaataatatcaacccctaacctaaactacttgtgttatctgtaaattccagacattgtataagaaagcattgtaaaactttctgttctgttagctgatgcttgtagcctccagtcatgttctccatgctttcccagtctatcataataaccctttcacgtggaccctttagggttgtaagcccttaaaagggccagtaatttcttttatgaggagctcagctcttaagacacaagtctgccaaagctcccagccaaataaaaccccttccttctttaaaaaaaaaaaaattcatcttaatatactatttaacatatttttctcttataaaactctttataacaaaaatatctttaggtggggtcctcgtcccaatcttccttttggggggtatttttacaaattccagggcatttgctttttattttctttctcgggaaaatctctttctttattctcaattttatgtgctatgtcatttcttcgtcctttttttctagttatgttttttattcataaatgtccgctcttttattctctttttctaaacattaagcaaatacctctctttctcaaatgttaaaattggaacaggctacattttccttttaaatccctgttaatacatttcgtttatttatatatttttctatccttaagtggtgaaatcgtctaa

SEQ ID NO: 649690 - DNA, 257 bp, Homo sapiens
tatggaagactttatgactctcggaacgatcgtatacagagagatcaggttgtaccaagtatggagtgcaagcgcagattacatttggcctatacccgtgtggtctgtgattgcccttacgtaggcgtgtgagagtaatcagagctggattctcccgagttgctactgttccgtaatacaaaagtggtcactagactactagctgagcataatccctagatagcatctgttccagtagggtacagagccctaactac

SEQ ID NO: 649691 - DNA, 211 bp, Homo sapiens
gtcgtctctagcaggatcccccccggacataaggttagaggcggaacctacaattctggcctcctcctgttttttattttgtttcgttttttttgttttttcgccatgaagtgtgaacattacagaaggagctggcccctggactctggccactgctttggcccccgttgccctgtgctgtagcctcgctggctcgtgcctagtcgacacc

SEQ ID NO: 649692 - DNA, 716 bp, Homo sapiens
gccaggtctctgactgcgggcttgtcgctggtggcgtcggagccgaggcggactggtcaggatgatcacggacgtgcagtcgcgatcttcgccaacatgctgggcgtgtcgcgcttcttgcttgtcgtccctctatcactacgtggccgtcaagcaatcgccaagaagcaggattgaaagtggcgctttctccgcccagggttccaggacatagtctgaggcaagatggagggtatgaggggccttcacacttcacttcatccgttctacccatcagaagatacaaagcagtacacctggatttttccaaagcaagtttatttcctcagagtcttccttaatgcctatggaagaagaaggctgccactgaatagggcccagttataggggcttggtttttctactccctccccccaatataaaagtatagacgttgttttggtggtcctaaaaaattataggaacatgagcaagaccaaacgatttttttccggccgcttagccccgcagaaagtgtttctcagccatctcgtgtgtgccggcgccgcccacaagtgggacgatagccttgagccacgcctggccaaaggaacccccggcactcaccacgggtggggttgctcccaataaaaccgggggcccccaggtcttgaccacccccagaggagggtcgcgccacggtttcaccgggccacgggcaataatcagcggggggc

SEQ ID NO: 649693 - DNA, 768 bp, Homo sapiens
tgctggtttctccctagtggttcctgtcaccatgagctgcaggtggagctacctgccagtcccacgccctgtgcccacactcctcagcccttggctggttgatgggactgggcgctgtggagcagggggcggcgctcggggaggctcaggccgcacaggagcccacggagttcggggaggctcaggcatggcgggctgcaggtcctgagccctgccctgtgggaaggcagctaaggccctgtgagaaattgagcacagcagctgctggcccgggtgctaaaagcccctcactgctccggcggtggggccagctggctgctccgagcgcagggtccgctgagcccacgcccacccggaactcgcactggcctgcaagcactgtgcgcagccccggttcccgcccatgcctctccctccacacctctccacacctccccgcaagctgagggagccggctccgccttggccagccgagaaaggggctcccacagtgcagcggcgggctgaagggctcctcaagtgccgccaaagtggaagcccaggcagaggaggtgctgagagtgagtgaggggtgtgagggctgccagtgcgctgtcacctctcactaattatcccttagtttatttcttcgttcaaaatggagtttcgctcttgtagccaggctgcagtgcatggcaaatctggatcatgtactcaactctaagtcagcattcgtgctcaagctccatactgggacagccccacggattgtttaaaaaggacgaccgg

SEQ ID NO: 649694 - DNA, 174 bp, Homo sapiens
tttggcggcactcaaagcgattgcgagatgggggtattcaaaaaggccacatgacaatgcactatcgcgccctagctttgcaggttggcgcacgtgacgatgaaattgccactttggttacacaattacaggcggcggaacaagtagatgcagccgtcgcaacagacctactaa

SEQ ID NO: 649695 - DNA, 248 bp, Homo sapiens
tgacatatagaatcgagctggtacccccgatagccgacagtgccacattcaattacaatgtctcgacaggagtctgtatgttatattgccgtcgctacctcccctgggctggggaggtgtgtaattagcgcgcctgtctgctgtccttgtcgtgtggtagccgaaagtgaggctctctctctggaatcgactcgtgatactccggtatcggtgttcaccagtggtaagcacggcgagtagcatccggt

SEQ ID NO: 649696 - DNA, 921 bp, Homo sapiens
  misc_feature (524)..(524): n is a, c, g, or t
gatttcaccctgttggtcaggctggtcttgaactcctggcctcgggtgatccacctgcctcggcctccctaagtgctgggattacaggcgtgagccaccatgcccggccagaaggtattttaaatttataggctgaagctaaagttgtctgggttaccttatatgacctttttaacggttgggatcggattcttttccaacagaacacttgattatcattagaaatagttcacgccattgtccccagctcatgaaacgggtcgctgctcgagaagatgaggcacactgtcctcccatgaacaatgatgcacgaaacttcagccaggctagagcgcgcaacgctagcatcgcgtctgaggcctgaacgcgcatgaccatacaaggttcaggagaactctgggctcgtgcgaacacgtataatggcagggctacaacgagtcgatgcacaaccgagccacgtgaccggctctctcgctcctttcccctcctatcttcctctcttagactgcttgtgcctctagcgntgctacagaaaccaggggcagggcctgaactctacgcgctggcacgaagggagctggcgaactacgccaccacaccccaccccacgggccagcgaactctctccgcctctcccacccctctgcgttaccctgcacccctacccgacacagagccagcaccacccaaatcctggcactccagcaaacagcggcgacacccacacacccccctacaacccacgccaccccggcgcaaacgccgccacaccccgcgcaccccacccccaacgcggcccccccaccccgcaccgcccccctcacgccgccaccaacccgcccctcgcccccacaccacatgcacgcacccgccagacgcgggcaccacgcaccacctcccccccgacgccctacccacccc

SEQ ID NO: 649697 - DNA, 130 bp, Homo sapiens
ccgactagccggacaggggcggggggtacgtggaagactcctacctaccgagctcacaggcgctcgggtttgataaacaagagagctggagaggctgccctcaacagtgcgctgtcgggctagtcggggg

SEQ ID NO: 649698 - DNA, 373 bp, Homo sapiens
  misc_feature (368)..(368): n is a, c, g, or t
taatgctggctggtctggcctgagtaactgcttggtctgccagacctggctctggccctactctgccctggcatacccttgcctggctggagcccggtcctggtccttgtcctgccccagctgtggccctggcctgccctgcctgtgccctcttctatcctgggctggccctgccatggcctggtcttgccattgccctgccctagcctgctctgcttgtgccctagatctgccccggcctttgcccctgtcttggttctagccttgactcagccctggaccttccctgaccttgcctcagccctggcactaccctggccttgacttggcatttgccctactctctctatggcctggctctggtcctnccctg

SEQ ID NO: 649699 - DNA, 379 bp, Homo sapiens
  misc_feature (46)..(46): n is a, c, g, or t
  misc_feature (85)..(85): n is a, c, g, or t
  misc_feature (96)..(96): n is a, c, g, or t
  misc_feature (98)..(98): n is a, c, g, or t
  misc_feature (103)..(103): n is a, c, g, or t
  misc_feature (112)..(112): n is a, c, g, or t
  misc_feature (116)..(116): n is a, c, g, or t
  misc_feature (118)..(119): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (136)..(136): n is a, c, g, or t
  misc_feature (138)..(138): n is a, c, g, or t
  misc_feature (170)..(170): n is a, c, g, or t
  misc_feature (172)..(172): n is a, c, g, or t
  misc_feature (174)..(174): n is a, c, g, or t
  misc_feature (178)..(178): n is a, c, g, or t
  misc_feature (200)..(201): n is a, c, g, or t
  misc_feature (217)..(217): n is a, c, g, or t
  misc_feature (230)..(230): n is a, c, g, or t
  misc_feature (256)..(256): n is a, c, g, or t
  misc_feature (258)..(258): n is a, c, g, or t
  misc_feature (262)..(262): n is a, c, g, or t
  misc_feature (272)..(273): n is a, c, g, or t
  misc_feature (280)..(280): n is a, c, g, or t
  misc_feature (282)..(282): n is a, c, g, or t
  misc_feature (292)..(292): n is a, c, g, or t
  misc_feature (307)..(307): n is a, c, g, or t
  misc_feature (339)..(339): n is a, c, g, or t
gcaggcaggaggacatcctcctctctgctcaggaccaccacggganttctaggcactccacctcactgttcttcagaaagctgtnatgtgagcagntnctatntcggtaatnaagntnncnaaantnaaccatgcnanacccttcctcctagtccccatgctctcctggnancntggnagctctgcttacttccgtttgnnttttttcttttgttanttacattgctgtnctctttggtccttcttcatccttgantncacnaccttgaaannacctctnantccagcaggncggggaaattaacgnaccacaacatttatgagcatacaaaatagatnaaatggcgtaaatcaaagccaagcacagccttcttgttga

SEQ ID NO: 649700 - DNA, 108 bp, Homo sapiens
gatgcaaagaactcttataaataaaaaatactagcagacttatttttttctttattttttgagagagtcgcgctccagcctcggcaacatgagtgaaactccatctca

SEQ ID NO: 649701 - DNA, 603 bp, Homo sapiens
  misc_feature (5)..(5): n is a, c, g, or t
  misc_feature (185)..(185): n is a, c, g, or t
  misc_feature (221)..(221): n is a, c, g, or t
  misc_feature (230)..(230): n is a, c, g, or t
  misc_feature (279)..(279): n is a, c, g, or t
  misc_feature (300)..(300): n is a, c, g, or t
  misc_feature (310)..(310): n is a, c, g, or t
  misc_feature (315)..(315): n is a, c, g, or t
  misc_feature (334)..(334): n is a, c, g, or t
  misc_feature (344)..(344): n is a, c, g, or t
  misc_feature (372)..(372): n is a, c, g, or t
  misc_feature (600)..(600): n is a, c, g, or t
gcgcntgattccgggctctcatataggagagaaactgcccagggatctcagccaggacacctttagccaatctagccatgcccagtatgtggttcccactcctgtcaatataatccctgaatggcacaaactgcacaatgtctctctcagcatattttcccctagaggagactcttacatcaccnccatccaattcgaccattgcatcaaattctgccggnccaacaccnaccataattattgacattggaagttttgagggattaactatggactccnttagtctgggccatatctganaaaacaccanctgtnataataagaagcacaaaanactgggagcnatcctttacagaagaagcataccttgcnacatgattaattacaggagcaaagtgggggggcccatatagttgtacagatttaagactcctgtaataagcctccatgaacccctcaatgccatcacagttggggttttgaggattccatttaaagcaaatacgtgagaaatccttccatctggagggagttttgcaccaaatcctagagctggaaacattttatcactgttataatcttgaacaatttctcccactncct

SEQ ID NO: 649702 - DNA, 285 bp, Homo sapiens
ccccacaaacccaaccccctggtcaacctcaacctaggcctcctatttattttagccacctttagcctagcggtttactcaatcctttgatcagggtgagcatcaaactcaaactacgccctgatgggggcactgggagcagtagcccaaacaatttcatatgaagtcaccctagccatcattttactatcaacattattaataagtggctcctttaacctttccacccttatcacaacacaagaacacctttgattactcctgccatcatgacccttggccata

SEQ ID NO: 649703 - DNA, 152 bp, Homo sapiens
ggccccccccccctggggggggggggggaaaatttttttttaaaagggggccccttccccccccccccccccccccaaaaaagggggggggcccctttcccctttttttttttttttttgggggggggggttttttttttttttggggggta

SEQ ID NO: 649704 - DNA, 442 bp, Homo sapiens
agcaggctttatgtctcctcgaaagactggccatcgttactcatgtcatcgttaatggctgttactggtctaggctgagctcagagttccttcagcctggctgctgcttgtcaaggtggagggtcctgagcccagggagcaggtgggagtgccagccctgccccttctcctttattgggccagtggtcctcacttgtcttctggatgtttcaagagacccagtttcttcttttgtctgcatccttttcctgtttgttatgagtgaaacagtattgttgcaatcccagcactactcagaattaatcatcttttatccagctattgaggtttggtcaggaaggaagaaaaacacctgctctttctgtttctctagtgtggggcaaaatgggggctataaactctggccttcaggatgatgcctggtgcagggaatggcaaaaaa

SEQ ID NO: 649705 - DNA, 597 bp, Homo sapiens
gccccgcgttcaaacaaggttcccaaggagtgccccttctgttgggcactgcattttccgacgccggcggttacaaaaaaagctcgcccccacgcacggtttctaatgagcgtcccctgccccctaagtgtagaaatggactgttcatccccggctgttgttcctcatggcgcggcacatttccgcacacaggacctgggtgaaatgacccttccctagtcagcgaagcctactgttcatcaaatgagggctctggcccaaacaagaggaacacctcgtcgtaacaccagaccccatagaaagtgcggagatgtgctaacacccacactgggtttctccatagacacagctcctcctataacattttcttagagttctttcacaagaaccccccataattatgtctcaactttccctcccactatgataaagcactacctcacgctcagacatgataacccccgaacctccatcccctcttttgtatttatcagcaactttctcgcctccgagacaagaaggtttttaagggcccactttgcccccccccttccttcaaaagcgaccaacaaattggtaaacataaacaacataatc

SEQ ID NO: 649706 - DNA, 210 bp, Homo sapiens
tggtacctgcctcagctcctgagtagctgggatagaggtgccatacctgggtaatttttgcatttttagtggagagggagtttcaccatgttggtcaggttggtcttgaactcctgaactcaggtgatcctcctgcctcgggctcccaaagtgctgggattacaggcatgagccaccgtgctcagccgcaaaattctttatgaattttac

SEQ ID NO: 649707 - DNA, 346 bp, Homo sapiens
  misc_feature (179)..(179): n is a, c, g, or t
  misc_feature (216)..(216): n is a, c, g, or t
acatacacgtctcctaatccctcctaagaacccccctagattagcctttgtaaccctccttttacaaatgaggaaactggctgggtgtggtggctcacaccctataatcccagcactttgggaggtcaaggcaggagaatcacttgaagcccaggagttcaagaccagccctgggcaanaaaatgagaccctatctctacaaaaaaatttaaaganctaccttacaggcctatagtcccagctactcaggagactgaggtgggaggatcacttgaacccaggaagtcaaggctgcagtgagctgtgatcatgccactgcactccagcttggataacagagtgagac

SEQ ID NO: 649708 - DNA, 229 bp, Homo sapiens
tctgcccacctgagctgccgctgtgcgcctctgtgaccttgctgtggggcctgaccgctggctatgaactggcccggatatcaggcgccctgctggcactccaccttgactcttggctaacctgctcctagcaggaggtcctggcgggcagcctgctcccgggggctctgctcgcctccctggttggtggcttcctcattgactgcttatggaaatgactgctatggca

SEQ ID NO: 649709 - DNA, 744 bp, Homo sapiens
  misc_feature (655)..(655): n is a, c, g, or t
cagaacacactgacccgctggaactgacttgttgcttcaacattattttggacagaacaaagacgaagactactctgccaacctactatccgcctacaattgcctattctcttgctacctacaccaccattttaccatccatctcctgcttttgggacctgccatcaccgtcataggagatcgctgcttatctataaccaaccattagctacaaaatcccacacagttattccaacgaagactaggcagccaaacccaccctgatcactttgtacctgcatgacttgtacacaatacatatttatatgctgctatactaaccgccactatgcagctctgtaacgagagagccactacttccaccatttggacaaggtgaatcactagggctaccttcgtatactgaacatgctgaaacggcgctgcatacagcactctcttacaggcacttttgacaccggtctggaatgagtacggtgaaaccccggacgccatcaaagctgccatggtcctgcataaaagcagaccttggcctttcaatgctgatggcctaccttatgcccgactgacccaccactctgagactactgagaaccccttcccactgaggaaccgatctctcgacatgagtggtgatccctgaccaacctcactngtgagggggccgaagaaatcctttcaactttttttcaaaaggttatttcaccttgttaaactttcctttggccacatgggcgtttttat

SEQ ID NO: 649710 - DNA, 104 bp, Homo sapiens
tggggatagaagacttagcagttagaatctgaactctgaatgctgccctctgagttcctctacccaggacgagctaggctgatgtgtaaatcacagggtgaaga

SEQ ID NO: 649711 - DNA, 175 bp, Homo sapiens
agccgctggatgcaagaattctacttgtcgtgcttagttgctagacattacgtcagtctaatggatcatgcgtgtttgagctcagcactgtgcgtttgggcgaagacgaaggaccaaggcatagcatcccaaagagcctacggatctatagatgacggtacccacgtacggtacg

SEQ ID NO: 649712 - DNA, 133 bp, Homo sapiens
gccggcccaatttgacatgagcattgcgtgtgattatttggacagttagacttgccacgtggggtcagttttagaaattgtttctagctagagggactggtgtccttctaagtctagcatttggggtatggaa

SEQ ID NO: 649713 - DNA, 177 bp, Homo sapiens
ggcaacagaataagactccatctcaaaaaaaaaaaaaaaaagaaagaaaatccctcaagggaatgaaatatctctaaccaaaaatgatttgattacttgtgtctaaggtaacctctaatccgtctaaatttctataaatccatatgtgaattccccacgtgcatcatctttgggtgt

SEQ ID NO: 649714 - DNA, 795 bp, Homo sapiens
gcgcgtaacctccttggcctgtgtgcgaagctgtgtggaccaagcaatgtcagtgagtgtgtgccatgtattcttgagcatgtgctgcccagagggcccacactctactgtccccaccatcagccaacaatgccacctttgccctgtgtgtgccatgtggcaacctacaccaactcctcacaacccttcctgtgctagtgagatgctgcatgctttagcctgtgcagtatgcccaacattatatgccgaccctgcgctcatccaacatgatgacccattccttgtgagaacctgtgtgcccatgcagcactgtgtgtgcatgttgtgatgttgggatgtgaatggaagcttgtgttgaaacttggcatgccttgatgtgatgaaatggttgctttgtgttgttgttgtgtgcactccttgttccaatgtggccaatttgccctgtcttgcgagccacctccattcccttgcgtgtggcatgtgtctattgggctgatgggatggcaacaagccttggctccaccgcaaggccctccttcgtgagggtaaaataacattacatccccaggactgacgacgcttgggtctatgtgaagattgacacttgcaggctggtaattcacaatcttacaaaatgtgcacccgatttgaacctgtcgttcaacacgcttgggtttactggtggcacttgtcctttggcttgtgttcttgcgctcccgttgagcacgactgaccgggacaggctacttggttggagtgactatttgctattgctgaacctttgctccccagaag

SEQ ID NO: 649715 - DNA, 188 bp, Homo sapiens
ggtcggaccatgcgacggactgatcctgggctgaagcgctgacgaagggagcgagacgatgagcgaaacccaaggccaaggccctgccaagcgctggtatgtcgtgcatgcctactccggcatggagaaggcggtcgagcgcaacctgcgtgagcgcatcgagcgcaggatcagtccgttcgcatgtt

SEQ ID NO: 649716 - DNA, 983 bp, Homo sapiens
  misc_feature (423)..(423): n is a, c, g, or t
ggtcccgtgtgtttcgctgtggtgcttcttgtgtttgctgtttttttttgtgtgtttacccttctgttttttttgtgcggctttttttgtctctttcttgttcgtttgtcgaatttccgggtttggcttcgccggtttttgacgtgctcggttctgaggttctgccggttagagtagggtcatgcctattagtttccagtcgttttgtgtttatcgagtttctgtttaagggacctgtcgtgttataatgattttttatttagatcgtgttcgatgtacagatcggtatcgataatttatgtgcgatatatgggaatcgggattccatagtatattagttatatgatctatactgtgtcccgatgttgtagatgaaagaagatgctatttccgatcggtaagataaccttgataatgtataanctccgagagttaatgtaagcctgctttattccatagtgcggccctttaagaatttgtggaaaatttcagagaacgaaagtaaaacccgggaatatgagaaagtaatgctgtcaagagaagaagaaatgaagaagagatatatggcctaaacgaagctattcgactataagaattcttagaagactatgatgatgactagtatatgaccccaatattacagttggaagtgctcttcaacgaaaaggttgcgtgatagagtaaaggtaatggaagcagtatgaacgagttatggtagagagagaaggaggagcttgaggaaatcaggcagcgccttctggcagaagggcatcctagatccagatgcagggctccagaggatggaacaagaggctgagaggcgcagtcagccacaaatgaagcaagagagagagcgagagagggaacgggagcgagaaagtagaataaagacacaaacgggaccgagaagaacgccgcaaagaagatgcatacgaacgaagaaaacttgaaagaaaattccgagtgaaagtagcctgggctta

SEQ ID NO: 649717 - DNA, 539 bp, Homo sapiens
  misc_feature (50)..(50): n is a, c, g, or t
  misc_feature (81)..(81): n is a, c, g, or t
  misc_feature (86)..(87): n is a, c, g, or t
  misc_feature (89)..(89): n is a, c, g, or t
  misc_feature (98)..(98): n is a, c, g, or t
  misc_feature (105)..(105): n is a, c, g, or t
  misc_feature (143)..(143): n is a, c, g, or t
  misc_feature (148)..(148): n is a, c, g, or t
  misc_feature (151)..(151): n is a, c, g, or t
  misc_feature (154)..(154): n is a, c, g, or t
  misc_feature (163)..(163): n is a, c, g, or t
  misc_feature (165)..(165): n is a, c, g, or t
  misc_feature (172)..(175): n is a, c, g, or t
  misc_feature (196)..(196): n is a, c, g, or t
  misc_feature (199)..(199): n is a, c, g, or t
  misc_feature (217)..(218): n is a, c, g, or t
  misc_feature (220)..(222): n is a, c, g, or t
  misc_feature (230)..(230): n is a, c, g, or t
  misc_feature (232)..(233): n is a, c, g, or t
  misc_feature (235)..(236): n is a, c, g, or t
  misc_feature (241)..(241): n is a, c, g, or t
  misc_feature (243)..(243): n is a, c, g, or t
  misc_feature (250)..(250): n is a, c, g, or t
  misc_feature (252)..(252): n is a, c, g, or t
  misc_feature (280)..(280): n is a, c, g, or t
  misc_feature (294)..(294): n is a, c, g, or t
  misc_feature (308)..(308): n is a, c, g, or t
  misc_feature (339)..(339): n is a, c, g, or t
  misc_feature (352)..(352): n is a, c, g, or t
  misc_feature (360)..(360): n is a, c, g, or t
  misc_feature (363)..(363): n is a, c, g, or t
  misc_feature (388)..(389): n is a, c, g, or t
  misc_feature (391)..(391): n is a, c, g, or t
  misc_feature (396)..(396): n is a, c, g, or t
  misc_feature (399)..(399): n is a, c, g, or t
  misc_feature (446)..(446): n is a, c, g, or t
  misc_feature (464)..(464): n is a, c, g, or t
  misc_feature (471)..(471): n is a, c, g, or t
  misc_feature (504)..(504): n is a, c, g, or t
cggccgagcccagctctccgagcaccgggtcggaagccgcgacccgagcngcgcaggaagctgggacgggaaccttggggnacgcnngnccacgcaantcacctncggaggtcaccagcaccctcggaacccagaggcccgcnctctnaangtnacccccctngngaggaannnnatgggccctgcgaggacgatnggncgcgcccgcctcgccccnncnnncatccctncnntnnccttntngcttctntncacgctcggcctccagggcacccaggcngggccacgcccgcnccccctgggttgcncgggggagccgactgcctgaacagttttacngccggggtgcctngtttcgtnctngaaaccaacgcttcggtcagcaacnnanctacnttnttggagttccccaccgtgcgccggggttgggactgcgtgcgcgcctnctgcaccacccagaattncaatttngcgttagtggagttgcagcccgaccgcggggangacgccatcgccgcctgcttcctcatcaattgctt

SEQ ID NO: 649718 - DNA, 253 bp, Homo sapiens
caaatgtctgggctcaagttcctttctttgaactgctgttaccccacctgtaaaatgaagatggtgaattccacttcctagaaattatctggggggcagatgtctgtactgtgtgagtggccacagtaatcatcactataattcaacgccaccacctacgatttgttggaatgttctctcccagatacactgtaatcgcctgcctgttgtgtctcctgtctgtgccgatctctattaaaggactccctcttaa

SEQ ID NO: 649719 - DNA, 461 bp, Homo sapiens
ttatgtcatatgctgtttccctgttaaaactgaaattctacgatttagacttgtgggagtggtcaactcgagcaacagcgggcgttcagtgctgcgtctcgctgggcggagtgtgtgttgagttcatcaaactcccggcctgtgaaagctttttgactgtcacgtcctcatcctgcccgaagatgcctgatgcggctgacatgatgtgccacagcatgtgcccttgttgtccccagtgatcatgatgaccctggatgcctgcttgcctggcacagcttcacggagtgagtgccacctcgattctcggagtgatccagcatgcccacgcagccaacgaagtgtcagactggtctcatatttaataaagttggcagagtcctcaatgtgcatttcttctcttctcagtgggttgtcatgagttggcataccaggcatcgcagtgtgtcgctgccactacccca

SEQ ID NO: 649720 - DNA, 334 bp, Homo sapiens
gaggatccccccgccagcgcttaaccttagtggttggattaaaatgaacggattcgaggagccaagatggccgaatagaaacagtttcggtctacagctcccagcgtgagcgacgcagaataagggtgatttctgcatttccatctgaggtaccgggttcatctcactagggagtgccagacagtgtgcgcaggccatagggtgcgtgcaccgtgcgtgagccgcagcagggcgaggcattgcctcacttgggaagtgcaaggggtcagggagttccctttccgagtcaaagaaaggggtgtcggacgcacctggaaaattgcgtcactcccac

SEQ ID NO: 649721 - DNA, 423 bp, Homo sapiens
tcgatctagaggacctggtcatttcagttcttaattttgcttgcgtgagctcctcatttgctctgctcatatctttctgggtctgatagtaaggatgcacttacttatacagtggggtaacagttctaagctagtcctgacaaggaagaataaaatcagaatagggtgccctgcaatcccagtgactcaggaggccaaagcaggagaatcacttgaggccaggaatttgaaatcagcctggacaacacagcaagaccctgtctctaaaagaatagaaaaaaattagccagcatggtggcgtgtgcctgtagtcccagctatatgggaggctgaggcaggaggattgtttgagcccaagtgttccaggatgaagtgagctaagatcactccactctactccagcctgggagacagtctctttaa

SEQ ID NO: 649722 - DNA, 155 bp, Homo sapiens
ctctttaaacatatcaaggcatgttcctacctcagggcctcaacacccgctattaccttggcctggactgctcctctccagacatggtgaaaccccgtctctactaaaaatacaaaaattagctcggtgtggtagcacacacctgtcatcccagc

SEQ ID NO: 649723 - DNA, 505 bp, Homo sapiens
  misc_feature (1)..(1): n is a, c, g, or t
  misc_feature (372)..(372): n is a, c, g, or t
  misc_feature (409)..(409): n is a, c, g, or t
  misc_feature (421)..(421): n is a, c, g, or t
  misc_feature (439)..(439): n is a, c, g, or t
  misc_feature (452)..(452): n is a, c, g, or t
  misc_feature (472)..(472): n is a, c, g, or t
  misc_feature (495)..(495): n is a, c, g, or t
nctaaatgtcctccctctgacgtttccttctctccaactctcaacacccgctttgtccatttgttagatacatttaatgcaacaacgcttttagatctactttcacttttttaaaaggcaaaatttaatataagttattaacaagaaactatatcctaatttgtaatgaatttcaggggagattatattggatgttgttagtttgggaaagagctttggaacaatcacttgtggagacacaagattcctgggaggacagatatcacatctactaaaattgactttaaagccatctaacactgtactttggcttagatagggaatatacggaaattcttgggtcattaatactgatttagagtcatttgttcnttttcaaggattatcctctaggagtccatttaggagnttaatttgttcnttttcaggattatccacnttttttggggaanggatccacaggctttccggnggtggttttaaaggggaaaggcncggtatttgg

SEQ ID NO: 649724 - DNA, 156 bp, Homo sapiens
cgtctcgatcgacggtttctctggttgactgtgcgtgtctagtgctgtgacttctcttgcttgttggtgcaggtgtcttccttgcattcaagtgggccttagagatgctggagaagaacaaatggaattgctcgtctgcataaactgtaacggtgc

SEQ ID NO: 649725 - DNA, 462 bp, Homo sapiens
  misc_feature (25)..(25): n is a, c, g, or t
tatacttgaaggatgtgctctactncttgctcagaagcatcataatgactcatggcatgttcagcatccagctgatgagggtaagatggtctgccttacagatgaacgtgatagtcatcaggggccttgttcagttcactcagttcctttagatgacgtcgcggacagtctatcaggctatggtcgacacttggaatggcctatggtacaacaatagtgatccgctctggtatactcacagatgctggatcaccgagccattacgatgaagtttggcaggacagcaagtctgagtcatcatggttcggcaatctgcagtcgtgaaagcagcttggtatatgccacacagtcttcctggctcttagtacagcactctaagagcccatcaagtccttggatagtgctgtcattgttggtgtcggcactactagcgccgtctagggctaccgtcgtgcaggtctc

SEQ ID NO: 649726 - DNA, 420 bp, Homo sapiens
gacttttaagctaatattttaagattggcagacttaaaaatggtaaaggcatttctctgttaccattaactacgacttccatgttgcccgctctttccactcacaggccaacttaaaactagagtattttaacattcgcatccgaattttccaatgctagtataatatatatatatgcattagcctggtaggggttttcggtagagtgcaatgcacaaaaagaagatgtgtctataaccttttgcccatttccaaacagaggtgaattggacccgtcctgttgtgtgccttccggcttcctttggagtcacagagggataggagagctaaggctgagaatgtgatttcaggggataaaaattaatatgatcaggtcagagtctcatagccaggttttatgctacattaagcgtcgacgcg

SEQ ID NO: 649727 - DNA, 108 bp, Homo sapiens
atgtctgcagcctccagccaacagacctcaggaaatgaggggatgaacttgcagactctgctgcttgagatcttcaaacaagcatcagctgttttccactggcttcct

SEQ ID NO: 649728 - DNA, 120 bp, Homo sapiens
cagcgtacgtcgaatagcacaacagctatacagcgtcagaccggtagcccgcaaccagtaccaattacacgattaatcaaaacgagagggaacgaaacagaaggggggccacaggagcat

SEQ ID NO: 649729 - DNA, 364 bp, Homo sapiens
cacacttgaaaaatctcattccagagtttcctccagacagctctaatatatatgaagacccttctctcgaacttcatatccatggcacttagagtttaagacccaacacttgcaaattaggtctggaatggtctatgccattaaatgaatccattgtgctcaccaatatcattccatagaacacaccacacgtttaatacagtgccatatgcactctcctttttccaagccatatcacagattcgcaatattcctataggctctgtgcacaaaaacacatgtcatctatattctgtagtaacacacacactattgtggctctctaagattgatacacatgacacacatgtactctctcgtgcca

SEQ ID NO: 649730 - DNA, 774 bp, Homo sapiens
cagtattggggatatctcacaggacccacccctagaggtctccaagcctggacgagaagtcctgcaacgtgcctcctgctcaaagtcacaacagatggcctccgtgaccgagtctcttcaggcgtccagctggccccggcccatgcttggggccctcataggtgtctcatccttacgggggagactgggagataccttcatcgctgacctggttgtcggaggctctaccactgggccagatccagactggtgccccttggcccgatctgagcgcttggcccagtaccaacccagctctctccagaattgaagaggacgtgggccacccaggctaagtttgcccggccaggaacattccagaaacccccttggcccagtaagctgtgggccaggccaaccccttctggtcaccctgttggctatcacagacccctcccctcgtgtcagctcaggcagcttgaggcccccgagcccacacttgccggggtccctgctaatgttatgcgcccccccgccgctggaggttcgtaccgcttccttatgatcttttcccgagagcccagctcccctggaggccctgttggccagctctagcctttgccgtcgtgtaattggccccagatccttgtttttctcgcctcactttccccccagtgttctagagtcatgtgagcctcgtgtcatctcccgggtggcccccggctagatccccggtggttttgtgctccaaaattaaaagcctccgtgacccctgaggtaaaaataaaaaataaa

SEQ ID NO: 649731 - DNA, 1137 bp, Homo sapiens
tggaatctgaagtctggtgtttaactaatggaaaaaaaaaatacaaaaaaggtttggtctctcagtggcttgcccaccgaagccgtggcactaaaacagcccagcgcctcacttcggctgggagaaatatccttggctctttgggacatcaggctggagggtatcacggccaggttctccagccagctggggcacactttccccatgtgtttgtgctcaggtgaacgtggaaggcctgtgaacatagttcctcaaaggtctcattccaacaagaggggccaacggggcgggctcattttacgaggtgactctgtgccgaagaaataccctttattcactcaagtggattaaaagaggccccgtgaaagcgagaagtgcctttcattcgagccctttatagagaaccgccattaattcctgtggagccagagtgggtgccgcttctgcgggctcgtgatataccaagaggaatgtgtttcatgtgggtctccacagttccctccgtgtggttcctagagggtgttttgtgacccagggctagaagtgaccagaaggtgagaaattccaagagaagagcaccaattcactgggcgcagtgagagtttccttaaatttcttctggcgcctatcactggaagcgcaatggatctccgggggggcacacaacgggtggaacgtccaagagggggtacacacacgaagaaccacaacattattttccttggtgagtcaagcaccagggtggatattctgttaaatgtgagccattggggctaaacagcgtgtgggttttgaaagtgggggcgccatggtgtgccccaattttacgcatttcccttgaaaaatttttcttattagaaggtccccaaaaagttgcgaatataaccctttttaaatggggaaggggcggataaaaaatcccccgcggggggccccggtataccgggacccaggctcgtgcacaagggggcccaaaagggagcgcataaaaaaaagaggaggccgggtaaacaccgcacggcgacaacatactgggcttcgtacgagaacaaaccgcgcggagaccgacgaacacccagaagagcgggtgaaaaacgtcggcgaacgcacgcgccaggctacacgccagcagtgagg

SEQ ID NO: 649732 - DNA, 826 bp, Homo sapiens
tggggtggtggtcccaggatttatggaaaataatacagcactacaaaaaaaattacaaacgggtccccgaggggtttggaaattcatcccaagcggtgggcggggggaccggagggtgggacagaagcggggcgaagtctccaaagagcttctcagcaatttctccttatgaggtggtcggggattctacttctcaaataatttcctcgcgggactccaggggcgtgagaacctcgagggaacataagtgggtctctcctttttctctctcctcctcgcgggcagcttggagggaggaatacctctatagggggcctcctcggaaattccgactctcaaccagaagtggcggtgacaataaccgcgggcatactcgtgggtgcggcggagacttagagggcggggggagtagggggggatctcctcgcacacagacgcttgggtccggtggtggaaagtcgatgggcccagggcgcggtgatagtacctattctctagtgagtgaaccggggcctgcctatcatttcaggggttttgtggagtggcagacactgccggccccatggtgggaggtggctccgtgggaggacggtgcactggcaagcacagagtccctgacacactaagatcctgtacactgcggtgggggccccaagcacagggcttcccagggagtggccagggaacgcccccatatatattgggtcttcgtggggaaacaagcaagaaggggcccaaataaaatccgggggtagaaatcccaattgaagcggccctggggtggctgtgacaagggccagctgggagaacaagaggaatcccggag

SEQ ID NO: 649733 - DNA, 126 bp, Homo sapiens
aggaccttaattgaggtcgtgtgggcgggcgggcgacgagggagaacaggctcaatcgtcacccaggagactgctagcttctgggttaagcactgctgctctgaagacgcctctataacgtttgac

SEQ ID NO: 649734 - DNA, 145 bp, Homo sapiens
ctgattcttgaggtaccccaatgcagcggaatctggaggtgtctggtgccatgtatgatcagcaacagtggctggtggctaggccagtgacagtgaccagagtcagggcaacgggacagagcatgtgcaatggccatgggtaggt

SEQ ID NO: 649735 - DNA, 196 bp, Homo sapiens
  misc_feature (57)..(57): n is a, c, g, or t
gttttcaagccaaaccaggcctcccaacatgacatgtgccgcttccactccgaggantacattgacttcctgcaaagagtcagcccccccaatatgcaaggtttccccaaaagttttaatgccttcaacgtaggcgatgactgcccagtgtttcccgggctttttaagttttgctcgggttacccaggcatgctca

SEQ ID NO: 649736 - DNA, 426 bp, Homo sapiens
gtcgtctaaggatcccccgccacagcttctccgccgccactcgtgcccggcgccacgcttctccttgctgtcacgctacgactttactcgctcggccgatgcgtgcgtgaacgctgtacgcctgctctctggtgagtcatctgtcagttatgtcctctgtcagcgtccggccatcccggtccagtcgcaatatgccctggtgaagggcttacccctcgtgatatggtacagtatgggtaagcccgttcaccggtagtctatcacgattccagtggtacggccagagagcgtacagggatacgcacatcctgaatagcaacgatacatggctgcggtgttgaaggtctcaaacatcatcagattcatcttctcatggttgaccttctgtgtcaggcgggcctcagtcggcagcacgagaagtaccga

SEQ ID NO: 649737 - DNA, 238 bp, Homo sapiens
cagagctgaaagcatgcagtagctcagactctgatagagtgaggtagattgtggcagcgtgcaggtaaccgtctgcagttcgcataacagaattagaaggtgggggtgtcatggaatcttaggagccctgcatttcaatttgccaggctttgctgaaacacaggcaccctagtctcacctgagtgtcacccaccaatggggatcattcccttcagaaattcaactctcaggtattcgg

SEQ ID NO: 649738 - DNA, 803 bp, Homo sapiens
  misc_feature (10)..(10): n is a, c, g, or t
  misc_feature (62)..(62): n is a, c, g, or t
  misc_feature (102)..(102): n is a, c, g, or t
  misc_feature (156)..(156): n is a, c, g, or t
  misc_feature (171)..(171): n is a, c, g, or t
  misc_feature (194)..(194): n is a, c, g, or t
  misc_feature (221)..(221): n is a, c, g, or t
  misc_feature (252)..(252): n is a, c, g, or t
  misc_feature (272)..(272): n is a, c, g, or t
  misc_feature (298)..(298): n is a, c, g, or t
  misc_feature (302)..(302): n is a, c, g, or t
  misc_feature (304)..(304): n is a, c, g, or t
  misc_feature (319)..(319): n is a, c, g, or t
  misc_feature (343)..(344): n is a, c, g, or t
  misc_feature (370)..(370): n is a, c, g, or t
  misc_feature (412)..(412): n is a, c, g, or t
  misc_feature (426)..(426): n is a, c, g, or t
  misc_feature (452)..(452): n is a, c, g, or t
  misc_feature (508)..(508): n is a, c, g, or t
  misc_feature (531)..(532): n is a, c, g, or t
  misc_feature (552)..(552): n is a, c, g, or t
  misc_feature (777)..(777): n is a, c, g, or t
aaggggttgntgtgaaagtctcgggcgtgagcaggtacctgcttttgccgcttctggttttngcggacatccactactccccggctggttacaccaacttgnatgaaacgacttctcttgtgaactatcaaggggccgccagaatcacctctgcangttttggggtcagcntaggggctcactcctccagtacnaaggggccggggggtgaccacctctgngatgtccttgactttgtcatagcctggggcnttttgggcatctctctcacngctgcctttcttatccccattcttgntgtngncctccttccgtgtcngctttttctcctcctcagaccccnncggggctttgatatcctgtgcggggngcagctcttccttttgttgctggcaagtggtagttgggggangcctcaaagctcgngttgttccctcggtgcggggggggcngatgggcctggtagtctggccctatttcggcttattcttgggcttgatcggggcgncgtcgtggtcctttttttctggnnttcctgcttcttttttcccnttggtgttgttgttggggtgggatgggactacttctatctccaggtcccgcttctcccctcctacgctgaccttgattgagtgttccttgtcatccacagtgaaacaatgtgctgctgtcagcacaaagtactcagacaccacagcccccatacagctctcgtgtccctttgaagggcgaatgactgagatcttggcctgccatggttgcttgtggtaatcggtnccttcctgtgttcccaaaccatgcca

SEQ ID NO: 649739 - DNA, 657 bp, Homo sapiens
  misc_feature (339)..(339): n is a, c, g, or t
  misc_feature (470)..(470): n is a, c, g, or t
  misc_feature (525)..(525): n is a, c, g, or t
ggcacgagaagaaacttaggctctcattgttcagtaatacttccttaggtcttaagaggtccttgtgtctgcatctggatttcatacatgctcagcctgatgtgtgcttttcatttacttgccttggtgaactacttctcagccttgtgttgagatgtcctttcttctaaaaagtcttccccaatatctgcaaagtatttttttaacttttattttaagttcaggtgtacaagtacaggtttgttacataagtcatagggtttgatgtacagattatttcatcacccaagtattaagcccagtacccattagttatttttcctgatactcatcctgttnctaccctgcaccgtctgaaaggccccagtgtgtgttggtcccgtctacgtgccatgtgttctatcattagctccactcgcagtgaaatatgtcatatcccttattgcattagcatctgcattggactagtngctgctcgctaatctgaggaagagcctgtttcatgaatagatccctgtactctcngcattgagatgccattcaccggttagcttttaatgatgaagcttacacttatggagtttctttgaaatcccggaatggccttgaaatttttccgaaacgtttaaccgtgatggccctggtccctttctttcg

SEQ ID NO: 649740 - DNA, 1350 bp, Homo sapiens
gttgctctgcggcgtgggcgcggggctcttgcgcgctcgctgtgggcggtggcgcggtcttcgcgtctgggcggtccttgggcttggccggttattggctctgtcttgtcgtgcggcgttttggtgtttcgtctggcgtttcggtggcgcgggttggtgcggggtcctgctcggtccttcctgggcggttcggtgggccttcctttgtgctcgtgggcccgtgtcccgtgttggtggctcgttttcgtttgtttgtccggcgtcgcgctgtgtggtgcgtggcgtggggcttgcgggcaacgtttctcgggggtgggtgcgtgcggttctttgtcgcttgcggtgcctgggccctgttcgtcggggtgctcggtatggctgctttgtttggggtgctggtggttgctctgcttggtttggggtgggtggttgggtggctcttgtcgtgtcgcgcggtggtgtgcgtggcctctgttagggttgggtcttgctgcccctggttgtgccgcgtgctaggacggggtgcgctgcctgtgggccccgcgtgcctcgtgctgcgtgcggccgctagggatgccgttctgggctttcccagtcggttgttttccttggctctcgctcttgtgtgtgcgtccggtggtctgctgtgctggtcgtccccttggtcgtcggggtgagggtcgcgcggtgacttgctccgagtgtttgcttcgtctgcgtgcccccctggggcgcacgtgccttgtcccgtctgggactgtcgtgtcgtccgagttggacggtctgcccttggacggggaggtctatgttgtgcctgacgtggtgttcggtatgcttgtggacgtctcggtccttgggatggctgtcgcttgaggccatgttttcccgctcatgttagcgcgcgtttaggtaatcgtatgtgtggtactggagcacgctcgggagtcacgcttcgcttgagtcaaggagagagagatcaggtcctcggtgggcctgagggagcgccgagcgtcacggagtccaccggctgcagggaacttagaactctcggatggagaaacagctggcagctggaccaggatgctacagagtgctacatgaaccgcggaagaagaacgctacaacgacagcatgctgtatcgcgcaggactgacggaccaaggtcctggagtgaagactggtgcgatttggtcaaccagagagatgcccgtcatccgcttccaggaggagcgcaggctcagcgagctggccattgggaaaggggccctgggctagacgaggctgggccgatctgacttgtcgttcccatcaaagaaagcacctcaccccagcacatatgccacccgtgtt

SEQ ID NO: 649741 - DNA, 152 bp, Homo sapiens
tgcttgatgagcatgtgtgtgtatgtttgtgtgtgtgtgtagtatgtgtgtagtgtgtgtgtgtatttttggatgtgcgtgtatgggtgtgtgtgtaatgtgtagtgtagtttgcgcactgtgtgtgttgatttgcggtgtgtgtgtgtacc

SEQ ID NO: 649742 - DNA, 136 bp, Homo sapiens
cggagatgtcccagcaggaaaaggcagtcaaacacaggaggggcagtctcgagccaagcttcagccccagagcggcctgtccagcttgagagcagcagtgaggtgcagagcgagccagcagtgcccaagccggaga

SEQ ID NO: 649743 - DNA, 296 bp, Homo sapiens
atgcaggagaagaaggatgccaaactaagtcaaaaaaacggaacgcaaataaaaggaatgagcacggttacaaagtcacaggatgagtccctgggatctggggcgggagaaggggtgaatcaagaatgacttgagcttgttactccctagcaggctgagggcgtgacacagcagctcgatgacaaagaggtctattatagtttctaacactacaacgctaacttttggaacgtatctacttctagcatgtagacagatctctaatcgcctgccagacggtaagccgcaggaatgcg

SEQ ID NO: 649744 - DNA, 526 bp, Homo sapiens
  misc_feature (103)..(103): n is a, c, g, or t
  misc_feature (509)..(509): n is a, c, g, or t
catgtacagtagtgcaacatatagcgatatatgtcgcggtaccgcccgacgcgtgatgcgagttttctcggcatactttattgttggtcagaacacacgcccngagcgagctctgtatcgcatacagtgtaacaccagtaccgcgatatattatgaagtccctccagtatagaatatatattgatactgatatatataatatcgcgaaatcgcggttatatgagaatagcaaatagaaagagatagcgtagtactgtagtgacccacctttataccccgatgaagaaatatgaatgagtatttgtcctcgacatgatcagatagcgacatttgatggcctagaagactgtaatcacgtgttttttattattataattatcaagcgctacccgtaccagtcgcgcacgccgcgtacgttgccagcggcgctcggcgcatttaattttatataccaggcgcccgtacatacgctgctcaatattcgtagatatagcgagttacccagcacnccccgcgatcttatacg

SEQ ID NO: 649745 - DNA, 2150 bp, Homo sapiens
  misc_feature (1266)..(1266): n is a, c, g, or t
gtccggtttgtgcgtgcagggggcgcgccgcagggcacagcgttggtgtcgtcgtgctgcactggttgtggtcgcgcccaccagggtggggttggtgggttgtgcttgcgcacctgccggtggccgtgctgtggtccgcctgcggtcgggtgatcgcatggccggtgcgggggggagaacacggggggtgggggggaatctgttgtcgtgcggtggggggtcgcaaccatatgtctctggtgggcggtgcgtgttgtggctgtggttggcttgcctcaccaggcggcgcgcccgtcggttgtggtgtgccgcgggggagagcagtcttctgttgtgttgcggggggtgtgggctctcgctggggtggggtggcgcctcgtgcatgttagtttagtttctcgcgtgcgttgtgtgggggttcgtagcctgtgtttgtgtatgtgtggttggctgtgttgcgtggtggggggttcggcttcgtcgatgattctcgtgtgagggggggggcgctagctcggctccgcgtccacagcgtgggtgctgcgcgcccgccttgttggtttgttgtccgtcgtggtgtgggttggggctctgctgcgagcgggtggtcgcgcccacctggttggtggtggctggtgctcggcggtcaggtgtgggtggtccgcaggcgcacgggtcggtcgcaccacgtcgtgcgtgggctcgatgtctcttcgtcttcttggtggtgagtgttggggccgcccctctcggccgcgtcgcctgctgggtgggcgacagaacccgccgtccgccgtcggtcgtctggtgtgtgctggctggtgtctgctggtgtgtccgtccacctacggacggtttgggtggttttgctgacttgcattatccttctcctccggctgtcgcgtcgcggcgtccttcgggtgtggcgagctgtcatcggtcggctggcgtgcgtgctggtgcgtccgatcacagacggcaggggtggcggcggcgtccgcttcgctgcgtggtctgttgttggatgtagtgaccgctcgtcgtcctgcgcggcgctgttgccggaagcaggcgtggagctgtggttgggtagatgtggtgtccggctgtgtcggtgtcgcgccctccggcttcctcgtccgccggtgcaggtggtggtggggcagcactcttcctcgccggcggtaatgtggggctgcggcctcccccgcccagtggaggagtgatgatgattgggtgggggacggactacttgtaggtcgtctntgtaacagacgatgcgtcgcaccggccgcggtcgttggtcctcgtcagtgtttggctccggccgcgacgcgagcgtctgcttcgcggcggctactcgagcgcgtgggggagtcgacggcgtggcggccactcctctccgctgctcgcttgcgtcgcgtctgccggcctcctctgcgtcgtgtgtgacttcgcggcggcgggttgattttgcggcggcgcaccacgcgtcgccgcgtggtggggctcgctacactcgtcgcgtcgcgcgcgcatgtgcgtcgcgcgcggtggcggctctatatgcgcgtgcgcgcctcaacacgtctggtctgcgctctctcggcgcgtcgcgtgcggcctctcctcgcggtggagggagcgcgcgacgacgcgtgcggtgcggggccgttgtcggctgtgcgccgcgcgccgccgctgtggtcgcgcgcgcgtggtgggtgtgttgtttgatagaagttgtgggtgtgaagagagtgtgtggagtgagagaagataacctctgagttcatagagagtgtgttgtgtgtgtgtgtggtctcgtctgatgtgtgtgtgtgtgttgtatagatgtgtgtgagacacacagcagacaacactgggtgggtggtggtcacaaccgcagagagtatattgttgtgtgggaatgaaaatgtctgtgcacccgcgcggtgtcgtgtgtgttgtgtgtggaatagtgtgtgggcctctctccccacctgtgtgtcgccacgatcacaatataatatggtatgaaagcacgcgcggcggtattaaaaaaaaagaaggagaaaaaaaataatcgctgaggcaagatgatcgtgcttggggcgtgagaatgatggatctgattcccttgtgctgga

SEQ ID NO: 649746 - DNA, 938 bp, Homo sapiens
ctttgtgccccttaagcaatatgtggccggaaatctagttctacccggacatctttgcgctataaaaagttgggcccaccttatgttcttcggaccaaattctcccattttggcccgaagaaatttccctccatatggggaaatctccccgtgatctccctcgtttgcaataaagggcattctttctgtaaagccccttgaccacacaggtaattttccgcagccgcgacagacgtttccatattctgtcatgaaacacagcccgttgcccccaggaggcaacccggataggggggcgcaaaaatgtgtaaaacaatcgtgtgtggcttacaaaagttaagatcaagacgcctctcctctagcgttgttacactggcggggacccctgttttagggggagaaataatttcccgccaggatatttttcgttaagcagacccccttctgttaaactggtagttatacccacgccccgaggggagcgctgccgagtataaacgttttggggccccaccagatgtggctataataaaattgtgccgacaagttcatccacccgctctagcggaataggagggtgggacaattaattcccctgctgaggaaaggtggggctttatacagtcaccacccccacaccacaaaatgggggaccaccagcatacagttgtagtttctagaaaagaggaggttcccctgcaacatcattgtggtgctcaactatgcaatacagatacagcagtagaaataatatcccttgtaagcactactgcatttgcggtgaaaaattctctaaccccgtatcccccagaaaattagggagaggcacctttttaggtccatcccaggaggtttgttatcaaaaagtgcgaccacccacccccttggtttttattagcccccaacaaaggcaaaattattttccgcaaaccaaaaca

SEQ ID NO: 649747 - DNA, 300 bp, Homo sapiens
  misc_feature (45)..(47): n is a, c, g, or t
  misc_feature (51)..(53): n is a, c, g, or t
  misc_feature (59)..(60): n is a, c, g, or t
  misc_feature (96)..(96): n is a, c, g, or t
  misc_feature (145)..(145): n is a, c, g, or t
  misc_feature (195)..(199): n is a, c, g, or t
  misc_feature (215)..(215): n is a, c, g, or t
  misc_feature (223)..(223): n is a, c, g, or t
  misc_feature (226)..(226): n is a, c, g, or t
  misc_feature (245)..(245): n is a, c, g, or t
  misc_feature (263)..(263): n is a, c, g, or t
  misc_feature (295)..(295): n is a, c, g, or t
  misc_feature (299)..(299): n is a, c, g, or t
taacagacgaggtcaacgatccctcccttaccatcaaatcaattnnntcannnatagtnntgaacctacgagtacaccgactacggcggactaatnttcaactcctacatacttcccccattattcctaagaaccaggcgacctncgactccttgacgttgacaatcgagtagttctcccgcttgaagcccccannnnnataataattacatcanaagacgtntancactcatgagctgtccccncattaggcttaaaaacanatgcaattcccggacggtctaaaccaaaccanactna

SEQ ID NO: 649748 - DNA, 156 bp, Homo sapiens
  misc_feature (20)..(20): n is a, c, g, or t
  misc_feature (133)..(133): n is a, c, g, or t
  misc_feature (141)..(141): n is a, c, g, or t
  misc_feature (151)..(151): n is a, c, g, or t
ggtcctcggtgttcatggtnacacatggtatgtgttcctcgctcagctggggcaaagtcgtggatctctttcccggatgacccagctccaggctctccacccggaccccgggttccaaggtccctggaggttncttcatgnaaggttctgncttgt

SEQ ID NO: 649749 - DNA, 106 bp, Homo sapiens
gctcgactcttaggatcccctgatcttccgtgccccgactcttagcgacagcaggctgcctgctgtcgttacgtacgaaaccccgacccaggggcacggaagatca

SEQ ID NO: 649750 - DNA, 529 bp, Homo sapiens
gtcatggtggtgttgagagatggtcagaggggagaagtaggggaggaggccagggagttgctgggtggggatctttagtacatgtcgaagacagtcaacaggatttcctgacagactggatatggggtgtgagagaaggcaggggtcaaggttgagtttgattgttactgaaattattaagtaattttaaaaaacactactgcctttcccaatcctaccaagtatgggatgctagattaaagaaatctcttcaggctcattgcagtgctcatgcctgtagtcccagctgtttggtaagcagaggtgcgagtatcttttaagggcaggtgttcgagaccagcctggacaacacagcaagatctgctctttacaaaaatatttttcaaaattaaataaatgtagctaggcatggtgatgtgtacttgtagtttcagctactcaggaggctgaagtgggcagatctcttgaggtcaggagtttgaggccagcttgggcaacatagcaagacccctcactctacaaaaaaaaa

SEQ ID NO: 649751 - DNA, 332 bp, Homo sapiens
catgttgaatggaataactgcatatcaccatgagtttgttttgcttttcaaacagacttgtatgtgtcatttgagtggtttccagattggagcgaggttattctgatctaaatgaacagcatttttttccttagcctctgtttgccactctgggggtgtctcctattgtcaaagccattagaaatgcataaaacctagagacatggtttcccccccaaaaaaaatgactttaaactagataatttactactgacctttcacagagaaaaaatatttcccttgaaaaaaactgggcttgtcattttttcccttgtagctttaagcaaagacat

SEQ ID NO: 649752 - DNA, 1710 bp, Homo sapiens
gctccctattcggattactgaatgctacgccctcatcggaacgccgtcctcacacaccaatggaacgagtctcgcgactatgactgcagaatcgctctggactcatcgtccgttgagaagttcctgacgtgcaatccatcctaacaatagactcatctagtgactcagtgtccatcagacgaatgcaacggtacatccaccgaggacgcccatcagcacgctcttctccattcacagaatcgcacctcaacaatcgacagtcgaaagtacggttcaacagtccactggcatggaaggcaatccgcttccacgtgtcaacgggcccatgtggcggacgcatccaaataataccattcactccatggcttcattgcctaccacgatcgagggacgaggctcttaatgaatttacggacgtcagttgtcgtgcatagcatgcacgagaaaaccctggaaagacccactcagaggccattgtagtcaccgtcgcttggaccttgcggaatataagataaggcgaagacagtgccatgtcaggtagacaggctaagtggtaccattaccccgaaaggtgagggagacgccatagagttactaactaattgtactttggacggggacgaggccccaaccaaggtaacaattataaccaacagaaacgtaataaaccgtgaatgccccggtcgcgaatcgcacgagtcaagcaagttaaaggggggaaacaatgatggcccttgtagtgtgcaacattcgtacaacttcaataggaagggtaacgcgccataacacttcgatggtcacacgtaagcaatggtctcgccaaactcggcgtactagacatcaggaaatgggccggtgtataaacaccttggtaccaactttgtggcacttcagttagacaccccttgggcgaataaacatctcagtctatggcccccattaagcgcaagagcacgtttgcctaattccttcctcgtaattcttcatttgcgcacagtagaaaaaccccgaggggaatttcaaaaaaagcgacacagaccgccccctataaggggaaaaataactaatggcatacctggaagtttcgcgggagtaaaagaggattcaacctcgttagtccaagttcgcttattatctttaaggaggtaacctccaaggaaggatcggatactgtccgtgcttggatagcatcatcgaaccgtaccagagtccgttcatacacctcataatggttgaactaggatgaaaacccgaccgtgaatatacctttgaggcatagaacacatcccccgttaagggcgaagcccccaagtgaagtgacatattagtaaatcgcgataagggtgcaaaggcccgcgtgttaaacagacaacttcgcctttccccccacaagcatttccaaaggggccgccgccaattttcgaatacatttatctccataatcatacaaggcggtatattaccgtaggataccattccccgtagtaggccctgaggccgcctttcaaaggagaagatatcatggagaagggggcagtaccagttgataggcgcccggaaatttaacaataatcacgaagtccgttcgatgtccgtaagagggagaatgaacattagccacagtagcgtcacaaataattaatcacagatagcagcagaggaagggacgatacaagatatatttccgtcgccacatataaaggccgacag

SEQ ID NO: 649753 - DNA, 542 bp, Homo sapiens
gcgttcgacggcgcgcacgggctcggcggctggcagtggctgttcctgctcgaagcgctgccgtcggtgctgcttggcttcgcggtgctgcgctggctgcccaacagcatcgaatccgcgcaatggctgaacgccgacgagaaacgcacgctgcgcgcgaacctcgacgccgatccgtccggcaacaagagccacgcgctcggcaaggcattctccgatccgaaggtgtgggcgctcggcctgatcgacctgtgcgtgctgctcggcctgtacgcggtgagtttctggctgccgacgatcctgcgcgacaccggcgtgaaggacgcgtatcacatcggctggctgatggtgatcccgaatgccgccgccgtgctcgcgacgctgtactgcggcgccagctccgatcgcgcacgcgaacggcgctggcatatcgtcgtcccgttcatggtgtcggccgtcgcacaggcggtcgcggcttcgtcgtcgcacggcacgctaaggacgattctgctgttctcgctgatcaacgcaggcgcggccgc

SEQ ID NO: 649754 - DNA, 419 bp, Homo sapiens
ccagaacggacgctgttagggttggttttactaatcaaagtctccatcaagagcgcatctgtgctttaccacttggggaagtcacacttgaatcagtggttgtgggttaagtaaaaactccaagtggtggccaggcgtggtagctcatgtctgtaatcccagcactttgggaggccaatgtgggaggatcgcttgagcctaggagtttgagaccagcctaggcaacatggcgaagccgctactctacaaaaaaaaatatgaaaatcagctgggcacggtggcatgtgcctgtagtcctagctactcaggaggctgaggtgggaggatcacttgagcccaggagacggaggttgtggtgagctgagatcatgccactgcactccagcctgtgcaacagaacgagactctgtctaaaatta

SEQ ID NO: 649755 - DNA, 246 bp, Homo sapiens
  misc_feature (77)..(77): n is a, c, g, or t
cagcatcgacaccatgttcgctgaactggggaaagtttggccgaaatttgacggtttcgtacactctattggttttncacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcg

SEQ ID NO: 649756 - DNA, 428 bp, Homo sapiens
gttggtacttgtcacagatgcacctgggtaggaagcgtaggcagtgttggggtcctggagtggggtcaactgtaattctaggatgaagtcgtccacgccagccttgtagcgctggtaggccaggaaggccagcacaccccaggagaagatggaaaagaagctgaaggtgatggctgccctcacagagtcggcccccaccagcacgtccttcgggttggtgactgcccactggtggtttaggaagcagaaaccaacaaaccacaggaaggtccagagagctgagaagagcaggtcaccaatgaccaggtacttgcggtcagtggcgttgctgatctggggggaaatacgcgtcgaccaccaagaagaaggcctgaggcctggaaggccagcaccccgatggcactgccatcccagagtgtctggacttg

SEQ ID NO: 649757 - DNA, 227 bp, Homo sapiens
atgaggttgatctagaggatcccattaggcgcgttctgcgtgcactcccagccactcgggaggctgaggcaggagaatcgcctgaacccaggaggcggaggttgtggtgagccgggatcacaccattgcactccagcctgggcaacaagagcaaaactcttgtctcaaaaaaaaaatgtggattctgtggtcctgaccaggtctctggacgcagaacgcgcctaatt

SEQ ID NO: 649758 - DNA, 124 bp, Homo sapiens
tacacagtctcagtgatgatcaaactgacctgcaatgtgacttaaactgactgcctcagaacttaagtaagagagcaaaatccagttaaagctcatgatgtctaaaattcaataggatattact

SEQ ID NO: 649759 - DNA, 869 bp, Homo sapiens
tgggtaaattttggtacaattttaaatagcttaaatggtttttacggccaaataaaaacttgctttaacaatggggggggttgggggtcacaacattcgactcaactctcaggtgctcgggcctccttgtgcgtggggcttgtacactttgaacaatgtggaatgtggaactcctccatggagttgacgggttcccatgtggaacgccacgcacttactccttgtggggacccccactgtgcaccatttaacgagatgttagagaagagtgtcgcccattttttcaccaccccgagagagatagagccgaccccgagagagttctcgagtgtgccccgtggcttttcgagggccgagagagacacccagagtttgtggggggagagtctcgaggatacagcgtgaaaagagcgcgtgtctctttgacccgcgagttgtgtgagagtggcccagggtgtgggggtctcctcgagagcccctgtggggcacccccgtgtgtggtaatctcccccagagtctattatagagagggggcctatttatctattgagagaggggctctagagtggtgagagcatcgtgagggggttttggggcgaatagtgagggatattagtgcccgcgcgggtgtgacaacagaggtgtcccgagctctatataatatcccgccgtaggtcgctgtggataagaaacccctcctcccccccaaagactcttgtgtactatattcggccgacgttgctcccacgaccagcagcggttttgaccgaggggggggacgaatattggtcccccccctatagatgcgccgggggtctggggtgaacgttttcccccccgagtgcgccaaattccctctttgtggtggg

SEQ ID NO: 649760 - DNA, 141 bp, Homo sapiens
tcgtggatccacgctgttgctgcgtgcatgcctttcgcatggtacttgagcatctcaggactctcaatgacggctgtggagagctgggcctcggtcatgatggctgggctcttgccataggtggactggtgaatgcgtccg

SEQ ID NO: 649761 - DNA, 201 bp, Homo sapiens
  misc_feature (52)..(52): n is a, c, g, or t
  misc_feature (107)..(107): n is a, c, g, or t
gttagagactttgggtgaccaggtgcgttacaatgagcagtaatatttttanagaactcttcttttctaagaggtagatctcaacaatgggcttaaatattcagtanaccagccaccgtgaacagccaatgtgccttcttatagtgttctactcattggtcttgttctgcccagtgataacaatgggataacgcctgctac

SEQ ID NO: 649762 - DNA, 133 bp, Homo sapiens
  misc_feature (14)..(14): n is a, c, g, or t
  misc_feature (71)..(71): n is a, c, g, or t
agggggggtagggnctagctggagtggtaaaaggctcagaaaaatctgcgaagaaaaaaattctgaggtantaaataggattatccgtatcgaaggcctggacaggtggtgtgtggtggccttggtatgtgcc

SEQ ID NO: 649763 - DNA, 811 bp, Homo sapiens
ggagtgcccaacatggcggcggccgtaaggtgcatgggtagagccttgatacatcaatcaagaggctatagccatttccaaggatggatttattcagacatcacgtttgttctgtgtcctagtaaacatccagagatgcccaagagacagttttgctgctgacttacaaatgtctgctgaagaaaaacgataaaaagagtgctaaaagaaaagaacagcgcagatgagaaaaaaagatgaaactaggaagaagataataagcatatgccactatatggaaaggtcgaatcctgaaggatgatgtctattctaaaagcgcttatagcccgatgacaggatatatgatggtcggaggaaaagctggttcacttacttaagaaatttcgaaattcttgacgtttacatagtccaaaagctaagagatgttatatccattgatttcgacatctggtgatagtgtgctactggtggaaaagaagaaatatacgtggagcctattgtaccagatgttgcttagtgttgccatagcccatgttgctatccgaaatcaagtaaatgtcggctgtatttacagagaatgcatcagaggtcaaaatagtcggaagaaaatggagctgtattggcagagaggcactagtgctgatacagaagatgagggatgatgaacattgtcggcagactttcacgtatgctgtgtccagaaataatgcctgaacgtaatcgattaagggatgaaactgagtaatcaaagtatccgaaagctgtctcgaagattccatggggcgtgaacatccccaaaatggttgaatta

SEQ ID NO: 649764 - DNA, 268 bp, Homo sapiens
tgctgtgcgtgacatcgcgccccagaagtgatctcaccttccttcgagtgggtccaagaaaaatgaaatgatggttgcaccagataacagactatctcctgattgtgattcacgactccaaccgcataagccactctcttggctccctgtgtcattccttaatttactgccccccaagaatgttaatgtcaatcatgtgggtggactagcacatggcagtcgcttggaatccactcacaccaatccagtgaccgtgtatggtcgggct

SEQ ID NO: 649765 - DNA, 605 bp, Homo sapiens
gagagtaagtgccgcctctgtggtgctctgtgtttcaccttaaaagctctgccaagcagaggctcccgtgcagcgaagagacgctgctcagcaagcaccatcaaatttgccatgctggctggtggaagagtttgtggtagcagaagcagtgctctccatgctctaatttcccgggcctaaaactacccctcgactgtggtcacacaggatatgtcgcgcaaaatcacctgcagctcatctaacgagaaactgagttcaaaagctgccgctcagcctttgcatggaacaaccgcttatcctcggaagttcagaagcgggctgtcgatgtgtgtggccctgatcttcgctcgtcttgtcatcatacgtcagcgacaatcggacagaaaggctctggaaaaggtccggaagcaaatcagagtccatcatagctacattccacaccttgtatcctgggtcttagcagaccctatctcacacacgtgaaagtgacaactggactgatttcgccctcttggctcttcgcagccctcgtggtcggaagtcaccctatttacacccatcttcattctttcagatcattaatcgagcagaaataacaacgacta

SEQ ID NO: 649766 - DNA, 725 bp, Homo sapiens
  misc_feature (725)..(725): n is a, c, g, or t
taacccctccttattttatgcgctcaaaaaccaatttaaacccccccccccttgtaaagggggggcgggaaaaaacaaaaaacgcaaaacccgctgggaaaccaccatttcctgcccccggccatttatgcgccctgatggggatttgggtgtttcacatctggtcccggtggctggggtcgagatgtggaaggttgagacgcctccggggggggccttgtgcctttggagccccttgggagatctgtcaagaggggatgtggacagaaggcacatctgtgccggctctggctctcggggagacatggggctggttcccaaaaatttcctgagggcgaagcgggcgggcgtgtggggcgacaggaggtcctccctccaggtttgccagcgagaggggtcgctacagggaggtcgccaataggaggaaggtggtgcgtccctctgggctgggcccttagagtcgttggctcctgagcaggggagattggtgggcgtcaccgtgtgttgcttgtaccacgagcgggtgtccccactaccgcggcttggggagcaaggggtggcgccggccttccgcgaactatctttgatggatcccttctcccctctccctccgggagactttttggcctcgccccttaaagaacccttgtcttagtcttccacgggtggggcccagactctcctgggtggacctttttggggggcaggtcggttttaacgctctn

SEQ ID NO: 649767 - DNA, 469 bp, Homo sapiens
tgacgctgtgggtgtcatatgtaggtgagggtacagtagaaggaggcgatgtccagagctgggtgagcacctgggtagcaagcccagccaggactggctggtggaagggttcaccgtggaggcattggggaagtccaggccctcaggaatgctttccaacagcactgattcgcaagggtcatagcagggggctgggcgctggttgggacgggaagagatgcaagtcgacgtatacccatagaaacagatgagtcatcagggctccgatagcccacaaccgacagaatgaggaacagcaggacccagcgggcttacttttccgcagccttcaacgcctcaatctcatacatgggcagctcattggcgggctcctctgcaggcaccttcagctcctggtagattatcaaaagcctcttcctttcctcctctctttcctgtccatgtccctgctggtgctgaatgcaggtgg

SEQ ID NO: 649768 - DNA, 678 bp, Homo sapiens
  misc_feature (201)..(201): n is a, c, g, or t
  misc_feature (269)..(269): n is a, c, g, or t
  misc_feature (278)..(278): n is a, c, g, or t
  misc_feature (282)..(282): n is a, c, g, or t
  misc_feature (284)..(286): n is a, c, g, or t
  misc_feature (291)..(292): n is a, c, g, or t
  misc_feature (306)..(306): n is a, c, g, or t
  misc_feature (310)..(311): n is a, c, g, or t
  misc_feature (413)..(413): n is a, c, g, or t
  misc_feature (416)..(416): n is a, c, g, or t
  misc_feature (426)..(426): n is a, c, g, or t
  misc_feature (467)..(467): n is a, c, g, or t
agcagactctccccggaataaaaaagagaaatcttcataatgaattataaactaatgattaatgtccccaaagaaatctgctttctactatatctttcagcattagagatttttctgttcttgaaaatacagtctgtgctcttgattttgctatgtacggtttcatgcatttttttaaagggcattgaggggaggattatngctatgaatgaaaaaaatattttagcttagactaagctacctgccttcaaaatagtttagggacaccncatatttanttgntnnnatttnngaacattttctaangatnnggagagaaaatatttacaaaaattccacatatcagtgatacaatttcttgctgtcaccaattttttataatagcagagtggcctgttctaagaaggcatatnttnaagtatcttncagggtaacatggaaatactataaagttggatgtcaaattnaatatgttttcagtgttctctaattttttggaatttttgtagactttacacctggaaaaaaacatttgtaaaatcaccggaacaattgtgtgctttattttataggtagtggttattagtattacatccccattttaaaaacaaaaacataataatggttacaacacgtggagttttactaacatacatattaaatcaaagtatattctta

SEQ ID NO: 649769 - DNA, 443 bp, Homo sapiens
ttgtgaaatgtctattcaagttagtttgcccattttctattgtggtgttctgtcttttgaacaaggaggttcttaattttaatatagcccaatttatcattgttccctttatgcttagttcttttatgtcctgtttaagaatttttgcagccaccatgcccagcccaccttttactttcttaatggtgtctttttcttattgattttaggaattccttacatatcctggatatgaatcccactatgtggcttacctttttccttctttctttttgaaacagagtctccttctgtcacccaggctggaatgcagtggcgctatctcagctcactacaacctctgcctcccaggttcaagcaattctcatacttcagctactcgggaggctgagatcacgccactgcactccagcctggtgacacagcaagactccatctaaaaa

SEQ ID NO: 649770 - DNA, 735 bp, Homo sapiens
  misc_feature (708)..(708): n is a, c, g, or t
  misc_feature (726)..(726): n is a, c, g, or t
  misc_feature (735)..(735): n is a, c, g, or t
aaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtcccaactgtttttcaacctcttcctaaggacctttgacaactggtcttgtttacaaaatgtttgggnccctttgcttcctttaanccccttaan

SEQ ID NO: 649771 - DNA, 189 bp, Homo sapiens
tgtgtaccatctatgtcctctcccctcccgttttgttacaatatcaggatagcactcccagtgccactttggtctcagtgtaagatccctattaactatctgaaagtgacaatagaagcaagaactctggtctcaaatatatagtaatttcctttctttagtcttcagtgactattgtttgaaaacaag

SEQ ID NO: 649772 - DNA, 535 bp, Homo sapiens
attccgatccccctcccggcgccgctccagcctagggtttcctcccgccgcccgtcgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcgatatcagcaagtgccagttctaccttgacatgctgaacgagtgccgccgtggaggagcaactctttaagctactatctttgcttgacttggggcttaattgggcagaacctg

SEQ ID NO: 649773 - DNA, 180 bp, Homo sapiens
aatattgctagccgtaataaatcaatgtggctgggtgtggtggctcacacctgtaatcccagcactttcggaggccaaggtgggcggatcacgagatccggagatcgtgaccatcctggctaacacggtaaaaccccgtctatactaaaaataaaataaaaatgcaaaaaacttagctgg

SEQ ID NO: 649774 - DNA, 719 bp, Homo sapiens
  misc_feature (655)..(655): n is a, c, g, or t
cagtctgctcccatcagcatgcccccgatatgagacatggcgccaaaggagattatttcagagatttaagatttaatgactgccccactggattttggacctgtgcagggcctatagcccctttgttttggccaatttctctcatttggaatgggagcatttacccaatgcctgtatccccattgtatctaggaaggaactaacttgtttttgattttacaggcttataggcagaagggacttgccttttctcaaatgagactttggattatggactttgagttaatgctgaaatcatttaaaattttgggggactgttgcgtaggcatgattggttgggaaatgtaaaaagacaagagatttggatgggctggggcagaatgatagggtttggctctgtgtccccacccaaaccttatctcgaattgtaattcttatgtgttgagggagggaactataatctccacatgttgagagagggaggtgattggatcatgggggcagtttcccccatgctgttctcatgatagtgagtgagttctcatgagatctgatggttttaaagatgttttgaagttcctccttttctttctcttgctgcactgtgaagaaggtgcttgtttcccctttgccttatgccatcattgtaagtttntgaggcctccctagctatgtggaactgtagtcaattaaacctatttcctttataaatgaaaaaa

SEQ ID NO: 649775 - DNA, 185 bp, Homo sapiens
ccctacttagaagagacgagatgtacaagagaagagacgagatgcacatgccatgtacagcatgaggggctgctgaagcccctcaccctgagtatgggagccatcttccacagatccaccatccccatcgtgggcattgttgctggcctggctgtcctagcagttgtggtcatcggatgctgtgt

SEQ ID NO: 649776 - DNA, 1696 bp, Homo sapiens
ggagaactagtcgcgagttttttttttggttttttgggagattaggggtggtttaatttaaaggggcgtggagtctatggtaatcacaggagggccagtatggtcccaggaacaaagggggagaggtgttaattttctgggtcttcttcctcctgggataaaggtctggatgagatctccctcctttctgggctcgggagggcgcttcttacaggggcgctgggcggtggcttctctggggtcctataagactctggggggctctcagctcgtggtgtgcaggccagggaggctttctgggcggggctctggtgtctggcgcttacagtctgggtgtggatgtggtgtctcccatgagagagaatcccggctgggtgttgtggagaacacaactatatcaccctcttaacactctatcacaggtgtgaccaggggtgtggtgggatcaccctctgtgtgtggcgagaaccgagatctctatctctataagagatatacaccgagtgtatatacatatatctagagaaagacaagcggcgcgagaggcgcgaccaaacatatccctctcacatatatctcttatctctcaactatctccctatgtgtgggaacatctttatctctctggagaggaataattcgccgcgcggggactatgagtgggcgtagtggagaaaccctctataccgcgagggttataaacatcttatatgtcgcgcccattggtggtgctgctccttggagcgcctcatattacacggggcggggtggtgcggcccaaacagtggtgttgggtgattatacaacaccggggggcagtattaacgcaagaagcggcgctccgtggggagcactattggggtgaccgccgaggtgcccacacaagggaggcttatttgaggggaggtaggcattgaggaatacccacaggagcgcgcccaattctcattttgtgtgcggatttgaggagcggtctcttcccccgggggaggacatccaccttgcagtactagaaggacacggaggagagactgtatagcggcggccctattgcgggggcggcgagaaatatacaccaataagggggggtccctcaacaattaggggaggggggctcccttaaaacaccccagagaaaccccttatgcctgttgctatgggggccccaacaaacggcggcgggaagggggacaccaccttcaacaaaggggggcgagagagagccccactattatcatagagaaagcagccccatgggaaagagcaaattaaccatacaatgtgggaacttaggggaggccccagcgcgcaaggagtcatacaccccaaacgccgcaagtattttccactagttggtgcgaacacccccaagtgggggcgacatcggggggacccatgagaaaatagacccactgttgggcggacgggcctatttgggaaacaaccacgggtgggaccccccctttgatgaagaaaacggcttgcggatgccatgggagagaggagccctcaaacagggggaagaacaccctataaaaaagccggagagatacccagggcgaaaagatccactcactaatcgcgacaagggaggaccgagacaaatagggggggccccgggatactcaagagtagtcccacacaatctcgtggcgggacaacacgaacaatcaaacacaacagggcggggtgcgaa

SEQ ID NO: 649777 - DNA, 825 bp, Homo sapiens
  misc_feature (519)..(519): n is a, c, g, or t
tggagtcagggtctgtgtcctgcgctcaggctggagggcagtggtgtggggatcacggctcactgcagcctcgatttcctgcaccaccacgcctggctgtttttttttttcccggaaaaaacgggggtctacaccggtgtggcccaggccgggtctagaaccttccggggctcaagcgaccccctcccgccctcggcctctccgcaaatgctgagattacacgcgtgagcccccgacccggcctccttttccaccgtttctgtgtctacagccgcccctcctgggctccgattgtttgggcagatgtcgccaattacggtgtcaaacggcgaaggggcactgagcgttttttctttctcccgtccttgtgggggcagcagctcggtcccggctagcggggttgagcccgtctctcagacgaggaaccgggggcccgagagggtgacccggtcccagaggcagggcaaggggaaaccgggattggggcccgaccggacccagccttgccttcccccctgnaggagatcgtcaatttaaatggcccgaaagcgggtgggcccgcacaatgccgttgttccgccaaggcgaaaccccaatttcggtcacgggccatgttgaccaacgctaaatttcggggtctcccaccgcgggggagaaaacatcatcccggaagggcgcactgcgggaagaaaaatgtttccatccacagcgggcgggcacgggggctacaaaggggagcagagaatataacccgccaagggccacaccggaaaaattagcggcacccgggcgcccagaaaagtggggggacactgcaacataaag

SEQ ID NO: 649778 - DNA, 645 bp, Homo sapiens
atggtacccgatggtgggagagaaggcgctaatgagaagtaggacagtaagatatctaccaggaccctagcagaccaccctccactgccagccagggtcatcttgctagagcctctgaggtcgcaccaaagcaaacagagcgggtgcgacatgtacagtggtgcgcagaggcaggacccaattggagtgcagaacactacctaatatagctgcaacaacatcaaaggcaaactgatgcaaagcaagcttggtgctcacattgttattctcttatttagaatgtcccttggtaataaacccctttccagcaggcccttctcagaagctgactgctggttcattggtgttattctgtgatgccttggccacacttttgttagtgtatttaagaatttgtagggtcttcatcacatgtcctgtttagtcagcctatgaggggtactgaatttgtggttactatgcccatcaggtcttctgggcaccctggtcaagggctgtttgattgatgctttccactactcgcagcaaaggttttgggtaaagggaagtgaaaggattccagtagtctgtcatggaggtgggatgtaggctgagggagaaggatcactacaagcacagcaggaagtcactggtgtgaagaaccct

SEQ ID NO: 649779 - DNA, 141 bp, Homo sapiens
tactccgacgcgatgacgcctccgaccggccgcgatccgctgacgatcgactaggtcgcgatccgcggcggcgacgtatacgtgaacccgcgcaccgaggtgcgcctcccggtgtacggcgcgctcgagacggcgctcttc

SEQ ID NO: 649780 - DNA, 437 bp, Homo sapiens
cacgaggcgcacggctccaacgacgcccagaatacgatgggcatcatcgcgctgacgctggtggccgcgcaggccgacggcacgctggacaacctgccgtcgtggctggcgttcctgcatccctcgccgaatgcgctcgccaacaacgacatcgacgcctggatcaaggtcacctgcgcgatcgtgatggccgccggcaccgcggcgggcggctggcggatcatcaagacgctcggccacaagctggtgaagctgcatccgatccacggcttcgccgccgaaaccagcgccgcctcggtgatcctggaggcgtcgtcgctgggcatcccggtgtcaaccacgcacactatctcgtcggcgatcatgggcgtgagcaccgccatgcgcttcaacgcgattcgctggacggtggtggaacggatgatctgggcgtggat

SEQ ID NO: 649781 - DNA, 749 bp, Homo sapiens
  misc_feature (52)..(52): n is a, c, g, or t
  misc_feature (64)..(64): n is a, c, g, or t
  misc_feature (77)..(77): n is a, c, g, or t
  misc_feature (116)..(116): n is a, c, g, or t
  misc_feature (134)..(134): n is a, c, g, or t
  misc_feature (230)..(230): n is a, c, g, or t
  misc_feature (233)..(233): n is a, c, g, or t
  misc_feature (242)..(242): n is a, c, g, or t
  misc_feature (255)..(255): n is a, c, g, or t
  misc_feature (258)..(259): n is a, c, g, or t
  misc_feature (264)..(264): n is a, c, g, or t
  misc_feature (266)..(266): n is a, c, g, or t
  misc_feature (280)..(280): n is a, c, g, or t
  misc_feature (288)..(288): n is a, c, g, or t
  misc_feature (296)..(296): n is a, c, g, or t
  misc_feature (303)..(303): n is a, c, g, or t
  misc_feature (311)..(311): n is a, c, g, or t
  misc_feature (325)..(325): n is a, c, g, or t
  misc_feature (339)..(339): n is a, c, g, or t
  misc_feature (374)..(376): n is a, c, g, or t
  misc_feature (393)..(393): n is a, c, g, or t
  misc_feature (398)..(398): n is a, c, g, or t
  misc_feature (402)..(402): n is a, c, g, or t
  misc_feature (412)..(412): n is a, c, g, or t
  misc_feature (422)..(422): n is a, c, g, or t
  misc_feature (459)..(459): n is a, c, g, or t
  misc_feature (477)..(477): n is a, c, g, or t
  misc_feature (554)..(554): n is a, c, g, or t
  misc_feature (578)..(578): n is a, c, g, or t
  misc_feature (586)..(586): n is a, c, g, or t
  misc_feature (599)..(599): n is a, c, g, or t
  misc_feature (605)..(605): n is a, c, g, or t
  misc_feature (620)..(620): n is a, c, g, or t
  misc_feature (624)..(624): n is a, c, g, or t
  misc_feature (638)..(638): n is a, c, g, or t
  misc_feature (662)..(662): n is a, c, g, or t
  misc_feature (665)..(665): n is a, c, g, or t
  misc_feature (679)..(679): n is a, c, g, or t
  misc_feature (682)..(683): n is a, c, g, or t
  misc_feature (727)..(727): n is a, c, g, or t
gataatcgcttttgttgttgttgttatagaacaatgaaaattcctgttaggnacccaagttgcngtttatatttgcntgttctcttaaatagtatgggaaggggtgggggggggcngttgggggggcccatcgngggcctttggggtttttcttcttggttccgtcctctcccccaccgatttttcagggtgtggtttcctagtctccgggggtgtccggtttagttgcnggntatgggggntggccgtagtgcntcnngggcncngttcgggtgtcccncggggccntttcgggncggggcncccttgtncgggtcgggggggncgcatcggtgcccntccccttccgggcgcggggcgggcggtcggcgggnnnggccggcgggggccccnccccnttgncggtggcccncggggggtcntccgcctgcccggggggttcgccgttgctgcggtccnccatgtcctggtggcggngatttctgtattcatcaaatgttagttttaattgaggaaagctccttaaacacaggttctcagtgaatttgtcttcntccgtgccccatctgttctcaccngctttatngagaatctgggcntcttgnttggccagatgctcntccnctttcagactttcntctcttctgccctctgcccaagtncanagagctttccgggngtnnccagatgtttcggcactaatgtcttctccaagactcttcctgcntactgcataataggcctgggcg

SEQ ID NO: 649782 - DNA, 205 bp, Homo sapiens
attcggctctgtaccccagcatgatgatcgacagaatgtagtggcatggtgcggcactgcgatcagaagcccgcgtggcgtacgtgccagttcatcgaatgcgctgtagtccgttcggtcggcgcgactgagcagggacaggaactcggtccggttcccacgccgcagaacgttggcaacgaacagcttctgcaggtaccagtag

SEQ ID NO: 649783 - DNA, 792 bp, Homo sapiens
taattaaaagaatttttttggagacggagtctcgctcggtcgcccaggcaggatggcaggggcataactggggctcacggtagcctcaacctccggggctctagagttcctcccgcctcagcctcatgagtggctgggaccgcaggcgcatgctaccatgccgggcaaactttttggatttttatagagacaggagggtctccctgtgttgcccaggctggtctgtaatgcctaggctcaagggatcctcggcctgggcttcttaaccggctggggattacaagcatgagacaccattccgggcctaaaagcctatttttaaagaaactacaatctcccagggggactggtttcccggcctctttggtgcagtcccagggaactggcctacagcaagaggcctaagatggaatcttttgggggaaaagtcattctaggatgaaaatcctatgttaaggccgggcgcaggggctcacgccgtgtaatcccagtacttggggaagccgaggcaggtgggatcacctgaggtgaggagttggagaccagcctgggccaactatggtgaaaccccgtctttactaaagctacaaaaattagctgggcgtggtgccaggcgcttgtggtcccggctactcaggaggctgaggcgggagaatgtgcttgagcctgggaggtggaggttgcagtgagccaagatcgctccatgggcactccagctgggtgacagtgaaacccatgtcaaaataaacgattaccagttgtcggcatccaagagaaacaaacccacggggg

SEQ ID NO: 649784 - DNA, 96 bp, Homo sapiens
tggaaaaactttccatccggggcggggatccctctaaagtcgcccggcgggcttgcaggttgggcctggcccgccgtttaccacggtcgggctggg

SEQ ID NO: 649785 - DNA, 430 bp, Homo sapiens
  misc_feature (408)..(408): n is a, c, g, or t
ccccacccccaagacttattttccggtttttgacctgagccccggttttgcccaggttaagggccccggcaaaaaggtggccgacgcgtttcacaacgccgtgggggaagtggaagacatgcccaacgcgttgtccgccttgagcgacctgcaggggcccaagttttggggggacccggtcaattttaagttcttaagcccttgcctgttggtgaccctggccgcccccctccccgccgggtttacccctggggggcacgcctccctggacaagtttttgggttttgtgggccccgggttgccctccaaaaaccgttaagttggagcctggggggccatgttttttgccccttgggcctccccccagcccctcctccccttcctgcccccggacccccgtggtttttnaataaagtttgaggggggggca

SEQ ID NO: 649786 - DNA, 543 bp, Homo sapiens
gcgtgaatctgggaggcagagcttgcagtgagccaagatctgtgccactgcactccagcctgggctgacagagcgagactctgtctcaaaaaaaaaaaaaaaaaaattacaaaattttggccatggcgctgttgttctcaggccttataattcccagcacttttggaaggccgatggatgggcggatcacaaggcgtcaagagatcgagacctatcattagaccaacattgggtgaacccccattcttcttactaaaaattacggaaacaatttagccaggcgttggttggcaccttgttcctgttaatcccagctagctcgggcacggcttgaagccatggacaaaattcgcttgtaacacgcctttataggcggaaaggctttgcacggtgagccatgaagaattttggtgccaaagagtgaaacgattcacagccccttggccacacaaggagtttgaaacacttccatgtcgtcagaaaaaaaaacaagtatataacgccgcggatattgttgtgccccaattgatcagggcaaatccc

SEQ ID NO: 649787 - DNA, 213 bp, Homo sapiens
catcacccacctttcagcgactcataatctgggttagggatagtgtataaaacagacatttcttaatcatttgacgtgcacgtataatcatggttagtctctggtaccaatatcttttacatgtatggcttctgcaatggttaatcccgtttgtcaacttgacggcatcatgaggtgctcagatacatggttaagcattatttctgggcgtgt

SEQ ID NO: 649788 - DNA, 384 bp, Homo sapiens
gagttattggtttgtatgttctcctccccagaagaagccactaaagccgttacagaaatggaacggtagaattgtgggcacacagccattgtatgtagctttagctcagcgcaatagaagagcgccaggctcacctcactaaccagtatatgcagagaatggcaagtgtacgagctgttcccaaccctgtaatcaacccctaccagccagcacctccttacaggttacttcatggcagctatcccacagactcagaagcgtgctgcgtactatcctcctagccaaattgctcaaactaaagaccaagtcctcgctggactgctcagggtgccagacctcatccattccaaaatatgcccggtgctatccggccggctgctccta

SEQ ID NO: 649789 - DNA, 951 bp, Homo sapiens
attgactaggatggatgggctagatcttctgtactacatggtggagctctcgccatctatatgatagcgctgggatcgtatcagagctacttgatcgccgtacgagaagttcgccatggaagggtccaatgtgtgactagctgtggtctgatccagagttgaccggggtggttggggtatatctcctccaagaggtgtgtacaactatgggcgagatatttctgagacgtttatatcatgccaatggactcatgtgggctgtctaaagttctcaccagactaatgatgggagggatataactggtgcggatgagcggagtgtagatagcgatatattcagtgctccaaacgattgtgatcgttgtggtaaccaagctggaatcatgtgaacttgacgatgctctataatacttctttcttgcaagatttgaaccggagctatactcgtatgaggtcgagccatcgaatgttagcgtcgtcggtgaccccagactacttcctgtaaattgagaattgttaaaacgtctgtacagaaatgtccatgagaccatatatcgacctagatggaatatgggaagagcaaatagttaactcgctgagtgtcggaagaataggttaacatttcaaaaatctgtgtaggcaccggtggaccaaaagatggtgccgtttcatacagagtactaaggcctctatgtcatctaaacgaggccgtgaacacttgtagaagattgaaccagttcaatggtggtgctgagagcgaccaattggtggtctcagaaacccaggttatcgtgggactaagcggctactttggtaagtacttttggcatggctccggagaaacttgcgggtatacgaatggtaactttagaccctcgtgaaataacaattaatttcccattgaggtatgggatattcccgcatgacgggattagggtgggagggacatac

SEQ ID NO: 649790 - DNA, 501 bp, Homo sapiens
  misc_feature (17)..(17): n is a, c, g, or t
  misc_feature (53)..(53): n is a, c, g, or t
  misc_feature (494)..(494): n is a, c, g, or t
gagggcaccccctcagnccatggactccctccctcttcctcctggaccattcnacctttccttggggcccagtccttaccatggcctaatggagtcctactttccccaataaatttacctccataagtccccattaaaccttccccaaacccttgttggatcctttgtcatttaataatccataaaaacaaaaatacagcccaaaaaagccggggtgcgatgccctcacaccctataatccctagcactttggaaggctgaggtgggcagatagcttgagctcagtagttcgagaccagcctgagcaacatggagaaacaccatctctaaaaactaaataatataataataaaataaattcaaaaattagccaggaatggtcatgcatgcctgtagttctagctacttggggaggctgaggcaggagggttgcttaaacctgggaggtcgaggctgcagtgagcccagatcgcaccacttcacacaaagtgagnccctatt

SEQ ID NO: 649791 - DNA, 290 bp, Homo sapiens
ttgatcaaagaataaaagaaattcaccttcatcattttttgacttaagataaaccgaattgcttcattttgagcagctccgatgccattatttgtttgcatcgacatatatgtcactttatcatttcgcaaacaataattatttaattttgattgtatgtctatcgtactcgcattatcaactaaatatcagacgcatctccatcgataaattgtgaatatttttgaatagatcatcgagattcggattataagtcaccaccaccacattgactaatatcctggtgttaa

SEQ ID NO: 649792 - DNA, 1448 bp, Homo sapiens
  misc_feature (559)..(559): n is a, c, g, or t
  misc_feature (721)..(721): n is a, c, g, or t
tggaaaaggggtctccctgtgttgcccgtgggtgggttcggctcttcaaacctctctgtggcctcaagccatctcctctcccattcttcattccttctccacaatatagcgtgggatttacaagttatgtgggccactcagtgccgtgagttaaattccttaatataaagtgcttccgtgaatgtggatgtggacggaaagtatattagaatgtagaagtggcagaagtgtagaatgtgaacgggaatctcaacttctctttctcctccttatagtgtggcgtgtgttttgtgtgtgggccacaggcaggctgtgaccctctcgccgtgttcgaggaaaacccacccccttccttccgcgggacacacgagggggagacgcctacgagcccctgtgggtgtgtgctctctctctcttctcaggagggctctccctctcgagagggcacactcttaagtgtctgggggtgtgccgggagagaaaagagagagggttatgtgaaagtgtggccacagagtggctccataagctgtgttttctccctgtgacaccccagagntttttctctttgtgtgtaaccacagagggtggttaagactcttggcccgagagatctctccccctatattaggagagaaggtcggaaaaataaaaacgttgcgaggaataaaagcccaagtggtttaaacccgttgggttctaataatagataattgagagnacaagaagaagaagagaaaaaagaaagagaaagaagagacgacggcagcgtcgaccagcacgacaacaggggggaaactaacaaacaaaaacaattagggtaaccacacacacacgacaactcgctgggagaccaagagcagacaaaaaagagccgataataacaaacagaatgttcgagcccatacacagacaaagagcaacaagacaaatagagccagccgaacagcaaacaaaaaacacaagacagccagcagccaagcaagacaagataacaaaaagagcaccacacacaagacgagagcctactgaaagggcagaataaggcaggagagcagcgagggaagaagaaacgagaggcaggcggaacaggagaaaacagagaaggagcagagagggaaacacgaacggaacgggagcgaaaaacaaagaaacaagaaagaacgggagagagagaagaggagagcataaaagtaaaaaggagagggacagaaggacgaagaaagatcgcgcgacgagcaccaacgcagagaaggcacatatgacgaaagaaatcatccagtgagacaatggagccgccaggagaggagatagcaccagacgatagaggaacacgcgagaacacagcgaagagatgagtgaggcacaaaggttatgacagcaacaaaacaggcggagcagagcgaccccgagtcgagagacacagacaggacgcgaaacacatcaca

SEQ ID NO: 649793 - DNA, 108 bp, Homo sapiens
  misc_feature (41)..(41): n is a, c, g, or t
  misc_feature (50)..(50): n is a, c, g, or t
gagaagacgacagaagggcggcccgtggaccgcgaaagcgnaaccacggnaaggaaagaaacacgaaaaagagagaaagaatgaggaaagaaacgaaggaaagaaggg

SEQ ID NO: 649794 - DNA, 209 bp, Homo sapiens
cccatgcacagttcgagtcattagtgtgtatctttttttgtgggttaaggtggggggatacaagaggaggacgcaaaggaggcttggatgggaagaagggtggcaatgagatatagctgtagtccagggatagtcagggaagcagataatttagttaaagtgtctcagcctaataagggaactgtgcatgggggggtacggagctcgaa

SEQ ID NO: 649795 - DNA, 897 bp, Homo sapiens
cttaggtagcagaggtatcctgttggccagcgagcattcccgtctgtgaatactgcctcggacaggagcatagaacggcaactcctggaagccagcacctggagaagctgggattggactctggctggctctcattccctgatgtgtctaacattgtattcgatattgccctcgctctcagatgaccacctggccgcgtgtgatgccttgtgatgaagacccaacctttgtagacaacgctgacgagcctacgttgattagaatcatgtggctggggagacagtggttgagaccctccagcgtccagctttggttgttgaacataccatatgcctaggatcactgcgattatcacacatgtatttgcctatatcgctgtggctttgtttgactcttacttcgcaggtgctatccttaagatagcttataatatcatgtatgatttaaatgctattgtcatatttacctatcattaagggatggatctgactagtttattgcatcatagaactattgcataaccactgattataaatactgactgcgtcatgcaggcctcaatggagtagatatagcgaccgattacttttttgggagttaagcaatgagacaagtaactgatggcctcgtttgggtcagtcggggagctctagcggcgttacctctctgagagggggaattctggtactcactcaatgagtggatacgctagaaagtactgtgaggaagacgcatcaatggctaaaggcggaatagggcatcccctgatctgtgtcttcggctgaacacttgtgacatacgacatcgacggctagaccgtgaggggcccgtgtggctttttcatccgtccgtcccctgggagctttcaaaggctctcttttccagcttggcgaaacg

SEQ ID NO: 649796 - DNA, 818 bp, Homo sapiens
tacaggatccaatagttaatgtcatgccttcgtgttgtaagtagccagatccctctccagtgacattggaacatgctacttattctaacttgccgccctgtaacagctagcttattctatgaaatttcattgaaaaacactgacagggtgttaggaagtggtgtgagagaatgtaggctctccagtgccattgtgtcagcttatgtattctagatgtgttgcagagcagctatgttacgcagctgccttaaatcgtaactatgattctaaatgaaatcagaagctaagtaatacagattgtttgggtgcaaagacacaagtatttgggtgaatagctagttgagtcgtgtaatagataaattgctatacatggtcatacatgttactcaactgctgcagttgcttcagatcgattctacgaacctggatacactatcgaagaatctagatttagtgtcgtttctggggcgtgttgaagtagatttgaggcggtctgcaagccagggagcagtgggtttaccaagagtaagatataaattcttattctatagataagaaaaaaagacaatataaaaacacaaaaacaaaaaaaatccagcaggtaaacccccagtgttcatctagagattggccatttactgcccaaccgcaacaacttgaagaagataaattcccttcaacgtctaacatgtagacaggaattggggcgtggacacccatactaaattccaaacgtggcactaaccgtaacttcttagatgtagggccagtccaattgaggaatagttgcgaacggtgtccatcatagccgggggcta

SEQ ID NO: 649797 - DNA, 1303 bp, Homo sapiens
tggccattaatttggattaattggcattctgaagtaccccggggggagggcctgaaaacgacccgtcttatactcagcgagttcataaagcctttattcaccgtggagaattaaatatctcgtggggggaaaaaactcaagaagtgggattactcaatacgttattttcacaggaagaattgtgagtttgtgggcccgtgaacgagaaagaacaccagcgtgtcactacaccgtgaaaaagagcgctcagcggtgagagaaattacaagaagagagaaacacgagctataaaccaccaaaactccgtgggtgaagaagaagaacgctcgaattataaagaggccgcagccaactctcacacgtggaagcggtggacacacacacctctcctctctgtggggtgtacgccgaggagagcacagaagcgggtgagacgacaccaactggcgccagtggagagcctggtggggcccacagagaggcgcccacctctccccactgagggagaaccccacacagagacgagaggcccacagaggggagagcgccctgtgtgtgggagagcagacgctttgtgtgcgctctctgagcccgcggtatagtctccacataatttctctctatatctatattcgcccgcccccactatatagttatatatcgcgctgctgaggagaaaggggcactagaggagccctacaatgtcgagcgccatattcgcgcgcaataatctctcccccggagagggggcgtgagggcccgcgcaaaccacccaactctctcgggcaaaacgccccatatagaggggggctccagaaagggggggtccaaaacccccgaacagaagggtgtctccactactccaagcgaaagtggcccccgccccggggcattctcttcccgtgaaaggtgaaagtgcactcgggggtgggcacagagccccgccacaagaaatcccacaaggacaaagagagaccagggcccacaaaagcggggggcaaaacaaaaggggagcaactcccagggtggccccccccgttgaaaggggcccccacgggttggtcccaaagacagcgtgccccaagatggcgtgagcaagaccatccaccaagactcaaacctggcgagaataccccccaagtgtgtcgccccaattggggccagtgccacggcaacacaccggaacaccacaaagtggtacacccaccagaggaacacacggacttagaggggctccacacagggtggaccacggtgagggggggggccacacaatatgtcagcgacacacaaaccacagagg

SEQ ID NO: 649798 - DNA, 220 bp, Homo sapiens
  misc_feature (58)..(58): n is a, c, g, or t
actcgttatctagaggatcccattcctgggctctaatgatcctcctctcagcttacanagtgctgggattacatggcatgacgcaccatgcccagcatgtattttttttttttttggtgaaatgcagagttaattcttgttccccaggttgaagcgcagtggcgcgatctcggctaattgaaacctcaacctccaaggttaaagcaattcctccggggga

SEQ ID NO: 649799 - DNA, 924 bp, Homo sapiens
  misc_feature (511)..(511): n is a, c, g, or t
ggagatattgccccccaagtctcagatagtgatagaatctctacaccagaaggcgacagatcattcatggggatgtataagcgatgagcagtcctctccaacgactgagcgatcttcactttacgcagtactacagactgcctagtgactccagaatatgacaaacctgcagaatttggccaagctggcctgaagacccagcaccgatcagcgatgactgtactacgtccctgtcgtacagaccatcgcagggtcagctgtctgctcccaaactacgacattggaggggcaccaacctctggctccgctgccctagcagctgacgcgcagccagcagtgactccacggtggatctgccacgggacctcagccctcgacgagccagagcagagactgaccggagagtgttcgctgggggcacgggaaccagaagcggacgatgcacgagcgggccaccgccgcgatacttagagttccgtccatgcgtattcacatgatcgacatggcagantgggcacaacctggggggcagctccacttacacatgccatggatgaaagattctcacgtatgctgatacacccagtgaccctctgtctacgagtgttcccacaacgaccgcagggaaggccgcgtctcataccggcgactcaaggcttgccgaagaagagtcacacgttcccgtggcatgaggatgtgacctccgcgaaggtatccctgtcctactggaaaggggaccctttctctgcgctgggaagagccagaccgtcatgggacaggggccgttgacacccattggaagtccctttcccacaatccccttcgaacggtctcccaaagaggccgtagggatggcccggggactaaacgggcccttccgtggtttgacccttcgctgaagggtctcaatacaggtgaaaaccc

SEQ ID NO: 649800 - DNA, 226 bp, Homo sapiens
tgtgagtgatctagagatctggtgaggcagactggagtgggctgggaatgacctgggtgagaggctgtcttgggtataatgtcagtttgtttacatttctcacaccaacaagtctacatgctgaaaagagagagaggggtgtgtgtgactcgcatgtgttggcaggaccaagggagggaggtaggataaaagggggaggaaggagagagtagccagggaatggtgg

SEQ ID NO: 649801 - DNA, 262 bp, Homo sapiens
aaggctttccctgacccccccgtttttttccttttccgggaaagcctctgtcccccgacattttatgtcataaaatacccatttattaatttcccgctctcccccaggggcccccgagctttgtaagggcaaaactttgtttggttgtggggtatgcccccaaccccccgggcagggcctgcccagggggacatttttgttggataaaggattttttgttaaatgggtttggcccccccaaaaaaacaaagccccccgggta

SEQ ID NO: 649802 - DNA, 987 bp, Homo sapiens
gcacagacagattgaactatatggggtgtgcggcgagtgtgagagggaagcgccgcggctgtatttctagacctgcccttcgcctggttcgtggcgccttgtgaccccgggcccctgccagctgcaagtcggaaattgctgctgtgctcctgtgctacggcctgtggctggactggctgctgctgcccagctggctggcaagatgaagctctccctggtggccgcgatgctgctgctgctcagcgcggcgcgggccgaggaggcggacaatgacgtgaggacgtgggcacggtgcgtcggcatcgacctggggaccacctacctccatgcgtcggacagtgttcaagaacggaccgcgtgagagatcatcgccaacagatcagggcaaacagcatcacagccaggacctatgtcgaccttcactcctgaaggggcaacagtctgattggagatgccggcaagaaccagactcacactccaacacccgaagcaacacggtctttgcacgccaaggcggactcatcggacgaacgatggaattgacaccgtcatgtgcagcccggacactccaagttccttgccgggtcacggcaggttgaacacagacaaaatcacaaccataccattacaaggttcgaatatcggcacgcgacggagcaccacaaaggacaatctgcctcactgacagaacaattttcttgccactggttcctcacttacccatgacacagaaacgcgcttgcaggccttcatatctgcgcaaagacagggtaccccgatgcaccacacggcaaccctgcaaacccaagccacaaataccccaccgaactgccccaaacgacgcgagcgaaccaaaccaaccggccggacaacccactgcccggcacctacacacggtgacatgcggaccgccagcgcaacgccacaagcgacacgggacgacagagcgagacaggcccacgactaacgactcggcgcgcgcaacac

SEQ ID NO: 649803 - DNA, 204 bp, Homo sapiens
ttggcaggatagtgcaggtgcagccacaggtcacacgcagtctcagccaagcgtcagccagaggagcatctccagcgcaggtgtcagtacagccaccagagcagacctatgagcagcctcatacccagccgcaggtgtcgttgctggttccagagccatgaccgagttgtggttcatagtctgcggcgctggacgatgccacct

SEQ ID NO: 649804 - DNA, 191 bp, Homo sapiens
agcaacccctattcatactctccttccgactatctcctaaacatctataaatacttcgtcctactaaactcttacaatacctttttacagtcagcttccctagggtgagtatatcccaatttctagtgatgaatatttagctcaatacttttcaggattcacataagtatgtaatacatacctcacagcaa

SEQ ID NO: 649805 - DNA, 1571 bp, Homo sapiens
aggcggagcttgcagtgagccgagattgcgccactgcactccagcctgggcgacagagcaagactctgtcgcccaggctgaaggccaggacgagtggccgtgaacccgggaggcggaagctgtgcagtgagccgagattgcgccactgcaactccagcctggagcgacagaagcaagacatctgcactcagaaacaaacacagcaaaccaaacaaaaaacaccaaacagcactctgcaatggacacaaaaaacaaacacaacacaacatactacgcacaccgatacaacaaggaccatgctacaacagatcggaaacaacaatactaagcgccacaccgaaactcacccgacgagccatcacacgtacacacacacctactaataaaaacataatactcataaaactcaggacagagcagaacataacagaagccccaagacacgacaacaccaacagccagaacaagagagaacaacaaccacagagagagagacagagacaacaggagacacccaagcgaacaaaacactacaaaacgacagaccaccacagccgcaggcgacgacagccaggcggagccaccacacgacgatgcacacagagcgagcaacacacagcgcgcagaacacacagctaggaccatcccgaagccaagagactcagccagcacggtagcgagaacgtcagaacaacaaggtgacggcacggacaataaacacacaagaccaacctgcacaacaaagacagcaacacgcgtggacaggtagagacacaaagcagtagcagtcgaactcctcgccaacagcccacaaacaacaagacacatccgcaacaaccaacacgcgagcagagaacaaacaccaacgacgagcggcagacactacaacacaacccggcagcgcaacccccaccacagagcacagccaacaaccgacacaaccaagtacactagcgcccgcgacacaacggagcgtcacacacacacaccagcccagcaccgcccacaacccacgaacacaaaagaaccacgaccaaacccaacaccacagaacgcctacaactcaagcaacactaccaccgaacacgcggggcggcgacacacaccccagaccacaacccaccagcccacaccaccccaccgcagcccaccgaagcgcaccgccacgaccacgcccaccaccagccgcacaaccgaccccccacaaccaccagaaccccacacaacgcaccaagagggtgaccgacctcgacacgttcgagcgctgtccccacaaccgacaaacagccagcacactatctaaaccgacgccgagtacgcagcgcgagtgcatatcactcacgcgttacgtactgcgcaccgattagcacggcgcagcgacggtcagcactacgacagggagacgaagagaggagagcaagcagaacccgccggtgggataagagcagcagctcgcagctgctccgacgatggaagaacgcacacaagagcagctcacgcacagcgcccgctgcacgagacaacgtcggcgcaacggccaccctcgcgcgaccagccaacacgagagcccg

SEQ ID NO: 649806 - DNA, 354 bp, Homo sapiens
caattgcaagcgcgcttttaacttatgtatttattttgtagagatagggtctcgctctgtcacccagactggagtgcagtggtgtaatcacggctcactgcagcctcagcctcctgagctcaagcaatccttacacctcagcctccctactagctgggattacaggcatgccaccatgcccagctaatttcttttattttaagtttttgcagggacgtgttgaaagaaaaaccttagccaaattaagcttaacaaagtttagttaagcaaagaatgctttgcgaatcaggcagcctcccaagccagggtagctcagagagactccagtgcagccacgtagtggaagatttatag

SEQ ID NO: 649807 - DNA, 498 bp, Homo sapiens
cgaatcatgcttgggaggcagaggcaggaatcgcttgaacctgggaggcggaggttgcagtgagccaagattgcagcattgcactccagcctgggcaacaagagtaaaactctgtctcaaggttaaaaaaaaaaaaaaaaaaaaaaaaattctaattcccaagcttttttgggggaattgaccagggttttaataaatatcttctgaaatactagacagatttgggttgcagactatgaaatatttcccatgtctttatttcaacaactgcaattttaatggtcttttaaggattcccaattccatgtgttgtccctctcttcctgcctaaactgtgtctcatttccttataatgtgctctctgattactgagcattttcggggtatttccatatgcaaaaactatttacccatctaataattatttaggggttccagatacagacgtactataatagagtcctagatccttggaaccttttaaaatactttcaaaac

SEQ ID NO: 649808 - DNA, 523 bp, Homo sapiens
actagttctagatcggccagctgcctaattctgaatatctatatatatatatcttttcaccataaaaaaaaaaaaaaaaaaaaacaaaaaaaaaaaaaaaaaaaaaaaaaaaaggggggggcgcccaaaattccccccgggggggcccattccgccccccccttttttggaaaaggggggcccctagggggggtattttaataagagcaggccgagggggcgggctattacaaaaaagggttggggataggggaaaaaacgcggcgcaacgctgggggattatcttttggggaagaggaaccctacttcttgctggggggggggggaacacaataatgggggacaacaccaacccatcagagcgaaatttcaagagctctgatagggtgaaatatacaaactgctctaaggtggtatataaggtgtgtgaaacccaggcgtgcaatttcgtacgggttgagagaaagactttggcacagggatgatatgattaagaacattttttacaggggacatgcgagaa

SEQ ID NO: 649809 - DNA, 156 bp, Homo sapiens
catacgggcctgtcccgtataggtaccaaccgatgacgggcatcttcagctgcactagggccccaagcttcatctatctcctttagcgcaggtcatcaagtctttcttaggctatgagctgctgacaggcgcaacctggctctggactcaataatt

SEQ ID NO: 649810 - DNA, 1220 bp, Homo sapiens
acctgtgactagacaatacggtaatggcagcgcgggcgcacagtaggataaagtgaacatggtcatagactggtttccatagagagatcatggatcatgacatagctgctatggatatcatcagagaagtaaaaaacgcaccggcgaaaacccgaggcgttcgtgaacaaatcacagaatgaaaggttcatgagagatcatatacggagggaatccataaatacaagcgagggaggtcccaacagcagaagactcagcagaagtacaaaagtgaacagcaccccagaacccgggagaacgacgacagagacacgcaagccaaccagacgaaagcgagagggggaggaaacagggaacgagcacgggaggagcggcaaacgcgagaacagcgcgaaagggagacagcgagaagacaagaaaggagccgagaggagggcgaggcgcgggggggggagaggagaaggacgcagcgacagcgcagagggggaacgcaggacggagcgggcagaaggcagggcgggcgggggggagaggcgaggagagcggagggcgggaggaagggcggaggcgcgagggcaggagagaggagcggggccggagccgaggcgaggaggggacgccgcagcggcggcgacggggaagaacaaaaagagagaaagagcggacacgacagaaggaaggagaaaaaagaaagagaaagacgaagagaaggaaggagcaggacacagacagagcgcgaaagggagagagccagaggaaaaacgagatcgagaggcaagacggacaagaccggaggagggagacgacgcagcgagaagaaacgagccgacgagggagaggagacagcaaacacgagggcgagcggggacaggagatcgcagaaagaggcaaacggaagagagggcagaacagacagcaagcgaacgagcggagaagaggcaaaaggaggacaaagacagagaagcgcagcaggagcaacagcgggacaagagaagaagaagaggagaggaaagacagacaagggcagcagacgacgagcgcggagcggagggaagagacaagaaaagagagagcagaacgacgagcaaaacgagaaggagcgacaagagacaacgagcaagccgatgcagagaccgaagaccgagcgaacgagaggaagcgcaagacgagggccgaagacgagaggaagaacgaacgcagaaaacaagagcagcgagcaa

SEQ ID NO: 649811 - DNA, 294 bp, Homo sapiens
caggttgggagagccccaagattgagaacaataatgaacaattattgtatgaacaattgttagagacagctaatcacaaacaacctgcgggcacaatgacctcattccacacgtagcacccttcagacaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 649812 - DNA, 104 bp, Homo sapiens
tgtcagactccttgccttctgtatgattgtgaggctccccagccatgtggcactgtatatacaattaaatctctttcttttgtaaaacacaacaaaacaaaacc

SEQ ID NO: 649813 - DNA, 116 bp, Homo sapiens
ggacagttaaaggtacgtgtcatccttatctcctgtagcttggtatgaagctgggacatggaaacttagtatttgccagcaatagattggttgggtgaatgtggcatcgataaaca

SEQ ID NO: 649814 - DNA, 1059 bp, Homo sapiens
gataatcgcttctagtgtccggcaccatattcacacctgatggcctcgagtataacgaattgctatcgtctatgactatgtcccatgtccggccgatcctatgtccgctcctacggtaggaattttagagccggcgcgtctctactgccgtagcgacgagagtgcttcatcagtgctctggtctactagcatatctagttagctctgcctatctcttgagacccgtgaaccgaggtccgagccgacagccgaggatgagcgcgtaccagctgtgggagtgtcccaccacgataacctcctcactgaccggatatgctcatctcattgaccctataaacggcgaggacactcattcgctagaccgccggtgcggttaggaatcaggaggtgacgcgagatgacgcgagtgacgtgaccatgagctcgagtcaggaagtgacacactgtcacgtggggccgaggtacgacggcttcaaagtgacggatggaagcctccacggtggtcgcaaagatccctttggacaaattttgcttgacaggagcagacgacggacgcgggagaggaatgtagtcgtacattctcgccaagggaccaacgatgtgcaacgaacctccagttttgactaccttgcctcttgcccaggctatcttgtagccttgtggcccaaagtgctcctaggccaattggaaacattcctcgaatgccgaccaacccccagtgttaggtgacaccaccactgaagaaatgttcgttccacaggcgtacctgacccggttcggcgcgggcatgtcctctcagcgaggaaggccccttacaaaattgttattaatcccttaccttgaaataggcgcatcctctagacacgcttgaccttaggaccacaagtccctcttacccatatggattatcccaaacaggcagaaggagtgccaccttcctaactggctaacgtgggaacaacagccaatcttaaatctcaaccatcacgaattctttccccgagttttacccttagagggctttgcaaaaatcacacgcattccccttataccacccct

SEQ ID NO: 649815 - DNA, 157 bp, Homo sapiens
  misc_feature (144)..(144): n is a, c, g, or t
gttatcgccaacactttttcacacacagactgggacagaatagggaaccagaaatagaccgcacacctacaatcatcatcttgacaaacctgacaaaaaaacaagcaatggggaatagattcccgtgtttaacaagtggtgttnggggataaactca

SEQ ID NO: 649816 - DNA, 800 bp, Homo sapiens
cggtgttgtgaacttcgttgcttgcttgccctgtgcgcgctgtgctgcggacatggcctcaaactgattatacccaacaagcaacccaaagctatggtggcctaccccacccagccctgggcagggctattcccagcagagcagtcatgccctactggacagcagatgttacatgtgtgttatatgccatgtccacggaacacttcagtgctatgtgccatgatgcagctattcttcttatgtgccagagccagaacatgctatgtgaactcagtcaaactcccacaggggatatgtgctcgactgtgctgagaatatgtgcatgtagccaatgaatgcctcccaaatcgtctatactggtgcatgccatgtcctcactacccttggactaattggcacagcaaagccatgcatcacacatgcatgcaacctctgggggaagttaccggtgtatgcatgtatctacatgatgcagcatgctactggagcaaggccaccatgatgttgggagatgcatacagcacatgcagcctaagctattggatgggacaggcagcacaatgctatggacacgacaagcgaaaagctatacatcccccctcaggtggctatgggacaagaatgaaacaagtacaaaatggagagatggtggtggaaggtggaggggtggaggtggaggtaactatggcaaagatcaatcctccatgagcagtgcgggaggatatggaatcatgacagagatgggaggggcgggtgggtaggcaggggccgtgatgctgggagggtgaaagagggagaga

SEQ ID NO: 649817 - DNA, 882 bp, Homo sapiens
gcaccaaatggcggatgacgccgtgtgcagcggtgggtggccctggtgggccctgtgtggccctgggattggggaacctgctggtgtgcttcctgctggatgtgtttctgtgcatgttgtgcgatcctgtgtggcctggtggtctgctggcctgtgtgactgtgtgtgcctgtgtgtgcctgatggcccgcgtgagcctctgcgggagtgcaatgtgccgatggcataacggcagtgtgattgccgctgtacaccgaaagtttggtgcctgcatatggatcaagtggacagtgaaagcaatcaatgttcccatgtgagtgaagaatctatcattctttactcgccttgcaccgatataacggacaatcgaggagaatcagttgacttatcgtatccttgcggagcgccctcgttcatcgagagggactgacgggcttatgttggacaagacatttattgcccaagatggcaagaaaggcaggcacccgcagattgacctccggggacagccaaaggacgcggcagagcccgaagagggtctccgacaatgggaccaatttaatgggataattggccttaaattacagagagaggcaaactttaaaccaaaagtggggtgcgccaaacggatacgaggggatacattggggaggttgggttccacagagtggaattgggcatttcgccagacacgcgggacaggggggtttgggtgagcccgaaccccttggacaccagatttaccccggaatggaggtggggccaccaaagttacacagtttccgctttgtgagcccgaaaaagggtcgttttccgttcccacaaggtttcccggcgttcaacacacgcggattggccttggccaccgaagcgaggcataac

SEQ ID NO: 649818 - DNA, 623 bp, Homo sapiens
gccccctgggttccctcagcccagccctgtccagcccggttcccgggaggatgaagttcgtgtacaaagaagagcatccggttcgagaagcgccgctctgaggggcgagaagatccgaaagaaatacccggaccgggggtgccggtgatagtagaaaaggctcccaaagctcggataggagacctggacaaaaagaaaatacctgggtgccttctgatctcacaagtttggtcagttctacttcttgaatccggaagcgaatttcatctccgagcttgaaggatgccattgttctacccttgtgtcaaccaattgtcattccaccacaaccagtgccacaaattgggttcagctgtaccaggaacaccatgaagaagactttctttctctacagttgcctacaggtgcacgacagggtgtctaccggtctggtgaaagcctgcgtgccccttgaagcttgggaggggggtctcatttctacaaagagagaggtgggccccccttttctttgacctccttcctcactttcaagctcaagacacaacttccctttattcagggaccggcacttcttaatgtctgtgggttatctactccagactctcttaggaggggtaaatggg

SEQ ID NO: 649819 - DNA, 757 bp, Homo sapiens
cgctgcgaccgagagggagcccgctgctgcctgtttgcactcggctgtatgctgttagggccccggccccagcgcgcaacagctcgggggacggggggcgggggcgacggaccgtggtggactgtcccgtgtgcaagcaaagtgcttctccaaagacatcgtggagaattatttcatgcgtgatagtggcagaaggtgacacgacgcccaggatgcgaaccaatgctgactactgtgaggataatgccccagcaccagctactgtgtggagtgctcggagacctctgtgtgagacctgtgtagaggcgcaccagcgggtgaagtacaccaaggaccatactgtgcgctctactgggccagcaagtctcgggatggtgaacgtactgtctattgaacgtacacaagcatgaaccccttgtgctgtttgtgagagctgtgatacatctcacctgcagagactgccagctcaatgcgccacaaggaccacacagtaacagttcttagaggatgccagtgaggaacccagcgcacagtcctggcactcacttggtgaagcgccttggggaccaacatctcaacattgagaagaagcacccaaaggaggttcgcagcctcaatccgcacggtgttgacgtaccgaacgcgtgtgcacagtggatgtcccagaatggccactacctgcagatacatgaacgggagctgcaataagcgggggccagctgttgcgtggtacacatgaatgcccaaaacagtgaat

SEQ ID NO: 649820 - DNA, 553 bp, Homo sapiens
attttttataagttctggatttttctgcaaaagttttattaatttcggtttctttcttggataaagagaaataaggtgtaataggcagctttatattcttccaaaaccacaaaagttcatgtttttgttgaaattttgtcccaatttagggcgtattacaataagcggaacggtgttctattttaatttgtcagggcttgattagcaagggcgcggcagttgctagttccagttgcaggctgagagcatgtctcgacaactccgaaaaagtggcagcgacatgttcacaggtgtgcggggatggacaggctacgtctcagccactcgcgcggggaggcggagcggtgtgggcagaagtaaatttctttataaattatccagtctgggcctggtgtgttggctcacatgtgtaattctagaactttgggaggtcaaggtgggaggagcgcctgggcccaggggttcaagacgagcctgggcaacatagtgagacctgtctctataaaatatttttaaaaattagctgggcgcggctgttacgcctgtaatccca

SEQ ID NO: 649821 - DNA, 615 bp, Homo sapiens
cgacccacgcgtccgtttaaaagatggcatttggaaaccctggaatattgtccaagtgaactaggtggccttagacatgcatctgccagcatgggggttcagaagcctataggtcacatgaaatttgataggaggtgttcgacagagtacaaagagtgccaaagacagaaaagcaaggtgcgtgtccatactagtcatccactgactgtatggcaaatattaccccagcctactgagattaatctggtgattgaatccgaaagatttgagaattgacactaagcgagccagtggagctggggggcagcatgtaaataccacggacggtgctgtccggatagttcatcttccaacaggtgtggtttctgaatgtcaatcaagagagatctcagctgatccaattaaatgagctggctagtgacaaaagttacgtgtcaaaagcatgtacagcatgcatctagaagagagaaatatacttagaagatcagaatgctagaaaaattggagattggcaagtaataggaagatcagcagaaaagtaagagacataatgtttgccacagaaagcgggtcacagatcacaggaataaatcaagacgcgggcatgatcttgaa

SEQ ID NO: 649822 - DNA, 322 bp, Homo sapiens
cagacgttgcttcgttgtggcttgtgaaatatgtccagtgtaatgacaagaggtacatttgaaatattcgcatataggaagcttatagagcaatcataatgttgtcaatggagcaaactcaagctctatttctaaatcacatgttcttgatgtcttcctgcatatcactgaccttggatgacatgggagtaggagagagacgggtttgcaagtggagactgcggtgatgatgaagatgagtagctaggaggctctggtgatggcatgatcaaagtgaagactcagctccgcttccttgcagaactggcctatgatctggatg

SEQ ID NO: 649823 - DNA, 685 bp, Homo sapiens
attttctggtttaacttcctcaagaggtccatcaacaaggcaaaattggacatctcccgtgctgttggtgtttgaaattatgtcttctttagctgaggacaaattcaacctgggggcatagagtgagctaaaacgtgccactggttagtaactttagcctccaaaaaatgtgaccctgtgtgcagagtctcttgtacacatcttttctcacttgtcatctgtggcttatatagggctgtcgtcaggatacatgttggcatttacaatcatgtcttcatcataaaccatgtgtgtttgaggtagaaggatcgccatatcattcgttgcccaacttgggtttattagataaaacaggatctattaattacacagatcataaggcattaacgaatcctgtcacagcttatgtggaaatatgctctatccagatgttggtgacctgatctagggcgtttgtaattgtgcaacccgtaccgcagatgctagtgtatgtgtaaatgtgggctccctgttaagtgcgtctcatggatccatgaccttaggaagtagcgcatgcaagtctgaagcgttaacatgcgtttctaaaattggctgatgtgaagattcaatcatgcctgccaaccttgagtgtctttgatcgtttccaatctcttcgcacttctttttatcattaaactttgcatac

SEQ ID NO: 649824 - DNA, 420 bp, Homo sapiens
gaagagggtagcctctattgaccttctgtatatatttagctcggattatttcaggggtgtgtatcgtcgagatgcacacaagagtgaggctgctcattggtttagagatttgagagacgaatagtccacagccttggcgttgattgccttagctcagtctgttcagcagtgcacattggacgatcatggaaagttagtgaatgaagtctctgaatctgcttaaacatgtgacggtgatgagtcagctgaaagttgagacgaatcactgcataccctttttggagacagattatgcacagtcgcatctcttcgagaaacctatggtgaaatggatgactgctgtgcagaatgtgaacctgagagtgaatgctttttgcgacacggagatgacccttgatctccctacgattgttgagcctg

SEQ ID NO: 649825 - DNA, 200 bp, Homo sapiens
agacctggcatccatatcccaggtcctcaggcatccccacacccagtcctcagctgcactcgtacatcaggtcctcacacagcccacagaagcatttccttcacaccataccatgacatcggtccttcgcacccccaaaaccaggtctcggctgtaacagtgaccaagcaggtggagccttccatcgccccacacggcag

SEQ ID NO: 649826 - DNA, 252 bp, Homo sapiens
catcccgcaattcacataagaggataaatatgaatgaacctccctttaaacgtcaatggacagaaagctcacgcctggggcataatttaaacgtcggacacctttcctaaatgggggagcatgggactccaaagggacaccatgaattattccagatgtatcccatcttacaaagttctcactctgtcaaagccattcggggtgtgccggaacatgatcgggcataaaccagtcctctcaggggaggaggtc

SEQ ID NO: 649827 - DNA, 475 bp, Homo sapiens
  misc_feature (141)..(141): n is a, c, g, or t
tcctttcccaccttttttggttcccagaccctgtgagcctatggagattttttccaaagggccttggtgtccccccacccttgcccagggcctttggacaggggatggccaggtggcccctccaaacccctggtttttttntggtggggcccttaaacccttttttacattaaccgtttgctttgtaagcccttttttttttttttgggggccggttttttttttccccttaaaaattgcctttcctgccaaaaggactccggtttttttaagtccctgcccagggcttttcagccccccataagtgatggttcccctgttccctttacttagcatttcccccccgagttttttttcccctggatgggggaaaacccaaccgtggttttcccctcacccccccctccccccccctttcccccttccccctgggaaatttcccccagttttttttaaacccccctttttttggcca

SEQ ID NO: 649828 - DNA, 389 bp, Homo sapiens
acccttcgatgaggtgtaatgccagtcgatgaggtgaacaatcaactgtgaaacagttcacggagatggtgactgagccacagtcaggagcggcgcaacagctgtgcatgcagtcgagagactcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctggcctcagtgaccccacacccccttcaggcccaagcctggatggtaccggatggaacagcttccagtcgt

SEQ ID NO: 649829 - DNA, 217 bp, Homo sapiens
cacgaggggccacattcaggaggccatcgccgtgatcaacaacctccacccacagctcttggccacaaaccggtatctttacatccatttgcaacagcagaatttggtagacctgatgcgccagcgcaagacaaaggcggcgccggtatttgtacacactcaccaggtggcttaaggcgatgagagccgacacaggctcacacagatggagcgtacc

SEQ ID NO: 649830 - DNA, 1137 bp, Homo sapiens
tgggaaacagtcttaactcggtcccccaggctgaattgcaggggcccaacctcggttcactgcaacctcctgcctccggggttcaagcaattctctcctgtgcctcagccttccggaaaagctagagattacaggcgaccacaacgtgcctaatttttggtattttaagtataaaaacggggtttccaccatgtgttgggctcaggggtggctcctcaaacctctttgaccctcagggtgactccgctcccccttgggcctcccagagagtgtgcgtgggaagttaacagggcgtgtaagccagtgtggcgcccgcggtccccaagaggaacaatttcttgaagaacccccacacaactttcagaaaccacacatttctgttccagtgtttaaaacacatagaaatttaacaacccttctataaagagcctagaggcaccacagtgcattctcgtgttaacagtgtgccacagaacagtggttctccactgggtttcccaccgatttaggggcgggaattctccacgtgtttctacgaaatctacttttacacacacaaaacagggtgtgtgggccgcggaaagtttaaacaccccagggagtaccaccccccaaggatacagtctatatatcttgcgtagccctccacagaaaaacttgtgaccccccgagatattgttgcgccaacagagtggtagacacaaccgcttgcgcaccccagcgcccgctctacagggtgttgttccctcacaaaaccctctgtgggtgaccaacaactcacactgtgagcgtgaattagcgcacgccctcttaatgacaacgacacacggcagtcgagagaaccccaccctttctccaacgacggatgacgtgtataacaaaacgcggatattcccccacctctatgaggcgcaaacaacatgtagcacgcgcacttgtgcgtatcgccatatcgctactacacttgtcactatatacccccccaccgggggcctgttgcatacttgccaccacttcttcgcaaattacgcaccacgtattcccccgcaaaaaaacagtttctccttacaacggttattactcacaccaattcacacgccacatgtggtggcacaactgctgtcgccacaagaatcc

SEQ ID NO: 649831 - DNA, 141 bp, Homo sapiens
cttgctctcctggtttactccactacattgctcctgcggcagctttcctactccacccttttacctttcccagaatacagaacctcaggccaaagagagatgccatgccccattaatctgcctctactgtaccccaggtga

SEQ ID NO: 649832 - DNA, 278 bp, Homo sapiens
atctccgtcgtgcattcactgagtaacgtatttacaccttgcgcacatatgactcgggaggagctaatgatacctcctgatacaattgctcgaggaaacatatttaactgatggagtcttatacgtggttcctgaatgcacagttgattctaacctatacaagtgcatcacatatagcagagcttccttctagtcttcttctgataattccaaatataaactttacctgtcagagtacaaagtagaagctgtgcattttataagaataagccttttca

SEQ ID NO: 649833 - DNA, 1041 bp, Homo sapiens
gcaacactccgaggtcaggaacgctccgtctggaacggcgcaggtccagcagctggggttccccgtcagcccgtgagcggccatgttcaaccccagcgccccaccaccatatgaagaccgcaaccccctgtacccaggccctccgcgcccctgggggctatgggcagcatctgtcctgcccagcgagggtatccatgcctaccctggctacctgctaggcctggctacgtgtctatccctgctggtctacccaacagcacgcatgccccccaaccactattctgatgcccatgaactacggaccagagccatgtgtataatggaggaggagagagcggtgagttgaatatcttcagcaggcccatgaggcagagatcgcgaaatacacggacaactgatgcagacaacaaagaatcatatagtccagacaaaggggttttacatacacaaattacaatctcgccatgacgacggcttagcctccagtcaacatgcaaggacctacttcaaatagccctaaatctaccaccccaatatagataaggagcaaccacctagattaacagtcaagcacctacataccatgcacaacctcataataaaatacttgcctcatagacactaaacttacacaattgataccataacctagtccatgaactcacatcatcgaaacacatccacatcgataatcccctgaacattcacccaactcaccatcgcactctgctcccactaagtgcaagctccccaaacaacaaccacagacttttatcacaccaaattggacacacctaaaaccaattacactttactaatcaacctcccccatttcattacaaagtataaatgatcaccaaaatacgcgcaattactcaactgcaaacagtctcaaccaccatattagacacacaacactaacataaatacacaccactctacatactacataacttactccatacttccaatcacaatatgctaccaaacaacttatataacaacatcccaacaatatccaaatatgacccaactaacaca

SEQ ID NO: 649834 - DNA, 1681 bp, Homo sapiens
  misc_feature (237)..(237): n is a, c, g, or t
  misc_feature (266)..(266): n is a, c, g, or t
  misc_feature (334)..(334): n is a, c, g, or t
  misc_feature (410)..(410): n is a, c, g, or t
  misc_feature (441)..(441): n is a, c, g, or t
  misc_feature (451)..(451): n is a, c, g, or t
  misc_feature (481)..(481): n is a, c, g, or t
  misc_feature (507)..(507): n is a, c, g, or t
  misc_feature (514)..(514): n is a, c, g, or t
  misc_feature (899)..(899): n is a, c, g, or t
attatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagntttaatctccgagcctgtctcagtagagnactggctccttttataatttgttaccagctttacttttgtgataaaatattgatgttgtattttacantcttaagtcttaaccacagtcagaattatcttaatgtagattataattttgggcttttaggaaaaaaaaacaaaantctgatatttatttcaaaacgtattgaagcnacaaaatatnaatattgtgccatatgacaacaaagtcttncctaaataccccatctgtttagtacngtattgnggaatatttgagttctatttccatacttgaaaacatggaggatttgagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagngattaaaaatgaaatgtcctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaacaaaaaaaaaaaaaaagaagaagaacaaacaaaacaaagaacaacaaagagagggggggacggcagttgatacgattagtcagggaagccaactaaacccgtccaacagtagttggtgagtagaaagagcgcaaaaagaagaaagaaaataaaagcagcgcaggcgcaataatcaaaacaaaacgagagaggaagaaacagagacgatcaatgatcaggaaagccaacacctaggagttgagagaagaaacacgcgaagagctacgctgagccaaagctaggcatcgtggaggagagatagcaacaaactgcaggaaggcgaagcagaaacagagaaagatagtaagacacgacacaaacagagcatgcgatgaataataaagagaaagaataagagacaggagcgaaggagaacaacaagagaaggtggaagagccgtggaaaacaaatgaaaaagagataaacacagcgggagagcactaaacaaaaacaggaaaaaacaagaggaaaacgaaacagaagacaggaaaataaagcaaagaaaaaaagaaaggaagagaagaaaacagtaagcaaaacaaagggagaacacaacaagagagcgaaggcactaacaaagcaacaagagaataagcaacaagaacag

SEQ ID NO: 649835 - DNA, 1372 bp, Homo sapiens
  misc_feature (11)..(11): n is a, c, g, or t
  misc_feature (15)..(15): n is a, c, g, or t
  misc_feature (17)..(17): n is a, c, g, or t
  misc_feature (20)..(20): n is a, c, g, or t
  misc_feature (33)..(33): n is a, c, g, or t
  misc_feature (51)..(52): n is a, c, g, or t
  misc_feature (60)..(60): n is a, c, g, or t
  misc_feature (62)..(62): n is a, c, g, or t
  misc_feature (66)..(66): n is a, c, g, or t
  misc_feature (72)..(74): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (99)..(99): n is a, c, g, or t
  misc_feature (107)..(107): n is a, c, g, or t
  misc_feature (111)..(111): n is a, c, g, or t
  misc_feature (117)..(117): n is a, c, g, or t
  misc_feature (123)..(123): n is a, c, g, or t
  misc_feature (125)..(125): n is a, c, g, or t
  misc_feature (132)..(132): n is a, c, g, or t
  misc_feature (142)..(142): n is a, c, g, or t
  misc_feature (172)..(172): n is a, c, g, or t
  misc_feature (198)..(198): n is a, c, g, or t
  misc_feature (205)..(205): n is a, c, g, or t
  misc_feature (590)..(590): n is a, c, g, or t
aaaacaccgangccncnccncacaggcccaagncccaaccacagccagaannaccccaangnagancagaannngggcccncnagnagggaaagggganaggcgganaagnaaggcnaaacgnanggaagcnacaaaatatnaatattgtgccatatgacaacaaagtcttncctaaataccccatctgtttagtacngtattgnggaatatttgagttctatttccatacttgaaaacatggaggatttgagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagngattaaaaatgaaatgtcctttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaacaaaaaaaaaaaaaaagaagaagaacaaacaaaacaaagaacaacaaagagagggggggacggcagttgatacgattagtcagggaagccaactaaacccgtccaacagtagttggtgagtagaaagagcgcaaaaagaagaaagaaaataaaagcagcgcaggcgcaataatcaaaacaaaacgagagaggaagaaacagagacgatcaatgatcaggaaagccaacacctaggagttgagagaagaaacacgcgaagagctacgctgagccaaagctaggcatcgtggaggagagatagcaacaaactgcaggaaggcgaagcagaaacagagaaagatagtaagacacgacacaaacagagcatgcgatgaataataaagagaaagaataagagacaggagcgaaggagaacaacaagagaaggtggaagagccgtggaaaacaaatgaaaaagagataaacacagcgggagagcactaaacaaaaacaggaaaaaacaagaggaaaacgaaacagaagacaggaaaataaagcaaagaaaaaaagaaaggaagagaagaaaacagtaagcaaaacaaagggagaacacaacaagagagcgaaggcactaacaaagcaacaagagaataagcaacaagaacag

SEQ ID NO: 649836 - DNA, 294 bp, Homo sapiens
attcgcggccgcgtcgacttttttttgttgttttttggagacagggtcacactctgtcaccctagctggagtgcagtggtgcaatcttggctcactgcaacctccggctcccaggtccaagcgattccctgccttagcctccagagtagctgggactacaggcacaggccaccacacctggccaattatttgttgtatttttagtagagatggcgtttctccatgccggccaagctgggtcgacgcgggcgcgaatttagtagtggtagtcgaccccggaatttcggaccggga

SEQ ID NO: 649837 - DNA, 124 bp, Homo sapiens
ggtactctagagatccccaaactcttgactcgtgccgggtgttgttcagcccagagccagattgctgtgtccctgggtcctccacaggtgaccccggtggacacacgcgtaacccatacctggc

SEQ ID NO: 649838 - DNA, 333 bp, Homo sapiens
ctgcgatccagcctaggcaacagagttgagaccctatctcaaaacaaacaaaacagccaggcacggtggctcatgcctgtaatcccagcactttgggaggtcgaggtggggggatcacctgaggtccggagttcgagaccagactgaccaacatggagaaagcccatctctactaaaaatacaatattagggggcgtggtggtgcatgcctgtaatcccagctatttgggaggctgaggcaggagaatcgcttgaacctgggaggcggaggttgcagtgagccatgattgagccattgcactacagcctgggcaagagcaaaactccgtcttc

SEQ ID NO: 649839 - DNA, 140 bp, Homo sapiens
tcgatacgacttttttttttttctctttccttttttctttccttctttccttcttttttctttctttctttctttctttctttttctttcctttctttctttctttctttcctttctttcttcccttctgtcgtcttctc

SEQ ID NO: 649840 - DNA, 192 bp, Homo sapiens
ccagatttccgcaaagctgggcagttgttagacgacgaataaccaatttcagcttcgcctttgtctagatcatcttcagagtctgcttataccccaggactgtacttcccacttttcataacgagttaggagcctagtagttgatcgactccgagcaacttttctcgtcttctttgtcggccaccatcttac

SEQ ID NO: 649841 - DNA, 157 bp, Homo sapiens
gcaaggcagcaaacatgttttcaatcatgccattgtgtgctaccctcaagtgtgctgtgtttcatcatggcagtctcaacacacacacgcacaacgcaacaaacacaaatcacagcctccatccaaccatctccgggctatctcgtgcagcaccaac

SEQ ID NO: 649842 - DNA, 215 bp, Homo sapiens
gaaagatgctatgtgatgagtaagctgattttaccaggtgtatcgttatctcaaggtagagactgccctaaggtagatggtttcagcaggcctatagctttggtattgtttgacccttaagcttaagcatctcttaccatggaggacgaataaagctgtacattgttgcttgagagtctgtacattatagtccagatttgtattagcactgtcag

SEQ ID NO: 649843 - DNA, 174 bp, Homo sapiens
  misc_feature (48)..(48): n is a, c, g, or t
  misc_feature (122)..(122): n is a, c, g, or t
  misc_feature (161)..(161): n is a, c, g, or t
ccctcaaaaattaaaaatagaactaccatataatccagcaattccagnctttgggtatttatccagaagcattgaaatgagggtactttcaaagatatcttagcactccagtggttgttgcnccagtaggaataaccaagatatgaaaacaacgtaatgtnccattggtcagtt

SEQ ID NO: 649844 - DNA, 385 bp, Homo sapiens
  misc_feature (133)..(133): n is a, c, g, or t
gcaatacaagcttgccagtttttgccccaacagataatccaatgaaggctgtgaaccaaaattttggctaaagcagtctccatggcagtttgatttttaaaggccaaacctcccacgacttcaaagcagggtntcacatgttaaccaggccccctgcttagagctgcagcacaaaagcctggatacatgcaactctattccactttccaattcaacagtaaacttcagattccaaacaatgttggggccaaacagcattgcaactgcggagagaaaattctaaggagggctagacctcagaacctctgccaagagcatcctctttgggagtggctggggtccgcacacaagaaggcattcctcctgtggggttccactcttaggg

SEQ ID NO: 649845 - DNA, 83 bp, Homo sapiens
tcctgcctaaggtttatttggacaaatagcccaggaggaccccacccccatgcaaatgggaccccaggggcgggggggggggg

SEQ ID NO: 649846 - DNA, 1177 bp, Homo sapiens
ggtacagaaacattagactgttatgaagatcagacacaactgcactgagatcccagacgcgtatctaattctccaactaatagaggcaactgcaccatgtctgtggacactggcggcccatgagggacacccgtgacgagcagagtgcacgacgcaggtacccttggttacaacatgcgacgttccttcctatgcgctgggtagagctcatgctaccgtcgccgtggtccggcgcacatcgcgtgcgggctaccttcactggtgcccatgcgacgtcacgcggtcccgggctcgtatctagatatgtaccatggttcacccgtacccatggaattcctggcggtcgttgggacgaatgcgtggctccactgtataaagcttgcctcgaaggcttcctcgcccgtgtcgctgtgctttcaaccgccatgcgcattggggcactcccaggcgtgcatgtgtgctgtgctgcgtgtccgcatgtccgcagacacctgtcctcgcagtggggaccacatgaccatacatgaccagcgcctaacgtaatggaacgaaacattgaaccgatgaagcggacgcattggtagattgccaccccatgctcttccaagaattagtcgtagattccaccctcctcgtaaaggaggtggtaaccaccgcacatcatgaagacctggggaggcccttcacctgcgagagagcttgaggatcaccgttagagacacacacaatggtatgaacccaattcagacgtgtggatacaaggtactatgtagaagcatgtgatgctactacatttggtctcgctggttattgaaaactgatgcaaggcaactccgttgggagtacaagaatgtcacagaatggacggctccgactcgagaagaagtcacattggcaaacgctggagcgacatcccgtcatcctgtgcgtggagttgtgaccaagacagcgatctgggccctattcgcccttgtcagagcagcaagaggcggtcttcacatcttgccaggccacacaaactacggtttcttagtgcccttaggccccaggcgcttccacgatttccgcctggtactcggtccattaaaccggtccggtttttgccactggcaaaaacacgagtgacataaaaaaaaagccgtgcaatcaattcacaggagcaccaggcaaaaaacgc

SEQ ID NO: 649847 - DNA, 327 bp, Homo sapiens
ctagaggatccacatacattgtctgatgacaacaatgttagatctgtttttataggcccacaaggccctgaggctctgtgagtttttattttttatattttgaggggtaggtcagggtttgagtccatcacccaggctagagtgcagtggtgcgatcatggctcactgcagcctcaacttcctgagctccagtgatcctccctcctcagcctcctgagtagctgggaccacaggcatgcaccaccatgcctggctaatttttttttattgtattttttgtagaggtgggttttgatatgttgcccaggttggtctcaaactcctgag

SEQ ID NO: 649848 - DNA, 435 bp, Homo sapiens
  misc_feature (29)..(29): n is a, c, g, or t
  misc_feature (36)..(36): n is a, c, g, or t
  misc_feature (90)..(90): n is a, c, g, or t
  misc_feature (108)..(108): n is a, c, g, or t
  misc_feature (121)..(121): n is a, c, g, or t
  misc_feature (132)..(132): n is a, c, g, or t
  misc_feature (138)..(138): n is a, c, g, or t
  misc_feature (143)..(143): n is a, c, g, or t
  misc_feature (298)..(298): n is a, c, g, or t
  misc_feature (395)..(395): n is a, c, g, or t
tttttcaaccccaataattgagcccctanacctttncttgagagagccacaaaacttttaacccatagtctgtctgggagccccatgaancttgttttattcaaaccntgcaaaagaactnggaaaaatttngacatnaaaanctaggccaggctgggtccagtgctttatgcctacaatcctaccaatttgggaggctgaggcaggaggattacgtgaggccaggagtttgacagcagcctgggcaatatagtgaggccccatctctacaagaaatagaaacattagctggacatgnacggcatgtgcctgtagttgcagctgcctggagggataatgtgggaggattgtttgagcctgggaggttgaggctgcagtgagcaataattgtactnactgcactgcagcctgggtgacagacagagaccctgtctc

SEQ ID NO: 649849 - DNA, 733 bp, Homo sapiens
cggcggcttgatggcagcgcaccgagttcccgcgaggatcatgacctgacggtggccccggagccgcgctgcctctcgggtgtctgggtcggtggggagcccagtgctctgcaggccggcgttgcgtgccggaggtgctgcatgtctccctcgcggtgagaggaatggcggagtgagcggtgaacctgcggcggcgctcgcgcggctgcctgctggggcggaacgggcagcttccgtgtgcctgggccgccgcctcacgcagtggcggcgtgctcccatgcgcaggtcttcagtgtgcccagggttgtgcctgtgcgtgccgaccttgcgatgacacactccaagtttcgtgcggtcagggctgattgccgcgagtttgaccgcgggcgggggccttgtggcccttcttgcccctttagcgacggcaagcttccgcactgccaggggccggcaagagggcggctcatcgtcgggccagacgacggcctccaggtcacgaggttacggagggcgagcgccggagcggtcgtagcgctgcaggggaccgcggggacaaccttgaattggcccccgagcccccgggctccttcgggaccgcgactggcggacagggctgctattccacaacatcttacgcggaaccaggggacacgttgcgggactcactcaattgttcggcggccgttggaccgcgggcccggtcagagccaacaattcctgtacacaggttgag

SEQ ID NO: 649850 - DNA, 362 bp, Homo sapiens
agttatcagccttggctacggttgattctgacttctctctgatatgggcgtgtgagagactacttcctattaggagagtcaggccgtgtgggaataaaatagtctcattcccagagtcagaggagaagagccatgtaccttgaaccatcgtccttcctctcaaggctagccagagggtgggagccataaggaatgcgtggcagtatcagatgcgagtgatggtcactaggatcctgacccgctcccataagctcaggagtagcaagggtccctttctcttcttctcgccaggtccttccttaaggcctgtgttgttgcaccgtctgcttggttggctgaagcggtgacatgggctaccgaga

SEQ ID NO: 649851 - DNA, 962 bp, Homo sapiens
cggacgcgtgggatgtattatgtttattgattgtgtatgttgaaccagcgttgcatcccagggatgaagccaacttgatcatggtacataagcttttgatgtgctgctggattggttgccagtattttattaagaattttcgcattgatgttcatcagggatattggcctgaaattttctttttttgtgtgtctctgccaggtttggtatcaggatgatgctggcttcataaaatgagttagggaggattccctctttttctattgttggaatagtttcagaaggaatgttcccagctcctctttgtacctctggtagaattcggctgtgaatctctctggtcctggacttttatggttggtaggctattaattgctgcctcagtttcagaacttgttataggtctgttcagggatttgacctctttctggtttagtcttgggagggtgtatgtgtccagaaatttatccatttagaagagaaaatttttaatgttcctagcacaagaacaaagataaatgactgaggtgagagctatcctaaataccctggtttgatcattacaccttgcataattgtctcaaaatatgacatataccccataaatgcatataatttgttatatgtctattaacaaaattttaaaaataggactggatgtggctgatgaataaatgggcgatggtaatactatttctctacttcttatgttcacaaatattttactattcagttccaaaatggatataaaataaccaaaagattccaaaatactattttctggcttccaattaggcccttattggctggtaatgctcggaggtttgcggtttcccactcggggtgttgcacccgtgtaaggagatcttcaggcgctccacagcgggccattacagttcgggaacacaaatgactgtaaaaagaggggcgcatcgaaaatagattataacacgccacaaaca

SEQ ID NO: 649852 - DNA, 397 bp, Homo sapiens
tgatgcgcacacacctatctagtgaagtggtaaaggactgtggttctccgtaagattacaccagtcatgagcgagagctcatagacggagaagactccgggaaggcttgtacgcccaacagcccattgaccaccttctcatgtctggtcacagagaactgattagtcctcagtacctctccgaccaccttcatgtacacagtggacaccaccttcacaaagtactgaaacatcatgaaggcttgcggcgcagagacatcgcgtgtggtccaggaggttcacaaatgcctggatagtcctccccaaatgacaggtgctggctgtcgtgggtcctgttgacgcttgtcaaggggttgaggccgcagggctgcaatgggcccatctcccatctgtgcttt

SEQ ID NO: 649853 - DNA, 330 bp, Homo sapiens
gccaattttaggaagcctttcatgactctaccaagtagactgagtcactgttattcagtgcgtccgcagacctatgctcacactccatttatagacagtaattaccgactgctgtgaattgcttggctatattattagcagtggctttagatccctgacacaagctacatgtctgtcaccaaaagttggcaactaagatgaatcacagaaaactaagacgtgataggaatgggtgcagtcagtggcgacttgaggaatagggaacaagactggcagcctataaaggaacactgcaagtgtctgaaaaagtctcaagtccagactcacttt

SEQ ID NO: 649854 - DNA, 196 bp, Homo sapiens
gcaatatggcaagaccccatctctaccaaaaatttaaaaaaatttagccgggggtggcggcatgttcttgtagttctggctactcacgaggctaaagtgggaggatcatttgggcccgggagttggaggctgcagtgagctacgatcgcaccactgcactccagcctggacaacatggcaaggcctcatctcttaa

SEQ ID NO: 649855 - DNA, 338 bp, Homo sapiens
tccatacacgtatattctactgcaggcgccattgatgcttacggcggcccggtgcatccggagcgcgtcttcgtcattcatgacgactcgcgggcgtggattcgagcctagagcgtgcgcgaggcctagtaccctgaccacctcgcgcgacatcctcgaagcgatggcgcgcggcgaaggcccgtccaatgccgtggtcatcgttgtttgctgcggttggggcgcagggcagctgggaaagcgagctgtccggagaaacagctggttgaccgtgcgggccgatgccgaactggtgttccagctgccgcttgagcaggcgctggcagggtgccgcctcg

SEQ ID NO: 649856 - DNA, 1013 bp, Homo sapiens
ggcggagcgcgcggtgcatggaatgggctatgtgaattgaaaaaaggtatccgttatgaaacttccagaaaaacgagctacatttttcagcagccgcagcacggtccttggccacacaaggatgagaaaaatatccaaccacgggagcctgcgggtggcgaaggtggcataccccctggggctgtgtgtgggcgtgtccatctatgttcgcctacatcaagtggcaccgggccaccgacaccaggccttcttcagacatcaccagggcagacccgggggcccggatggggttcagcaggcccacagcccctgggggacagcatagcagacgggcacgaggtcttctacgggatcatgtcgacagcaggaagcactggcacccgagtacaacgtctaccagtatcacccggccccccagagaaactcccacgtgaacccacgaaagccttcacaaggcactgaacgccaggtcttttctgccctcatgctgctgatgttgaacagagagcgctcagggaatcccgggaacctactgggatgttgctacaacagggacatcccgtacgaccttctgggaaggccgccacctctggtcctcagaggccacagatggtgcacgcctgttactggaggacaccaggcccagacgtatgcggaacgtgaagcacaggcatctaaagcttcgcactaaccctgaggggatggctgcgttaccacccacgagcgggaaccgacgaagggcgttcgcgtgaccaccacgatgccgcaaggcagctgacataccacagacgggagacgtggccagctgacctggcggacgatcacacacgtcctcctccgccgacgcacccagcgagatccacccgagacacggggcgcggcacaacgcacacaagatgctaaaacacagacggaaatgacagaaccgcgagcgagcccaccggcacactgcccggtcccacgaccgcccagtacggcgacgcgcactcaagcccagcagacacacaacgcga

SEQ ID NO: 649857 - DNA, 834 bp, Homo sapiens
cccagctgcaaaggtccttactcggcgcacccggaagagttcacgaaacatctggaggcacacggagttgaacccctcaaccaaggaggctagcttcaccaccaagaggcgaagggtcgggaacttgggggggtctggagtggttcggggggatgacaactccggtcgtggaggaaacttcattggtctggtggctttggtggcaccctggtggtggtgagaaatggtgcatggggatgctataatggatttggtaatgatggaagccattttggaggtggtggaagcacaaagattttggggatacaacacatcagtcttcacaaatttggacgccctgaagggaggaaaatttggaggcagaagctctggcccctatggcggtggaggcccatactttgccaaaccacgagaacccaggtggctatggcggttccaagcagcagccagtagctatggccagtggccagaagattttaaataggggaaccaagcttagcaggagaggagagcccagagaagtgacagggaagctaccaggttacacaccagatttgtgaactcaaacccagccaacagtggtggcagggcctagctgctcaaccaaagaagacatgttttagaccaaaaacatcaaagtgtatgggcaaaaaactcgaggaccgtatttgtgactaattgtattaacaggttattttaatttctgtttctgtggaaagtgtaaagcattcccaccaagggttttaatgtagatttttttttttgcaccccatgctgttgattgctgaatgtaaccgtctgatcgtgacgctgaataaatgtccttttttttta

SEQ ID NO: 649858 - DNA, 1024 bp, Homo sapiens
gctcttattaggcctgctgccacttccacgtaggactgtagactgtgcttcctcctggcccactggttgtagaggcctcccacaagctattgtggaacctatgtatgacgaaggaacaacagtgatctaaagctctttagcaaaccaagcagccagcgcactagctgcaggacacaagaacttttcaccaagaacaacagtcagaggtgattccatcagatccactacttactagtctgcattaccacggtccttaggaccagaactatgcgagtgctgaaacaatgacttctcttcaacaggtggctggagctgggtttgccatcactgccccaaggctcgggtctggggacatcgtctttcaacgtgaccaacctaatataccagtatacgaactcctcgagtactcctaatgcggatgggacagcgtaggatacgatacacctctaggccttcaagcccagtgcacaagggctctctaagttgaaacggacaacagtggacccccgtgactcccttatagagtaagacgagtggcccataagggccaaaagtcactggaaccccctcgtttggccattccttgggacaggcttaaagccatccatggcgtttccaggataattggcaacattgggctataaacccgttccggtatcgccccatgggtttcccaccaactgggctttagacaacattttaatatcccgcgtggatcaatccctgtggaagacacgccatttcccatttacaccatcacacatttcggccaacaaccgacatttggggaacagtacacccatataaattcgttcccaaggggactacgttgtgggctctcccaattaacggctaaggcattgtctcccaaaaactctatttacagggtcaaccacaacctctgggcgcaaatcccccttctcaaatatgtcacaataatatatccgtgttgtttccaacattgtctacaggcaaggacacttgcatacactctggtgtcctcagcacacagcacaagcctggg

SEQ ID NO: 649859 - DNA, 558 bp, Homo sapiens
  misc_feature (209)..(209): n is a, c, g, or t
  misc_feature (242)..(242): n is a, c, g, or t
tcgtctagcaggatccttgaaattgtgtggtgttatgttactgcgtaccattcaaacttctagactaaaggtcatcctccaaagggaccaagaggtaatgagctaggaacactatgataagcattggtatatccatggctcatgaggaatcgtggcatccttgaggatggtgttgtgccagcgttgaaggtttatgacgtttcctttgnagattgcttaggaaacattcttgtacaaggcanaatcctctcgtaaaaccttctcgaaggagattgtgtggtgtgtatgggtacattttcttacagttgtattaatttagaaaaatgtgtaatgacctattgataaaggttgtaggatattattgtgtatcctagagtaggtaatcttttaccctatagggagagagtgaagtttgttacttctctctcctttatacaacatagtggtccccactttattccccccacatgggcttgtgacctacttaagtacaagtgatagatagtgtgacctctctcacatttttgtaattgtgcattacaccacactaagggatcc

SEQ ID NO: 649860 - DNA, 338 bp, Homo sapiens
  misc_feature (209)..(209): n is a, c, g, or t
  misc_feature (242)..(242): n is a, c, g, or t
tcgtctagcaggatccttgaaattgtgtggtgttatgttactgcgtaccattcaaacttctagactaaaggtcatcctccaaagggaccaagaggtaatgagctaggaacactatgataagcattggtatatccatggctcatgaggaatcgtggcatccttgaggatggtgttgtgccagcgttgaaggtttatgacgtttcctttgnagattgcttaggaaacattcttgtacaaggcanaatcctctcgtaaaaccttctcgaaggagatggagttgtcgactagcttgaacagtagaatataaggggacatgagaatcataacaccacacaatt

SEQ ID NO: 649861 - DNA, 276 bp, Homo sapiens
gccaaagttgctgctctaccaaattctcagcagctcccttttacctattctgtgtggcaacgtctcgctgctgagtgcttttttctagcacttttatcaggggacctgctgtccttgggttgctggagcatggagaaatgccagtagttaatatcacttctcattctgcatctccatcctctcactcaccaaagccccaaactgcagccaacatagtcgatgattgaatgggggtagataggaatgcccagctcccttacctccaggcaaaaaaaa

SEQ ID NO: 649862 - DNA, 336 bp, Homo sapiens
aagtcctggatgctgtggaactttgttgaaagatggctaatagccttggcttcatggacttgggctctctgccgaatttctcttttacctttaatagagacttttcatctgaatggaggcattatcttacttttgttaatattcatatcaatagcaggtattttgtataaattccaggatgtattgctttattttccagaactagccatccctcttcaacgtcatttattgtttcccattggcccacctaggcatttcacacattggaaaaccatttttacaatcaagatacgcataagtattggtaattaccgaccttgaaatcctttatttttt

SEQ ID NO: 649863 - DNA, 141 bp, Homo sapiens
ttaatatagattagatcccatttgtcaattaagacttttgttttgttgcttttggtgtaatagtacataaagtctttgcccatagcctataatcctaaaattatattagcctaggttttcttctggtagtttttataggtt

SEQ ID NO: 649864 - DNA, 314 bp, Homo sapiens
ccggttcctttttttcccaggggggccaaggaattaattttggtttccccccaattaaaattcccccctttcccatcaggtcattgaaaggccctttaacgaaagaaatggtccctgaatgggaatttttttaaaaacccctgagattaaaaaaagcctttttggataacttataggaaaccctagacccccccagtaaagtggggatttttttttttttcccttttttttttggccaaaagttaaattaccagttttagttatgagtttggttccagtgttttttttttggggggtgttttaacttttgtcca

SEQ ID NO: 649865 - DNA, 566 bp, Homo sapiens
tgtatggtgaacatctagccacgtaaaaggcgttggatctttgtactgatactacagttcgtcttctggctaattcagagaaatgtcttttaatcatattcgtttacttatcccagatccttggaactcatgaaaaataacttgccagattttgcatcagccctcagtaagtcatgaaccatagagaaggtcatggggccatttatccttcgtgaccactggtctacttctgaagttctggcttcctaactctctaaggagtgagtcgtgtataaccagcttttaagttaatagtgcgtcatactgagtttgagcttctcttctgacttgatttttaactttcatgaaatgggaaataatgtttttccattctgctgttcatttagaagtgggactttgaggtgttagtaatgtcattgtcactgttctgaaagattgacagttgggaagacaagatatctcatgtctagtagtatgcatattagttttgtcccaccatgcctatctttgaatggctaacatttaaaagacatctgttctagttgcaccactactctagcttctct

SEQ ID NO: 649866 - DNA, 227 bp, Homo sapiens
accatattctattctgagagagtacatgcaatacgaggagccccagacatacagctgggcatgggtataaggcaggacatagtacctgcttagtcatagacaatattacatgtcctcatgtagctccccttaactgaaccccccttaacaggcgggattctgcctccagaataaacctaaggcagctctgaccaatgaatgagcccctctaggcaatgaacatcctc

SEQ ID NO: 649867 - DNA, 1010 bp, Homo sapiens
  misc_feature (165)..(165): n is a, c, g, or t
cagcacgcactctagcaaagtgtgcctgccccgaggccaagccctcagttacctcgtcctactccccagatcttgaacgatcacaactagtaatctacatcaatccgatgtaaatgagtcatcggagtgatctgcacgtcattagcggccagttagtcgatagcnctggcgtttgaggacattgttgtgagaaggcagacaggtgtgcgctgcatgactcaggtgagcaacagaaatcacgtctagggcgagacacacgttgaactgtgaagtgacccagcccggtccgagttgaaaccagccactggaagtccgtatagaaccacagtggaccaccggcggcactggtcacagggtacaccgaacacaagccctggggacacaccggagatatgacgccggcagtgtgatgtagactttttctcaagcgacactaggatacaaccgagtagtgtgaaagcccattggtgatgctccgaatgtgtgtcacacaaagacaggggaggctccgtggggcgatgaatcaattctcacgtttgacaagtatgaggtcggagatacccattccagacggcgagttgtagggccataacaattatacccgatattcaagatcactgggacaatcctatgtacttgctatcgctcagacagagagcataacgggtgagtgtgtagtcctgatcaccaggatttcgaacattgttctcgactctatcctagatggacatagtgggcagacatacatctgccccagaggaagaaacaacaagagatgccctagcaacccagcaaggccattccatgcagttcggtaagcagttggacatagggggcctagacagactctagaaagacgcagctctggcaagagtaaggacatacttagtggtagttggaccttatgcggtaccacccttttccaattaaactcaagaggatacgacccgaatgcaatacagttcttcgactcctccaacatatgtgggagaccacagacgtgctgcatg

SEQ ID NO: 649868 - DNA, 803 bp, Homo sapiens
  misc_feature (6)..(6): n is a, c, g, or t
  misc_feature (70)..(70): n is a, c, g, or t
  misc_feature (75)..(75): n is a, c, g, or t
  misc_feature (129)..(129): n is a, c, g, or t
  misc_feature (143)..(143): n is a, c, g, or t
  misc_feature (185)..(185): n is a, c, g, or t
  misc_feature (195)..(195): n is a, c, g, or t
  misc_feature (202)..(202): n is a, c, g, or t
  misc_feature (219)..(219): n is a, c, g, or t
  misc_feature (223)..(223): n is a, c, g, or t
  misc_feature (227)..(227): n is a, c, g, or t
  misc_feature (258)..(258): n is a, c, g, or t
  misc_feature (271)..(271): n is a, c, g, or t
  misc_feature (276)..(276): n is a, c, g, or t
  misc_feature (286)..(287): n is a, c, g, or t
  misc_feature (320)..(320): n is a, c, g, or t
  misc_feature (330)..(330): n is a, c, g, or t
  misc_feature (341)..(341): n is a, c, g, or t
  misc_feature (344)..(345): n is a, c, g, or t
  misc_feature (349)..(349): n is a, c, g, or t
  misc_feature (374)..(375): n is a, c, g, or t
  misc_feature (377)..(377): n is a, c, g, or t
  misc_feature (382)..(383): n is a, c, g, or t
  misc_feature (387)..(387): n is a, c, g, or t
  misc_feature (389)..(391): n is a, c, g, or t
  misc_feature (393)..(393): n is a, c, g, or t
  misc_feature (417)..(417): n is a, c, g, or t
  misc_feature (420)..(421): n is a, c, g, or t
  misc_feature (445)..(445): n is a, c, g, or t
  misc_feature (460)..(460): n is a, c, g, or t
  misc_feature (462)..(462): n is a, c, g, or t
  misc_feature (464)..(464): n is a, c, g, or t
  misc_feature (473)..(473): n is a, c, g, or t
gggacngcttcagggcttctccgcgactggaccgggcgccgctcgaaagcacgccctccattcgcactgnttgtngggctcatcatgaagcgcttgggctccgtgcagcggaaaatgccgtgtgtgttngtgacggaggtganagaggagccttcctccaaaagggagcatcagtttaaagtttnggcaactganactgtanagtcacaaggcattagntgcngatntatacagtgcaattccaacagaaaaagtggntggaacatgtgtnatgtnctacctatanngatcagccataccttgggctcgactagatgaanagccaacaanacaagctgaanaanngatntaaaaattttctacattcaaaagannanccaanngaantnnntnggaacgttgaggaggacttcaacncannctccggagtgctggataccagcanaggagacagaacaantnantgggaaccnagtgcctgatgaaaatggacacgttcctggtggggtaccagtagagaacatcaacaaagggtattgcctggcatccgtctgctagttcacttatgaatctgaaaattgcccgtggtacgaaaacaatcatccctgatgattctggaacttttggaaattagtgcagtgcactgtcagatctcttagaacaaaccgtggtactcataggaacacatatcatgcaaccagtagggttagggagcacgagcgtcattcatctcttttacccctgggcattcaagtaaaaatctcctcttgagcccaggtctccggccggttgacatgcccacg

SEQ ID NO: 649869 - DNA, 272 bp, Homo sapiens
cgctgtcggccagctaccagagcaaccaggtggagctggacaactacgtcaagaccatcaaggaagcggtcggcatcgccaacgtcaagagcgacaagatcgaccagatcctgcgcgacgcggtctccggtcgttacggtgacagccgtcagaacctggacggttcggcaccggtgaagaacggccagggcggctcgttcatctcggccatcgtcgaagcctaccccgacatcaagggtcagctcaacgtctatgaccacatcatcgccaag

SEQ ID NO: 649870 - DNA, 155 bp, Homo sapiens
cagcagcgcgagcagtcacaattccatcaagcaggtcaagcatgccctggccaaagcatgtgttgttcatgcatgtccacatttcagcacagcagctcttgcatcactcatgtggcaacaccacacaggtggcttcacaggcgcagcatcaccca

SEQ ID NO: 649871 - DNA, 838 bp, Homo sapiens
  misc_feature (6)..(6): n is a, c, g, or t
  misc_feature (70)..(70): n is a, c, g, or t
  misc_feature (75)..(75): n is a, c, g, or t
  misc_feature (129)..(129): n is a, c, g, or t
  misc_feature (143)..(143): n is a, c, g, or t
  misc_feature (220)..(220): n is a, c, g, or t
  misc_feature (230)..(230): n is a, c, g, or t
  misc_feature (237)..(237): n is a, c, g, or t
  misc_feature (254)..(254): n is a, c, g, or t
  misc_feature (258)..(258): n is a, c, g, or t
  misc_feature (262)..(262): n is a, c, g, or t
  misc_feature (293)..(293): n is a, c, g, or t
  misc_feature (306)..(306): n is a, c, g, or t
  misc_feature (311)..(311): n is a, c, g, or t
  misc_feature (321)..(322): n is a, c, g, or t
  misc_feature (355)..(355): n is a, c, g, or t
  misc_feature (365)..(365): n is a, c, g, or t
  misc_feature (376)..(376): n is a, c, g, or t
  misc_feature (379)..(380): n is a, c, g, or t
  misc_feature (384)..(384): n is a, c, g, or t
  misc_feature (409)..(410): n is a, c, g, or t
  misc_feature (412)..(412): n is a, c, g, or t
  misc_feature (417)..(418): n is a, c, g, or t
  misc_feature (422)..(422): n is a, c, g, or t
  misc_feature (424)..(426): n is a, c, g, or t
  misc_feature (428)..(428): n is a, c, g, or t
  misc_feature (452)..(452): n is a, c, g, or t
  misc_feature (455)..(456): n is a, c, g, or t
  misc_feature (480)..(480): n is a, c, g, or t
  misc_feature (495)..(495): n is a, c, g, or t
  misc_feature (497)..(497): n is a, c, g, or t
  misc_feature (499)..(499): n is a, c, g, or t
  misc_feature (508)..(508): n is a, c, g, or t
gggacngcttcagggcttctccgcgactggaccgggcgccgctcgaaagcacgccctccattcgcactgnttgtngggctcatcatgaagcgcttgggctccgtgcagcggaaaatgccgtgtgtgttngtgacggaggtganagaggagccttcctccaaaagggagcatcaggtcagcacctattggggaaaccccctaatcagccatttaaagtttnggcaactganactgtanagtcacaaggcattagntgcngatntatacagtgcaattccaacagaaaaagtggntggaacatgtgtnatgtnctacctatanngatcagccataccttgggctcgactagatgaanagccaacaanacaagctgaanaanngatntaaaaattttctacattcaaaagannanccaanngaantnnntnggaacgttgaggaggacttcaacncannctccggagtgctggataccagcanaggagacagaacaantnantgggaaccnagtgcctgatgaaaatggacacgttcctggtggggtaccagtagagaacatcaacaaagggtattgcctggcatccgtctgctagttcacttatgaatctgaaaattgcccgtggtacgaaaacaatcatccctgatgattctggaacttttggaaattagtgcagtgcactgtcagatctcttagaacaaaccgtggtactcataggaacacatatcatgcaaccagtagggttagggagcacgagcgtcattcatctcttttacccctgggcattcaagtaaaaatctcctcttgagcccaggtctccggccggttgacatgcccacg

SEQ ID NO: 649872 - DNA, 275 bp, Homo sapiens
cccattgcttgtgatagctgaaagccaagcaccaagcaaggactctatctgtagtaatttaatgacactcaaataaaattggttttcgaatgtccccaaaaaattagttttagagttaaaataataaagttgcattttagcttttctctccttctttgcttaaggagctcaccaattcctaaagtttgaaatgtgccaaagtagtacctcttctctcatcaatacctgaagtccttagctctggttcaatgactacttttagtatgtctgtatga

SEQ ID NO: 649873 - DNA, 268 bp, Homo sapiens
caatgaaactccaagatagttctctccaccagcacggggctacaaagacaggccagggggtcgcacactgtgggtactttccgtgagaactcataaaggtcgttgggacttcctgactctgatgaagtgggaaaagtactgcatgatttccaacgacaggctcttctcctccagagacaactgcccctcataggctgggtagacgggaagccccacggcaaactgaacatccgccagcacctccaggctgccatggacgtcgtttcca

SEQ ID NO: 649874 - DNA, 100 bp, Homo sapiens
ggatttgctggtgcagtacaactaggcttaatagggaagaaaagacagaaaaagagaaggagcaaagaaggaaagcagggagagaaggaaaaaggaaaaa

SEQ ID NO: 649875 - DNA, 241 bp, Homo sapiens
catgtgctgtaaggtcgagcgaattttgatttatatataattattttggaaacagtgtcccgcactggtcccccaggcgggagtgcaagggtagcaatttcggctcactggcaattgccacctcctgtgtccagttgattctcgagaactcagcctcccaaatagctgggaccacaaactgtgcaccagtggctaagtttttcttatctatggttttatacaaaattcaaaaaaaacaggg

SEQ ID NO: 649876 - DNA, 188 bp, Homo sapiens
gatcagcgctgtaccgggtttatcgatgccactgggctctgggctaggacacgagtgagaccctatctcagaaaaagtaagattataagaacagacatacaaagatacggagactcactatactgtatatgattggatatcattagcacatcaagagtactctacgctctggaattgctatctagaag

SEQ ID NO: 649877 - DNA, 221 bp, Homo sapiens
  misc_feature (202)..(202): n is a, c, g, or t
gcctagcctcctagacacttttcagttgattccagtctgggatgcccgcctgagggatctaagcctcccattgtctcggctcctggctcagctagaaccatctttcccattgtccctgtggtgctagggtttcagtggttattaacgtctgtgttgtatcatcttgcctgaatttcagctctctgtaaccagttccccaaanaaatcccccctttacctac

SEQ ID NO: 649878 - DNA, 311 bp, Homo sapiens
  misc_feature (96)..(96): n is a, c, g, or t
  misc_feature (105)..(105): n is a, c, g, or t
  misc_feature (123)..(123): n is a, c, g, or t
gggctatgcaagggggtgatcttttagactcatcatggaagattggagtagctaggatacacctgtgggcttggggaattgggggcaaggaatgtnttgtcagtnctcaggttcatgtaaatnttgtatcggcagggatgggccttggttccctagagacaaggaaagcatttgggggtgaaggcaggaaggctagaagagagtggatggaagattctatggggtaagagtgaattgaggaaaaccccatgaaattttgggaaaaggaacactatttctgatttggttgtctaaagcagagggacctttat

SEQ ID NO: 649879 - DNA, 101 bp, Homo sapiens
gccagcaccaaccagacatctatgtacctctgtgccagcagtaacccggacagggaggaaggacgagcagtacttcgggccgggcaccaggctcacggtca

SEQ ID NO: 649880 - DNA, 180 bp, Homo sapiens
ttttttaaaaacagggggggcccctaaagggggggggttcccggaggggttttttttttaatttacccttttttttttaaaaaggggtttttttgttttttttaaaccccctttgggttttttccccttgaccctttttttttactgggttctttaaaatttttttttttggggggccca

SEQ ID NO: 649881 - DNA, 129 bp, Homo sapiens
agagacttcgccgagagtcgtcggggtttcctgcttcaacagtgcttggacgagaacccggtcgctcgttccccatcccggctcggccgcccatagccagccctccgtcacctcttcaccgcacactcg

SEQ ID NO: 649882 - DNA, 335 bp, Homo sapiens
  misc_feature (44)..(44): n is a, c, g, or t
  misc_feature (102)..(102): n is a, c, g, or t
  misc_feature (106)..(106): n is a, c, g, or t
  misc_feature (109)..(109): n is a, c, g, or t
  misc_feature (111)..(111): n is a, c, g, or t
  misc_feature (182)..(182): n is a, c, g, or t
  misc_feature (323)..(323): n is a, c, g, or t
  misc_feature (328)..(328): n is a, c, g, or t
gcaggggcagagcggtctcaccccccgcctctccccggcccccnccgcccatatggcgaggagggagccccctcccaacccgggctcgagcggcggcgcctnaggnagngngtcatcatggaactaattcgctgaccgacccagcggccgagcgtgcgtcccgctcgagcgccagaccagcnccgcgcccccgatccgcttccctttctccctcctcagttggccgagtcgtccgcgcgcaccgctccgcgccctatgagaatgaggtggtaacgggcccccggatgaccccgcgtcaccactgtgaggcctacagctctgcnggggngggagga

SEQ ID NO: 649883 - DNA, 150 bp, Homo sapiens
cgttaaggaaaccagaatttgacaaactccaacaatacaaaggggcatgttgctaatgagcgcaagaagagctgaccatattagatttgatgcttgggggatcatagagaatttatgtctgcttttctaaatctgaattataatagctta

SEQ ID NO: 649884 - DNA, 117 bp, Homo sapiens
ggtttgggcccccccctttattccctgccccgggtaaattagccccggggggccccccccccccaggggttttggtttttccccttttttttaaagggggggggtttttttccccca

SEQ ID NO: 649885 - DNA, 105 bp, Homo sapiens
cagcgtcagggtcaataatcattcaggtgttttgaaaatccaggaaaaatattcaggatggggccggggctgccgaaatgtgttcccaggctgtggagtccccag

SEQ ID NO: 649886 - DNA, 187 bp, Homo sapiens
acccgcggcgtgttcatgcagaagatgtgctgtttgggctgcatctggaaagaggattattgggttgcaggatgggcactgaaggggggggtcactcccctcccacacacacacacacacacagacacacccctgccccccgtcaatgtgcacacacacacacacacagacataccctctgccaacg

SEQ ID NO: 649887 - DNA, 379 bp, Homo sapiens
aagtctttttcacattattataattggggtgttcactagagtagcccttttcatttccttcaagaactttgccagccgggtgcggtgactcacgcctgtaatcccagcactttgggaggctgaggtgggcagatcacttaaggtcaggagttcgagaccagcctggccaacctgatgaaaccccctttctactaaagatacaaaaattagcctggtgtggtggcaggcacccgtaatcccagttacttgggaggttgaggcacaagaataacctgaacccaggaggtggaggttgcagtgagccgagatcacgccactgcgcttcagcctgggcagagcgagagtctgaaaaaaaaaatatattccaacattaccatgt

SEQ ID NO: 649888 - DNA, 190 bp, Homo sapiens
gccgggaaactgctttacactataggcattgttacactgtggatgctgtaattagggtcctgctagtttttccacagcaagcgtgtgcttctatcagcactaatatttctgggatctacatagtactgtttaaattatggtacatgtcatttaatacatctcacttcagtctgtctatcaatattgttct

SEQ ID NO: 649889 - DNA, 101 bp, Homo sapiens
aggatctgaagtcaccgcgtactcatgctcaccagcggcgctcgcgtgcgaacgccagttttggccgttttttgcggtgcagaagggtaaaaacagcagtt

SEQ ID NO: 649890 - DNA, 405 bp, Homo sapiens
  misc_feature (166)..(166): n is a, c, g, or t
  misc_feature (171)..(171): n is a, c, g, or t
  misc_feature (175)..(175): n is a, c, g, or t
  misc_feature (182)..(182): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (201)..(203): n is a, c, g, or t
  misc_feature (208)..(208): n is a, c, g, or t
  misc_feature (213)..(213): n is a, c, g, or t
  misc_feature (215)..(215): n is a, c, g, or t
  misc_feature (217)..(219): n is a, c, g, or t
  misc_feature (225)..(225): n is a, c, g, or t
  misc_feature (227)..(227): n is a, c, g, or t
  misc_feature (242)..(242): n is a, c, g, or t
  misc_feature (252)..(252): n is a, c, g, or t
  misc_feature (290)..(290): n is a, c, g, or t
atagtgcggctgcagcttgattacaggactgatctaccatcaccacgccagggatcgcaggagtgccagcgtgtaagcctccccatacgggatgtggtacttgggggcctcatcactcacgtccgtctcgatgcgagacgggaatgtccagaaggcgatcggctcntcatnggtnatgtganatgccttncanccngtgtnnngtctnggganancnnntctgcngncaggatgtgtccatngaccacgttnccacaaaggtgaagtccaccaagttcttcccatttccnatcacgaacttcatcttgccgttcctggctgcctcgatgaggatgggtaccaactgcgggtcccttggggcgaaaatgccatgagggcggatggctgtggttcggacattcttct

SEQ ID NO: 649891 - DNA, 186 bp, Homo sapiens
ctccttcacagtcgggaaagtaatatgagtaggactgtgtatgctactagattatctgctcgttgttctataccacttcacagctctggtttcatctggattatgggctttagagaatgttaccccacctggtcataatttatacctcattttgattcatgactctgggttatcattccagagtta

SEQ ID NO: 649892 - DNA, 167 bp, Homo sapiens
gcgccgctccttgatcatcaagggcctgccgacccaactgaccgaccagctcaagcgccgtaactgatgctgggcggggtgctcaagaaagtcctgctggtgttgctggtggtgggtgcgatccagaactggggcaaggtggagcggctgttcaagccgtcccaggt

SEQ ID NO: 649893 - DNA, 470 bp, Homo sapiens
taagtgcatctgccactgtaaatcatagtcatgactaggacaatatgttgagcccgcctagtgaatgatctaaccaggagggtcttgggaacctccaacaatttcaaaccatgtcttcctccctaatactttcttatttttgtcctcacttaaagccaccttatatctgctctccaaattttatttccacttcgtttttatcttcctttttctttcttctctccatagaaaacaggacctgttagctgtacacttccctgaaactagatccatttacatattcaatctttcactgaactatgaaaactcattgatttattcaataagcatgtaacaggcatttgttacattccaggctctggaaaacaagctcagtaagagagtcttattcagtcacttaaaccttacattcaaacgaggaaaacaaattagtaagaaagcaattattttgttgtggctatatactgcat

SEQ ID NO: 649894 - DNA, 225 bp, Homo sapiens
caaagggctggaggttacagggcatgagccacggcacccgggcagtcctctattttctggcccccatttccagacccctccagtcttggttcccagaacaccttcagaaggcatgagtaaaagggaggtgataatttccaactcacaggatgggggggggaagaaagggagaccatctataaaagtcttccaggtagagagccgggcaagggtaccggagctcga

SEQ ID NO: 649895 - DNA, 116 bp, Homo sapiens
aaggtagacgctctgcctatactcacatgtataaggcttttctgaagtgtgaactctcatccagttcgattcccacattcactgcacatgtaagatctttccctaatgaggtctcc

SEQ ID NO: 649896 - DNA, 427 bp, Homo sapiens
  misc_feature (22)..(22): n is a, c, g, or t
  misc_feature (77)..(77): n is a, c, g, or t
  misc_feature (160)..(160): n is a, c, g, or t
  misc_feature (272)..(272): n is a, c, g, or t
  misc_feature (274)..(274): n is a, c, g, or t
  misc_feature (277)..(277): n is a, c, g, or t
  misc_feature (285)..(285): n is a, c, g, or t
  misc_feature (291)..(291): n is a, c, g, or t
  misc_feature (298)..(298): n is a, c, g, or t
  misc_feature (303)..(303): n is a, c, g, or t
cactctatactgtaaagtacgnaaacagcccttgacggtgaaaaacagcagcggcctgcagcagctggccttaccanactgtgaaatccgtcgctatcggggagttcttgaatctgcagacccgtctggaggagaaaccagatctacggaaagttcatcnaaaaatgtgaagggtcctaaaaagctctttccagatcttccatttggaaacatggacagtgacagagtagaagcccgtaagagcctcctagaatcattcctaattggggggngngcnattccagngatcgntaacagnggttnggtgcaggagttccttgctctgaacacagatgctcgtattgcctttgtcaagaaaccatttatggtctctagaatagacaaggtgttaccgatttggaaactagaaatcacctttttacttaaa

SEQ ID NO: 649897 - DNA, 213 bp, Homo sapiens
cgctcacacgggagggacacggggacggtggagtggcgcagagcggatggctgagaccgttagcgggaagcagggtgagcaccatgcgcgggacgctcaggccgggtcgggcgttcagtcatctccaccacacaggtacagcagcgctttctggtagtcgcccttagcgtctcgcgggatataataggacagggactggccgaagctggagca

SEQ ID NO: 649898 - DNA, 87 bp, Homo sapiens
gatttttaaagacaaatatctaaatagaaaaatggccaaaacaggagttcaagaccagcctgaacaacgcagcgagaccccatctct

SEQ ID NO: 649899 - DNA, 1536 bp, Homo sapiens
tggtgtgtgtgtaggggctgtcttggctgtgtcgtggtttgggtgtgctgtgtgtgtggttgcgctgtgcggcggctcggtaggcgagtgtgtgtgtgcgtgctggtgatggcgtctgtctggcttgtgggttggggcgtgctgttgctggcttggccgcgcttgctgtgttgtgtgttcgaggtcggtgctcttgctggtctatgtgtgttggccgttgtgggtgcgggtgcgccggtggtgctgcggtgtggctctgggcctcggacttgtcgctgtgtgccgtatgcctggtgttcgtccctgtctgttagtttgtgacttgggatgtcgccgatccacgatggtgttagtggtgatgcggtgtctcggagtgttgggttgcttgctggtgtgcatgcttgctgtgggggggagcgtcagtttggcttgtgttggatggtgtgggaggagagggcggttggctctgctcctggtagatttgtttgctcgactgccgtcgtagtcacccggggtgggctccggggggattggcggggatgggtttggggtgctcctgcaggggggctgtgggggcgcgtcattgtgggctggtcccgttggattggggaacgagggtagtctcctgtgtgtgtacgtcctgtgctcagtggtgagtcgtgtccgagatgccgtccagcggctcccttgtgcgcttgacccgtgtggtcttcgtgtcaggagggtggttgctggtgctttgtcggggtcgttctcggcgctgggtggtgtgaagggtcgcgtttggccaagggggggggttcctcgtgtttgttcggttccccagtgtggttgtgtgcccccaattggatggggggcgtttccttctctgagtgttttgacgctgctaggtcaggggggccaaagttgtgtctgcggaaattgcttagccttgaatgtggccagcgagccgtgccgagggggctccaagtcccaggtggccaacacaatgctcgtgttgcacaaggaggcctgtgggggagacgttgctgtagggggtgctgtgctaggcaagtccagtgaggtcctgggccctccttgggagtcttgggggccctcgggcccagtgcctggacctgtgtgctgttgtgttcccgcacgtcgcccactgggtgtccgcttgttgtattcgtggttaaaagtttatgctggacttgcacgccctgggggtttcacggcttcggtgccatcaggcccactccgttcagccttgtggcccacctctgtgggcaccaatgggggctccaccaccatgcacccaatctgccccgcagggttggtggcgagtatccacaggcgctctcatgtgggaccatgggcacccctgaccgggcacttttcagcgcccgttttgaggaccagacaatcacacacacgagtgtaggcgtacatcccaccacaccccagctggtcatcgcattggatttcacatacaagcccaccgtgggtcatggaccacctttattttataccaaaatttcaaacaagtttttacca

SEQ ID NO: 649900 - DNA, 758 bp, Homo sapiens
catggtggctcacgcctgccacccatgaccgggtaatttgtatttagtagagacgggttcactgtgtagccaggatggtctcgatctcctgacctcatgatccgcccgctcggcctcccaaagtgctgggattacaggcgtgagccaccatgcccgcgcttaataactttttaaaggatgtcaagttaatggaatgtatctgctcctacattcttccacccggggttttgttacaaattagtcccagatctagtgtgtacattctttctcaattacctttttgtggctattgggaaactttctttaacaaagaggtttttcctcaccctttggttgtgcccaagaaggggcaggaaggaaaaaccaaaagatttgggttccaattggcaaaggtggtttttcccctttaggaggggggggaaaccccccttaaagggaaaaaacacgccaaagaggggcgaaaacgggcatcgcttttttgttgggggcaacagtgcgcgggccgccaaaaagggggggggggcgacacccaaacagaagacagacggggggagtcttaaacagacattttttttttgttatcaccacagacaaagaagatgcgacgacgaagaaagagtaacgaaggagagttggtgtgtggtggggggagcgagagaagaatttagtttatagtcgacgagaggagaggtggggtgggagatgattgagtgattgatttgtgattagtggagagtagttagtgatgaggagaggga

SEQ ID NO: 649901 - DNA, 445 bp, Homo sapiens
cccccgggattttggtagtgatgacattcatctatagcaacatacatacaatgtacagatgtataggatgtggacataagagtttctgtgacgaaatatgcttcagatgagaataccaagaacataatagagttcatgcagaggcctaaggataatcaagtagtcactaagtttatcttaagatctacacttataggatgctgttattgctagcacaattaagcaggcggagtctttcatttgctcaaacactggaatctttggttgctaccatatcagctggcttgcagacgagaagcctaccattttaagaatgttgtaagtgaacaacttgcaaaccccagggatggaaaaaccctaagaatgcacaattgtgagcatttaacaaccatcacaactgtggctgaagactgttcatgccgttcttctgaaatgagatctcaaa

SEQ ID NO: 649902 - DNA, 1337 bp, Homo sapiens
ctgtttgtcttctttctctcgtcgtgcttcttgttcttttgtttttctgttcctgtttgtgatcggttcgttagttgcgtgttgtctgtttccctcgtggtttatcattttgtcgcttctgctgctctgtcgtctcgttcttctttggttgctttgcttcgatctgtctctgttcgccttgtgggcctctctctcttttcgcggttgctgtcggttccttgtggcgttcttgtgttgttcagtactgcttgttttgtggttctttgtgcttctgtgtgcgttgtcctcgttgtgtcgcttctttcctgctcttgtttggtgctgttccttgttcggtattcgttcccttttggtttttagtgtcctgtgttttcctgactgtttgtctggctggggtcctgtttcagctctttgtgtgccgggtgcctgttttgggctctccccggtgtcattctcccctggtgccggttcatgttgtttttgttttgttgggttcctgttttgtgtgcgtttgctgtgtctttggccccgttgtctggttcctgtagtctggtgttgtgtctttttctaggccgttggtcgtcctcgtgcgtgcttgccaggtcgcttgctgctgtgatcccttgggtgttttttgtttcagtgatctcccttccgtgaaaggattggacttttaatctttctggtatgctagtgtatctatgggccttctgctcccgttgcgtgaattgatctccatgggaaatcccatgtatggtccctgtgcgtgtgcatagtggcttcgtgcagtgtttcatcgtcatggagggcctgtaggggtactagcgagtgattgtccctctccacctgcctggccgagtccttccttgtttcagtcttcctctgtgcgacctcttccagggatgcagtgggagtctcaggattctctgcccctgtcatctcggcgtagtcagaatgtgtatgggtgcctttccctcggatcccatggccccatggcagagcttttgcacctgcaggatcccctttgagggcctttcaaggcgtctctccatgtgagtccccctctgcctggcccccctatgccccagctccctcttggtgtcctgtgccaagtccgccccatgggcctggggctgttgggatgccatagggccccctggtatctcagttccctcacgattcccgatcatcgggcacacctgccccctggttatttgtaaatatttctatttggatcccaattctcctctggaattgtgctggcacctctggctgccgcagctcatgtgatacgtgtggtggagtgggatgaggccgatggctaaccgaggggtggg

SEQ ID NO: 649903 - DNA, 125 bp, Homo sapiens
gcggccgcctactactactactactgctcgaattcaagcttctaacgatgtacggggacatgcaaggtctacaaactcctcggacttttggccaggggaccaagctggagatcaaacgaactgtg

SEQ ID NO: 649904 - DNA, 780 bp, Homo sapiens
tgggactctaatcaacttccctttggtgggggactttggggattcacagaaatcggagttgggaggccctttaaaaaaaaactccggatttttgacggagtaaattgggcgtgtgcccaaacagattttggttatattgggcgcccctgtgtaagaaggtaactccctgtgggggttccccttcttataaataattgggcgtataattggaccaattggcttaaggggcaaacggtgattttattatacaaggactcgcctagaaaatatatatgcattctttggatttcaaagaacgcaaaaaggtgtctctctaaattaactccctttaaaccaacaagattaaaactaaggtgggggcacataattaacatttaatttgcggcacgaaatggggtgggtaaataaggccgtaagacgcaagttattagcaaatatgggagagggccccggtgtttcaaggtgaggaccaaagggcgggccccagggttataattaaccggttttctccgggacccctttatttaattttcttctacccaaagttttcttcccactggtggtgtttccctttttgcgcacaaattgtgggtagcttttaaaaaagatttttcgtggacccccaggtaggttcaatattcgttgggaggaccattctcttgagagaatttctccaattttcaaaaattaacaaaaaattttacattctatgttgggtactaaaggtcacagggtttggagaggctaacctattcatgtattaaatatagtttccccaag

SEQ ID NO: 649905 - DNA, 812 bp, Homo sapiens
ccctttttttttgtttgttttaaaaggtagttaaataaactccagaaaataatagcagatgcatggaaatatttgacataatctcgattttcaaatctctcattcaaataaaggggataaaaataaaattgcggcctttacggcagcagaacctcttgccggaaagggatgggtaaaataagatacttcacgggagaggaactaatttaggttaagaggtatgcatattcagctaagaaaatacaaccctttttcagctatatagagtagggaatataaaaggatatttctacatttttggaccggtattcaaagttctaaattcaacttggactgtgaagagagaaggtgatttgggtacccatacagagtagatcatcacaattacaagggaaagataattaacgtttaatatgcggtaaattggctttggaaagttggggtcagaaaggctgtgataataattcgggcccaaacaggtatgcttataccgtgacacaaatttcactaaaacctaacactttgggctgggagttctggggattccgacttcctgagtcccttccatttccaaagcaggttccatggagagcaggcaaggttgggggaccaggtgtatgatcaagactaattcagatgccaaagtttccaagctcacaggggaaagaaggtgaaacacagaccggctgctgccacgtggcccccagagacttgaaaagggaacaaatcagaaaccggtcaactggtgacctaagaaaatttgcaaaacccaagcattactatgcagtgactcaaactcttagatcaaatca

SEQ ID NO: 649906 - DNA, 768 bp, Homo sapiens
ggggccagtcgcgctgctgtcctgctgggcctcacctggtgctttcggcctcctcttacatcaacaaggagtcggtggtcatggcctatctcttcaccaccttcaagcgccttccagggggtcttcatcttgcgtctttgcactgctgccttacagaagaaggtgcacaaggagtacagctaagtgcctgcgtcacgtcctactgctgcagtccgcatcccctcgaccgcgggggcacttcacggatccgctcaatgactcctcagcccatgcgaagtcaacacccgctactacactaggggacccagagccgaattcggcaggatgtggaatgaccactgtgaggaatacagacggatgctcgcgtcgcttcatgggcgggtgacgatcaagcagagaggccccgagcctgagacgcgaagggtacccagtggggggaaccaacgccgtgcgtgaaccaagccccgattgctggcaagcgccccgtggggggcacctagttcccctagcaaaacaccccgtgcattcggccgagttcaagtgagggcttccaactcctcgtcacctcgggccgcccctaggttctttccaaaacgtcacccccaaggggaaggcctaaccccggggaaaagccacagagacaagtccccctttggggaaggcccgagtgcaaggccttgtagcgccatttgggaacgaactcgcttggtcgcccttggaaacggggcaaacctttcaacataaagcaggttagctcctttgcgaaag

SEQ ID NO: 649907 - DNA, 105 bp, Homo sapiens
atcaacacacccaaaaagatgacagactacgccaagaagcaagggaggatccaggagcccaaacaactactacagaatagctagcgctgagtaaccagagctccg

SEQ ID NO: 649908 - DNA, 351 bp, Homo sapiens
agcatgagagctggacagatggagcagactcacaaattgcccagcgacacaggaaatgaggctgcacagcgtgctcaaaactaaagaaacccatatcagaacaaggaatgttcacccatcagatcaatgaggattaaatgacttatacctaataaaacgatcaaaatgtgaaagaaccagaaattgtagatggcagtgaaaactggccctgtcccttggggtgggcaattgagcaccattattacttaactacatctgcgctttgatctagcaatttcatttctaggcgtttttcctttaaatatattgacagacagttgggcgcggtggctcacgcttataatcccagca

SEQ ID NO: 649909 - DNA, 150 bp, Homo sapiens
tctcttgcaatttcaaccaagtccataacggtgataataccatcatcaaccgtcatagaatcaacgatttgtatacgcccctatttgatgggcaaaataagtaattcccacgcgtccagagccttatcgcaaagcggtacaccatatgcg

SEQ ID NO: 649910 - DNA, 836 bp, Homo sapiens
  misc_feature (27)..(27): n is a, c, g, or t
  misc_feature (83)..(83): n is a, c, g, or t
  misc_feature (89)..(89): n is a, c, g, or t
  misc_feature (91)..(91): n is a, c, g, or t
  misc_feature (103)..(103): n is a, c, g, or t
  misc_feature (120)..(120): n is a, c, g, or t
  misc_feature (151)..(151): n is a, c, g, or t
  misc_feature (189)..(189): n is a, c, g, or t
  misc_feature (248)..(248): n is a, c, g, or t
  misc_feature (269)..(269): n is a, c, g, or t
  misc_feature (323)..(323): n is a, c, g, or t
  misc_feature (336)..(336): n is a, c, g, or t
  misc_feature (363)..(363): n is a, c, g, or t
  misc_feature (388)..(389): n is a, c, g, or t
  misc_feature (393)..(393): n is a, c, g, or t
  misc_feature (403)..(403): n is a, c, g, or t
  misc_feature (423)..(423): n is a, c, g, or t
  misc_feature (427)..(427): n is a, c, g, or t
  misc_feature (432)..(432): n is a, c, g, or t
  misc_feature (445)..(445): n is a, c, g, or t
  misc_feature (466)..(466): n is a, c, g, or t
  misc_feature (478)..(478): n is a, c, g, or t
  misc_feature (485)..(485): n is a, c, g, or t
  misc_feature (492)..(492): n is a, c, g, or t
  misc_feature (513)..(513): n is a, c, g, or t
  misc_feature (518)..(518): n is a, c, g, or t
  misc_feature (549)..(550): n is a, c, g, or t
  misc_feature (552)..(553): n is a, c, g, or t
  misc_feature (733)..(733): n is a, c, g, or t
  misc_feature (739)..(739): n is a, c, g, or t
  misc_feature (745)..(745): n is a, c, g, or t
  misc_feature (749)..(749): n is a, c, g, or t
  misc_feature (768)..(768): n is a, c, g, or t
  misc_feature (773)..(773): n is a, c, g, or t
  misc_feature (826)..(826): n is a, c, g, or t
aatttgttattgtggcttatttctccnagacaaaccttctgtgagtttaacatgcggtattacattaggtactacggtcaggntaaaanancacctgattttnttagagatgtgtttganatatttttaggtgacataaagaaggcctganatttgcttccaggcaatccaggggcaagacaaagaggnaacaggggtcccgctgctgagacaggcgggggcatcagatctgcttgaacacatccgtngcgaaggggtagtcacacacngctcggccctacgcttccagctcaagactctgtccagggtcccgttctctcccnggggggctttggnagggtttggggggcaaaccattagggnatggggcagctgagcagtggggggnncgcngggggggggncggcccgggggggggggggnggcncgggnggggggggggggnctccccgggcgggggcgcggngcggggcgaggncgtggcngccgccntccttccgggcccgggcggcnccggnggcggtcgccggccgtgcgggcggccgcgcnncnncgggcgccaggacgacagcacagcccctttcctgggcaagcctgacatccttctgaagctgcaaaaatgggatattgaagaacttatgaaggtactttaggccgaagctgttcttcatggaagactcagcatagcggaagtaggaggaactggaggtctgtccaggttgtcgatgaagtnacgcangtcgtncggnagatgactcggtgctcgcncatgncccggtagttacccagcacgcacactggcacgtggggtgggcacttttggaanctcccggaga

SEQ ID NO: 649911 - DNA, 147 bp, Homo sapiens
tagtacacgctcatatggccacacttgcaacggacgtacgtcagtcactcatcaggatatagtcagcgatgaaattaaactgcacttattcttccatagcatcggaaaaagtcagtatgctcttggtgtaatcataaacaatctccg

SEQ ID NO: 649912 - DNA, 405 bp, Homo sapiens
caaactcgcgtgggagccacattactcactgaaaccattccttctgaaacatctaacacactccagaacactctccttatacccctacccaataacttcaatactgcttactcccaaattcagacattattctcaatgacttcaacaaagatgctcaataacttatctacatcctgaccttcaaaaactcctaagaccttcatctgcacttcagctagccacaaagaaactcaacagagccatcaactgaaaagtgctaggccgagtgtggtggtgcacgcctataatcgcaacactttaagaggccaaagcaggtggatcacttgaggtcaggagttcgacaccagccctggccaacatggtgaacacctgtctcctttataaatacagaatcttagccgtaca

SEQ ID NO: 649913 - DNA, 237 bp, Homo sapiens
aggcgagtcgcagtcacacttggaagccctcatgagtgcaggtcccgtcacttgtcgagagggcctcgactggtgatgaaatttaccgcacagccatctggagatgagcctgatattcagccaccatgtcttcaaattcatcaggattgaagtaggtgaagccccacttctttgagatgtggatcttctggcggccagcaaacttgaaattggcccttgtcagttcctaaatcacat

SEQ ID NO: 649914 - DNA, 129 bp, Homo sapiens
aaaggcatttgcacagacatgggaggacctctgcttaacgggtaatgtcagctctactgcagggcacggctgtttggtgagtggattgaaactgtctctgtatggccagacaaaacgtagacaaggtag

SEQ ID NO: 649915 - DNA, 122 bp, Homo sapiens
tgagacgcagtgtgtggtgtggtactcactgatgtccagcgtataatgactctgtctacttttccctactactactgccttactgtcttaagaaaaatctgacttacgattttggattcttt

SEQ ID NO: 649916 - DNA, 499 bp, Homo sapiens
  misc_feature (418)..(418): n is a, c, g, or t
  misc_feature (443)..(443): n is a, c, g, or t
  misc_feature (457)..(457): n is a, c, g, or t
  misc_feature (490)..(490): n is a, c, g, or t
aagtgttggggattacaggcgtgcgcttgttgcccagcctgaccaacatggcggaaccccgtctctactggaaatacaaaaattagccgggcgtggtggtgtgtgactgtaatcccagcctcccaggtagctgtgactacgagcacccaccaccacgcccagctaatgtttttgtattttttgtagaaacaaagtctccttgttttccaggctggtcttgaactcctggggctcgagcagtctgcccatatcgaccttctaaagtgctggggagttacaggcatgagccacttgcacacggcctatagtacacattttttaaagtaggatttctggaattttacggaaatattttacttaaatttcttcctggcaaaagggttattacatttgttatccataggtttagggagtaccnggggtttcacccataacctttgatnaactttggaggtantcatccaaactctggtaaatctggtccattctnggtgggggt

SEQ ID NO: 649917 - DNA, 418 bp, Homo sapiens
gtctacttgtccatgcgctacgcatgactcctgctcacgcatgccgcgacactgctgggcacggacctgtcgatcgacactagactgctagtgtcctaagatatgaagtcctggagcacatgtcctgtcacagatggagaaagccatctctgagactggcgttaccactgtctacctgttcacttcagagatgtacacctacggagctgagacagacagggatggagctgactgcactgacgggccgactgatgagctatttggccccactggcgagcttgctggattgagtgtggctgtcacatgtccaagctcacttatggagggatcgaccagctggttagccggaccgacctgctgctgccagatactaagcacgctcagctgtcagagaccatgcgacgtggagaggatgccc

SEQ ID NO: 649918 - DNA, 125 bp, Homo sapiens
tactcaaggaaggactggccaagggagagggtgccttccgggcagtgctgtgctgtatgcagctgcaagggaagctccagctggtgtcctccatccttgccaagtcactgtcaggagagtctctg

SEQ ID NO: 649919 - DNA, 164 bp, Homo sapiens
ctgagaagaaaatccatggttcagaaaggacgcaccatggtaaagaatatcatgcggacaaagtttgggtgcttattaggaagcagtttagtgctctggctaaatgaggatataagcagaaaagacttttggtttcaactccttagggttacagggctccctgg

SEQ ID NO: 649920 - DNA, 120 bp, Homo sapiens
tagggcaggtcagaaagaggaagcaagaaagaagaatccgaggagtctagatagataactagggcaaggtctaatagactaaacctctataataacagtacgataaaaagctagaactat

SEQ ID NO: 649921 - DNA, 152 bp, Homo sapiens
gatacagaaacaagaagaatttaagcacatagcagtatttccctgcaagataaaaatcctccctcagtacattttttattctcgagatccgatagtgatgggaagtgtcaagcaaaatttgttgacatcggatgtaggtatacccatacaca

SEQ ID NO: 649922 - DNA, 977 bp, Homo sapiens
caggactacctagggctgcagagaggatctacctcgacgtgtgggcttcgtctctgattgagagctgaacactcactgggacgcgctgcctagtgggaaaacagactgttcactctgggtctcctctgagcctgttactgtcgctcagtaaaggtcttcttgctgcttactcgccctccatttgtctggcttacctcattcatcctggacacaggacagagaacttgggacttgccggtatggtggagctaacacatagtctgtaacactaagtcaggattgatagacatgccccttgctcgccacattggtggatgacaagagggagggaagaaaggagagaagatctgtgagccttcggcaaacccagagttaggagatcggagagccaagactgtgagatccttatctggggctctgtggttcctggcgtctccaagcttctgggcacctcggtttccccggtgccagtcgtggtaagctgcttgtgcgagagtcttgctttagtcagccaggctggagtacagggtgtgatcacagcttactgaaacgtcgtgcgtctcaggttcaagcgattatttctgcctcagcctctggtgtagctggaagttacagggtgagcagtcactgatgctcatggatgagaagactgggacatccatcagataagaaaggctgcccaaagtgtacagtaataagtcgacagggtcggacaagaacccaatcactcaggcttccggaagagtgagtgatagacgaaatagagaatgctagtctggatgagaaaaaacacgacattgtccgggcacggggtcaaggcggtatccacggactagcaggcaaggggcggacatggggccggagagggaacacgggtaggggggaacccgttgggaaatcaaaatagccgagggggggggctgagaccccactggagtgggaaaggacacgggggggcgcagagaacagcctggcac

SEQ ID NO: 649923 - DNA, 631 bp, Homo sapiens
agcggtgtgttttcaaaaaagatctgtaatgaattttatgtgtggcatatacttatttcttgagagaagattttaacttattgtttttattttatggttacatatgatgataacctgctattattaaacttttctaaaaagtgaaaaaaaaaaaaaaagatttaaactcggtccctactctgtattcgggatccatctgagatgcatgctaagctatgtgtatgttttaatttggcactgctcttcctggcaatttgtttaatggttattgcagaatattaggtacatgtctcctctgtttaagtaatattgccctttataaaaaagtatgattaagcaaactattttataaagtgccctgtttaaagcatttgcactgtattttggccactttatttccattttctactttaaatttgtccctcacttcctcttctactttgtttgcaccacgtagcaaatggggcttgttgtgtctgtagtcagccacttatgccccattgtgaggaaaacctaagggaatttaactaaacactgtgcttcatatttgtaccctgtgttgtcctacagctgaggaattcctccctgtagtcatatattatgtacctaatattttagaatctacctatga

SEQ ID NO: 649924 - DNA, 983 bp, Homo sapiens
cgggtctgacgctgaactcaggatgtcgtgaaacttatccgttaaaaagtccactacgggaaaggcaaaggatctatcatcacctatggtcgtcatcgccacgcgtagatacggcggcacgtacagcatgactggccgtctgatctatctatgctgcggcctcgacggctgactcatcgaaaacttcgagaaagagatggctgctgcaacatgggcctggggctccattcaaagctattgcctcatgtgaggctctatgtgccttactgtgccaagcattgagacttgctgaactgcctggtaatccacccatttgtataatcatccgccttgatgcgtaacttagagaaacctatgtcatgattcataatgatgaactacttcatagggtagctcccaagtgtatacaagtcccattattagtccaaaatgaccatagaattccacccgaggcacattgcgtctcgagcttagattatggttgcctgtccgttgacatcgtggcatagcttaggctgtgtgtgatgaatattaggaacgcgctcgggctatcatctccatgcattatgggccacgcatgcagagaagcatgtcaccttcttagcgcctttccattagtgggtgtcgcataatgaagggcaattagtcgtgaggtaaagctacaatcgtgctcttcaagaagaagaccagccccttaaaagatcagcatccgatggagttattgacgtgcataaactagtcaagcgcgacagtacgacgccatcctgttaacatgaccgggcacaattgcgtgcattaccaaaaaccccggactaggaaggcatgtcaatcgggtgggccagtctattcggcgatgagaatatgtgtcgaacggaacattgacctagtgcgtccattgatgattaacctgtgctctatggaacctacggggcataggaaacgtcaccccggagagggttggcaaaaagcctgttgtcaacggg

SEQ ID NO: 649925 - DNA, 148 bp, Homo sapiens
actgtcatgacgggaatcccgcatgctggtggcaatggtgctaggttgggcttcattcagcttgaagacactctgttgtgctggctggcaggccctgtggttgctggctgagggttctgctgtcctgtgccaccccattaaagtgcag

SEQ ID NO: 649926 - DNA, 1060 bp, Homo sapiens
agcggagttagtcgcgggggccggcatccgcttgttcgtagaagcaacgactttggcagggatgacgtccccagggtcggcatcagcgtgggactgggtaacagagtgaagggaaagcagaaggagagccttgagaaagacctgctctctccgtccgcatccataagttgactgagtccaagtgagagccaacagaggtcactagtgcatcaagctggagtcggggatgcgggtttccaccatgtcggcattctttcgtcagagcggggaagtatgagtggggcggaatatgggagaatagggagggactcgcgctcgagcgcatcgtggcttggggacgacgggtccgttaattccggcacctgttcacatctgactggtatctggattcatacggttgaccccagatacaatcgaaatcgcagggcggctagggcagggtgggaatcgacgacgaggatactactatttcccacgctagtgctagcgagaatacgcgagtacttgacggtccactacttcacggcgttgtaccgaagaagactaggacgatcccggcgtagtaccagaggagactggcagtccgagtgtgcgaggtggtctacaatggaatccgtgggcaagccaggatggtcaagcacatcctggccacaggcgagggaccctcagccttcaatacgccatcgtgtgtgagttggaacccatctttcatgggaatcccagtcgggtaccctagcaataaggcgaggggcttgtcaggaacgactagaacggccagggtcggcagccgtggacgtcccctctccaaggtaactggcttgttgccacagaagggggtgctcaaggacccttacgacgggtgggccagggcctaataagcgtacctccttggagcaacattggtgctgtctcaagaaggaattggacgcgcgtaatcaatctttacactgaagtcctgggaatttgggggataatccaccttaccaccctaacaagttcccaaaaaggggacccagtatggccacagaagggccagaaggcttatgccaagcaaaaaatg

SEQ ID NO: 649927 - DNA, 390 bp, Homo sapiens
ctagaggatcccttgctatcatctggcacctgctgggggaagcagggggaaatgcctcaagtatttctattggttaaaacctcggtgtgagaacactgcttttggccactcaatggaagacagttcatcaaacaccagtgagtgggacttctggagcaaagataaaagaattcatggctgcactgcaccgattctgaaaaggaggaacaaacgcccctgtttggaacatgaatcttggccctatcccattgtgagatggtgccagctgtgccatgacatgattttgtttgggtgtgacatcttgtggtgcccatggtgatcacatattgtgcaactcatacacatctatgcttggctgagtgtgaacttggatgtgccatgcacacaatg

SEQ ID NO: 649928 - DNA, 123 bp, Homo sapiens
  misc_feature (2)..(2): n is a, c, g, or t
antgagggcagtgcaggttggtggtgcggtagctgtctagggagagcagatggccaatggtgtgcctggttggtcagtgaacatgaacacatcctgctgcctggatgttggcacagaagtgcc

SEQ ID NO: 649929 - DNA, 806 bp, Homo sapiens
gtcggcgataagggcccggcgttctggacctcgtgtcgcgatctgccatgtctccagtggaggaagatgaaagggctccggaagcgccgaggctgcggtctcccaggcccgtgttcagcgactcgtgaggacggcgagtttgagatccaggcggaagatgacgctcgggccctggaagctgggacctggaatgacccactgggctaccgttcacccactcatcggaatgctactctcggatgtggacgcctggacacccgggagtattggtgcgtgcccagaacgaaggaagaagaagaagtcttggaggcttccagtcctattgggccgtgagtctatcccggttgttcaaatggcatcatgaacgaagcgggtacagagtttgccaatactcccaatcgcagagtgatagacgcattcccgagtgattcttatggaattggcaagggaacgtaggtggccattggccgcaggatcggggcatagtgtcgagggacagcactgcgttaccttccatcccaattgtatcgagctggctctaagaccccatcagttgcccatgaccggggtcgccgtgcgccttcattccttcttcgcccgaccgcggagagcgtgggccgctcaagacccgtgaaagttcactacagcgacgctacggtcgatgttcaccttggccttcaaaggacttgcccgtgatccttgggttggagacagggattggatgaccaagttttgcacgcccttgtaccgaacattcccgacagttaatttattgcccatggccagggacggattggtgcaatgtg

SEQ ID NO: 649930 - DNA, 237 bp, Homo sapiens
tttcgcctttctactagattctgagtgttttatcatgaacgggtgctggatttttatactttgttggcttatttacattgacacgttttttctatggtcaagtaacatttggtaatatttgggttgattttaaaaatattaagccaccactccattggtgacaaactatggctgggttatggtatgtaatcagttttacatgtggctggatttagtgtgccaccatttctttttttt

SEQ ID NO: 649931 - DNA, 704 bp, Homo sapiens
gtctttcaacttccttccttagtatctcttcattcctgtagtagttattatgtctataccacttggttcttatcacatattattttttataatgtaatgtaggcatgccagaaagttccatattttctaaaaaagaaaatttaattattttgcctcactctctatttctgtttctgaagacatagtcaatgaatatatctgtctcatgaccccagctagattgtaagaccctcaagtgcatagaccataccttaagatgttgtgggttttttgttttttttgtttgtttgttttgcacaagcatagattgagctgttgtccataataaatcaataggtttgggattgcctttaagaacaaagatgactcatgagtgcagactggctagattatcaatggctagagcatagatgaagaaatggacttcatctctcgggaagtcaaggcattttccatatccgatggcattaaattatcatgtctcatccttttgccaatccttgtccttgtttaaagggcagaaagtgtgatggactcatgcaaattcatcccttcagtcctggggggaggaattcatggcttcctggatgtggcttgattattttgtgcacaaggaggcttttcctaagatgataaaggcatttttaccaaaagaagatagcagctgtgtaaagttcatgctatagcattttagtgaatcaatg

SEQ ID NO: 649932 - DNA, 346 bp, Homo sapiens
  misc_feature (66)..(66): n is a, c, g, or t
cccaaacggaaggccattttccctgctcttcctcagttgtccggggcgggggtggggggttctccnaggaatggaaaaaccaggccctttagaggatcccaaaaagggaaaagaaccaggggcccttttcttttttaatcagcccaccttttgactccccgcccgccccaatccattatttttttttgccttccgggtcccatccttaaagctcgagtcgttccttcccctcctggattccgggtaggaaaggcagccccgcaggaggcgggtgcccgtttgtcccaggcctgggcgtggtggaggaaggggtgctggaacaataaacggccctatccaaatgtca

SEQ ID NO: 649933 - DNA, 589 bp, Homo sapiens
taaaacgggcttttacagataccacccctttgcaggaccacacagcgcttccagcaatttacaggtgttctccctgtgagtgctcaggccatcacaccccgtcattatgggaggttgtaggagagaaggagttatgacagatgaccctcctcgtgagtcaatactaagatgactctcgggtacccgcccctcacttatcagccacgagaacaatagtgtgcacaacacaacgcgtggttccacactctcggcaaagcttctctcgcacacaacaagtgctctaatggagattatattgtggacgcggtccaacacacctccttaaattatgtgtgttgagacacgcaccctcgtgcccctttttcgtgttccgttgtcagctgaacaccagggtgctgtaggtgctggttcagctgccgcacacagtcgttgaactctttgtcccgcgcaaacactctggaagagtttgaacaagttcaatcagtatagaaacgtgtgttcattctcccccaccctaaaattgtcagagtagttaattcctcccaacaaggaagataagcaagggcgcacccccacgacaaacaaaaca

SEQ ID NO: 649934 - DNA, 160 bp, Homo sapiens
catcggatgatctctttcctaagcagcaagccggcagttatcattaactccccgcaactgagaagcatagcaagttagcatgtgggaaaacagaccccggtactgtcttcgtgatgaataaaaacatttcaactccctacagttgtgccatgcatttaag

SEQ ID NO: 649935 - DNA, 197 bp, Homo sapiens
aggctcggtccggtatagcggtctccctctgtctccagactagttttttttccttaatatctatccctaacaaatgattgctcttatctgttgctatttttcgctccactagcatgttggctccatgagaacagaggtttctgtctgctgtgttcactgctgtatctccagtatctattccatgagaccgctctacc

SEQ ID NO: 649936 - DNA, 213 bp, Homo sapiens
gccccaaattttttggggcccccccccttaaattggggggggggcccttttttttcccccgggcctttttttggccaaaaaatttaaaccccgggggggatttttcccccccccgggggggccccttggggggggggggcccttttcccccctccccaagggggttttttttttcttttttttttttttaaaaaagttgggccccccccccca

SEQ ID NO: 649937 - DNA, 347 bp, Homo sapiens
catgagaacagagctcgcaggtgacttcttgatgtgtctgtaaatatctggctggctcaggaataagcacttatatgtggaaaatgtattatctacagtcgggagtaaatgttcatagaaacgctcacccagtacgatgctttgtcgacgagctggatttaacgtttcacatctcggctccccagctggctagctgtgtgacgtactctgataggacatacgatttacgctttacagcacgctaccccgatggacaaacaccataccaaaggggtttactttattctcacataatgacgacattcttaagcacgggaccagtaattatagtaactgtaagcagcata

SEQ ID NO: 649938 - DNA, 441 bp, Homo sapiens
tgacctatgcgactgaatgagatgaagaaacagattattagcatgcaatggctctatacagagcataccagaaatacctgatgacctgaagcaactttctaaacctgtgtgcgaaatctctcagaacactgttctcccgatggcagctgcccagaggtgctttcattgatcaaagccaatctttgaacatccacattgctgcagcctaactatggcaaactccactagtatgcacttctacggctggaagcagggtttgcaagcactgggatgtattatttcaggacgagaccagcagctaatccactccagttcactctaaataaggggaagctaaacgataacgacaaggtctcacaagcggaagaagagaaggagaggaacacagcagccatggtgtgctctttggagaatagagatgaatgtctgatgtgtggatcc

SEQ ID NO: 649939 - DNA, 510 bp, Homo sapiens
  misc_feature (25)..(25): n is a, c, g, or t
  misc_feature (200)..(200): n is a, c, g, or t
gattgagaccatccctgctaaacangggaaaccccgtctctacttaaaatacaaaaaattacccaggcatggtggcacgcgcctgcagtccccagctacttggcaggctgaggcaggagaatcgcttgaaccccgagaggcagaggtcgcaagtaagtggagattgctcccactgcactcccagccctgggtgacaggtncgaactacgtctcaaaaaaacaaacaaaggctgggcgaggtggctcacacctgtaatcccagcactttggggggccaaggcaggtggatcacctgaggtcaggagctcaagaccagcctgaccaacatggagaaaccccatctctactaaaaatacaaaattagtcaggtgtggtggcacatgcctgtaatcccagctacttgggaggctgaggcaggagaatcccttgaacctaggaggcagatgttgcggtgaaccaagatcacatcattgcactccagcctgggcaacagagcgagactccatctca

SEQ ID NO: 649940 - DNA, 361 bp, Homo sapiens
  misc_feature (40)..(40): n is a, c, g, or t
  misc_feature (259)..(259): n is a, c, g, or t
tctgtcacaacaactcaactcagctttgtagtgtgaagcnaccataggcaatatgtaaatgaaagtgctgtggccaagagtggtggctcatgtctataatcccagtactttgggagccaaggcagaaggatcacttgaggccaggagttaaagaccagcacgggaaacatagcaagaccttgtctctacaaaaaatgaaaaacttagccgggcgtggtggtatgcacgcccagctagttctttttcttcaaaaagacgntgaagcaggaggatcattttaacccaggagtttggggctgcagtgagctgttgactgtgccactgtgttctagcctggacaatagagtgagaccctgtccta

SEQ ID NO: 649941 - DNA, 301 bp, Homo sapiens
gaaaagcaaggttgtatgacgtgaaagaatatttcgatatgcatgtgtgaggcaaatacatgggtgcgacagatgagaacatttaagtacttggggagcctaggagagtatgcttggtgactaggagaaacaaactggttcagtttccagtttcagaatacaatgaaagattgctctagaatacaaagaacagtcgaatggtaatggtacagggaaacgaaacactctcatgaccaagatttctaaccaaacgcgccagagacgaccccagatagagagaagacattctatgcgttgtcgc

SEQ ID NO: 649942 - DNA, 696 bp, Homo sapiens
  misc_feature (237)..(237): n is a, c, g, or t
cccccccgttgttaatttggggaatttgcccaccccaaccgggcgttcaccattgcaagccagtttgctgagctgaagggaaagatttgatcgccgttctggtaaaaagcgtggaagatggccctaaattcttgaagatctggtgatgctgcccattgttgataatggttcctggccaagcccacatgtgtgttgagagcttctccagactatcccacctttgggtcgcctttgctngttcgtgtatatgaggaccagaccagattgcggtgtggtgtctatccaaagaccagtgagaccaagaaagagctgtctggagactggcaaggtccacccagatctgccccagaaaagactccaggaagagcataaatggaatattagtccctagtacctgccaccccccacacttcttaaatcacgtggtggagagaagcggttctcagaaactgtttgtttcacaatgtggccactttaagtttagtagtataaagactggttaatgataacacatgcactcgtaaaacctcctcacgaaggaaaggagaatgttttgtggagccacctttggttttcttttttgcgtgtggcaggttttaagattattagtttttaaaatcagtactttttaatggaaaccacttgacccaaaatttgtcacagaattttgagacccctttaaaaagtttaatgaga

SEQ ID NO: 649943 - DNA, 115 bp, Homo sapiens
cagaaatatgcctgcacacatcatggtgaagtgcaggctatttctgcagtttaatataatcaaactttgtaccaaccatcgctccatggtgctgacatcctaccatggtgctgat

SEQ ID NO: 649944 - DNA, 483 bp, Homo sapiens
  misc_feature (30)..(31): n is a, c, g, or t
  misc_feature (36)..(36): n is a, c, g, or t
  misc_feature (117)..(117): n is a, c, g, or t
  misc_feature (306)..(306): n is a, c, g, or t
  misc_feature (312)..(312): n is a, c, g, or t
  misc_feature (321)..(321): n is a, c, g, or t
  misc_feature (391)..(391): n is a, c, g, or t
cgtaccgctttcgttactgtcattgccgcnnctctntcgactgtttggcggcatgttgaatgggcatagaatcaattttcggtcctcagccgggtcgaccagtccttacggtgcggnaccctgtcggctcagcgctgcaagcacgccagaatttttggaactcgtttcgtggcatcttttgaggggatttttcgtgaacaagtccgagttgatcgagcacatcgcccagcaagctgatatttccaaggccgcagccggtcgcgccttgggaagctgtcattgggtggtgtgcgtaccacactgaanaagggncggcaccgntgtcgctcgttgggtttggcacctttgctgtcagcacccgtgttgcacgcacagggcgcaacccccgtancggcgacgccatcaagatcaagaaagccaaggtgcccaaattccgtcccgggcaaggcactgaaagaccgcgggcattaacagtaacgaaag

SEQ ID NO: 649945 - DNA, 404 bp, Homo sapiens
atgtgatctcgttactctaggcatctgattatcgtgcagtccagggatcatggctggctggtcagaggctgacatactgcttcttatattataagacaataaaacacaatagtgttgaagtgttggggcagcgaaaatttctgggggtggtatggagagataatgggcgatgtatctcagggctgcttcaagcgggattaggggcggcgtgggagcctagagtgggagagattaagctgaagggaggtcttgtggtaaggggtgatatcatggggatgttagaagaaacctttgtcgtatagaatgattggtgatggcctggatacggttttggatgatttgagacgctaaacggaagatacaaggtccgaataaaaggaggagacaactgggtattagatgtc

SEQ ID NO: 649946 - DNA, 427 bp, Homo sapiens
ccgctatttgggacggcggaacagacaggatactatttccatgtggctagagaacgtggacaccactatgaaggtgcacatcaagataccgagatgacctcgtcctcagtgtgagccctgcggtgccccttaccaccccctcctgcctgccccggacacaagggtctgcattgcgtccatttcaagaggtggccccagtgacgcgagcagcccaggctcctgctgtacttgggcaagatgagactgttcccccaaatagcatcctttttccttccaacttggctgaaaaccacctggagacgcagttcacgtccaggctcttcccctgtggaatcttggggcagtcaagtacgaggcctcattttctcaacctgcaaaacgggttacagcattcctttatgatagctcacgccgtcccaaagcacag

SEQ ID NO: 649947 - DNA, 212 bp, Homo sapiens
ggatgcttagaacggagctggaactaccccaagtgcttacagaaccggactacgtggctcagaagctgcttttgaagagacaccagagcatggacaattccaaggcagtcctggtggtagctatgggactgctcagcccccacctcactatgggcccacacagccagcttatagtcctagtcagcagctcagagctccttcggcattccctg

SEQ ID NO: 649948 - DNA, 194 bp, Homo sapiens
atccccgttcatcgaaacctggtctcgaactcctgacctcaggtgatcctacccgccttggcttcccaaagtgctgggattacaggtgtgagccaccgctcctggcccagagtgacactattctgatggcatgcttgtgataaacttcagtacaaaacatatcttagggaaaaagaggctttgatgagggtttc

SEQ ID NO: 649949 - DNA, 159 bp, Homo sapiens
tttgaaattcttttcattttttttttaaaaacggctttattgagatataattcccatgccccccaattcccctatccagtatacaattcagtagggtttactatattcagagttgggcaactatcatttttttccccccctctaccccctttagagcca

SEQ ID NO: 649950 - DNA, 983 bp, Homo sapiens
  misc_feature (702)..(702): n is a, c, g, or t
  misc_feature (715)..(715): n is a, c, g, or t
  misc_feature (768)..(768): n is a, c, g, or t
  misc_feature (779)..(779): n is a, c, g, or t
  misc_feature (837)..(837): n is a, c, g, or t
  misc_feature (839)..(839): n is a, c, g, or t
  misc_feature (841)..(841): n is a, c, g, or t
  misc_feature (845)..(845): n is a, c, g, or t
  misc_feature (857)..(857): n is a, c, g, or t
cctcattcttggagaacaacacagaacctagtcaatcagaatggccgcaaccaccatgtcactctcttccccagccttcgccggcaaggcagtgaagaacttgccatcgtcatctctttttggggaggctcgcgttaccatgcgcaagacggcagcaaaggccaagcaggttgcctcccgcagcccgtggtacggctctgaccgcgtgctctacctcggcccgctttctggtgagcccccgagctacctgaccggtgaattccccggcgactatgggtgggacaccgctgggctgtcggctgaccccgagaccttcgccaagaaccgcgagctggaggtgatccactgccgttgggccatgcttggcgcgctcggttgcgtcttccccgagctgctcgcccgcaacggtgtgaagttcggcgaggctgtttggttcaaggctggatcccagatcttcagcgagggcggcctcgactacctcggcaatccaagccttgtgcacgcgcaaagtatccttgccatctgggcttgtcaggtcgtgctcatgggcgccgtcgagggctaccgcattgccggtgggccgctcggtgagatcgtcgacccgctctacccgggtggcagtttcgacccgctcggccttgctgacgaccctgaggcgtttgccgagctcaggttaaggagatcaagaacggtcgctcgccntgttctccatgtncggtttcttcgtgcaagccatcgtcccggcaagggtccactcgagaaccttgntgaccacttgncgaccccgtcaacaacaacgcatgggcattcgcaccaactttgttcccggcaagtaangngngtcncgagcttgcggngaatatgccgtgtccgtgtgagtgtactaccagatgttattaccaggatcgatggtgaataaaatgcgagaatcgtccacaaacacacacacacaaaccgacacaaaaaaaggccacaaaaaaccg

SEQ ID NO: 649951 - DNA, 334 bp, Homo sapiens
  misc_feature (275)..(275): n is a, c, g, or t
  misc_feature (279)..(279): n is a, c, g, or t
tcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggaagaatcaactctgtcaattgggagggttggagggtttgncaangccgcgcactgcactccagcctgggtgacagagtgcagtggcacggtctcggctc

SEQ ID NO: 649952 - DNA, 153 bp, Homo sapiens
gtgcggcgtgtatgataaactggccaagaccaggatcaggcattcagcaggagctggacgacctgattgattgatttggacaaccagcaggcaactcgtgtccaacctggaaaagaagcagagaaaatttgatcagttgttagcgcgtgctgt

SEQ ID NO: 649953 - DNA, 689 bp, Homo sapiens
ctccccagacaggttgtgccagcacttctaccaatcggaccgcttagcctcctgaaagcgtgtgctcaataaggagctctcattgtagttgagcctaagatagctatctgacctaagtgtagtgtactcacctcatggtgccacaggcatctatttcccaggtacttggcacctggagccagtgtctatcagcatctccgaaagtatgcccggcgtccagtctaaacgtgccatgcagatccatggaaagcttctgtggagacgcatgcaaacggagcttcaccccgtgaatcataccattaagatcccactctaagctggtgcatgagtatgtttcgccaaagtagcaccattagcatcagcccggtagagtcaggaaccatctctaacgggcccttcattcctccacatgctacaatcgctgttatgggcctacggtgctatgtagcatgggtcctttgtgtgacagcaagacggagcaatccatagaagtcctcttcctgattcactggactccattaatgtgcatgccgatcagctgttgccgtcaagatccagatgaacttccgtgtcgtgcgtgagcactggatcattcctgatattgcagcacttttggcgtgttcctctggatctccgcattatgtcccttgtataaaccagtatagaccacttggcaagacaccatctgt

SEQ ID NO: 649954 - DNA, 267 bp, Homo sapiens
ctggacggcttagcactccttgacactggatattccacatttagcatctctcatctcgcatatggcaaaggaactcttcgagcacttagccacagtagccataaggatcacctgcagaatagactctctcaaagcagataccagagagcaggtttagcaccatggtccccagcagtgtgacacacatagctgctcgatgagatcatggcagcatgccatatgtagacagtagcacgtccaacatctctgactatgtagtgcccaatc

SEQ ID NO: 649955 - DNA, 217 bp, Homo sapiens
agatggacgtagctagaactgactctccaggcatccattcttgcttcccccttccacccagtaccacgaatttgcaagcctgggatgcgttcacattgccctcaccctcaattccagtatggtcttatattatttttgaacatagatctgtattcatcttgtcgccatcaataattgattctttcaatgaatcggtcacatcatgcgggggatccat

SEQ ID NO: 649956 - DNA, 1098 bp, Homo sapiens
gtaacgcggggccgccacgtgacagcttaatggcggcggtcgtctgaggcgggcgtggctggtatatatgctgtggctgtgcatgtgatggcaagtcagctgaaaccttcccggtcgcctgctccctgtccctgtatctggcgtgcttccccaaggcggcaggactcggcgcgccatggacagtgcctggctggtcggtcggctgtgctgggcggggctttgccgactgtgccgtgctggtgtgggcctctgaaccccctggtgtgcctgggttgtgtgctggtcactgtgatgggccttctctgcggtgggccatgtcgtgtgtgggtcgcccaacccggccgagcttcccctgggtcatgctcccaagctgttggtcagaaccccttgggcacaaggttctccccacctagtgcaattccagccagtgggtttcgcacagttggctagatttaagaccgaggggctttaattaggcctttgtcttaacaagagattgtccctagggttccaggaattgtatcccgggttctcccagcgtggaacccattcgaggaaacacacgtggttgggtcccaaggcagggactttaccgcaaaggctttttcccaaggcggaacgcgccccgttgcatttcgtaccctgggggcttcattaaacgggcgaattggggacaccattaaacgcgccttggggccatcccaccgaacttggggaacaggacagggcgttcccgaagcgattttttttccccctagaggacgaaacgtccgaggtctgtaaaatagcccaagttctggtttcgaagaacggcagttggtccatgggttaactgtaatccttggctccccactttatacatttgagggggagcggacaacggtggacctgtattgcgacatcacccccttggaactagctttgcagacctaggcagccatttatcaacagcgactttggtaaccccgttaccagcaaatacatatttggattccgtaaagaaaatcgggcgaaacccccacgtgcaaaattttactatactatacccgctgtggaccatgtgctattcccgcgcccatttgtggcgaacagtgtggc

SEQ ID NO: 649957 - DNA, 164 bp, Homo sapiens
aagggtccatttccccccccctcaggtttgaaccgcggttgccccccctcctttccaggttttcagccccacgtccctccctgaacaatcccttttcttgaaattccgccgtcaagaaatttgccgcggaagtaaatggataaatgttttcttttccaatcgga

SEQ ID NO: 649958 - DNA, 173 bp, Homo sapiens
tttctgataaacccatttcacactcagtatggacacttccctggtttggaagtttattctctaatattcacattccaggtacgtcctccctgtggatttctgcccgcatctacgtcttggttgaccccttcatttaggagcgatgttgaaatacgttcttttgatcctcctga

SEQ ID NO: 649959 - DNA, 467 bp, Homo sapiens
  misc_feature (290)..(290): n is a, c, g, or t
gaaccggccggagccgggcgccctacagctgagaaggggacccaaggggtcggccgcggccaaggcccctaggaccgcgcccagctcacgctgcgacgcgcttagacattctgcgtcaggtccgggctcctggacttgctttccgagccctgagggggagaaaaggtaccaattttaaatccaaatatatctatggtacaggaagactggcagagagtctggaagttgggttctggtctggtgtgccactgactactggaccttgggatcttggctggaagactttcccngtgcttatgttacaagcaaattgacccacaggcctggaagagtgattgttggttgcgcaaggtggtcttaccagctcactcccctggacccaccggggacctgagcataactgggtggacttgggctctcatgggacaccgggttgaaatacgactgctgacctgggatgtgaagga

SEQ ID NO: 649960 - DNA, 1069 bp, Homo sapiens
ttgaaacagccaactcatgactaaggcaaagtcttctttctccttacagctgagcttctctggatgatgttgactacgcctgcgaactggcgggacagtggtcgacgtataggcgttgtccgaaaggcaacacggcaacaaagtccagctggcagcaacaaagctgacacaataacacactcagctgaactggcattactgatggaacgctgatcccatccatttacgtctgcgcacaagctacacttcagcccccctgaggcagtgttgactccaacacacgactgcagctaccacagggaactgacttgagacttgctggagcgacgggccgactactgcacaacggctgcaggctctactcccactcttggccactcgctgtgggatggccaacacaagcggcgcacttgcctgccagcaacagggcgacgagcgctcaaagcttccaaattggtgctgctcctgcggcccaataaatgcacaaactactggccttacgaaccattcgacacccctggcgcagggcgcacaagcggcaatggtcgtgaccacgactcagtcttgagcttcatttacacttatgaccgctcggaccactacgcacacgaacgcctccttacacccaactgctggaaagacaccgctccgagcgaatggccacttggagccctacccgcgcagcgacgaatgaacggtgagaacttccttcagccggaattccttcaaatcccgccgccacctgcgcacacttgccaaccgccctggcacctggtcaggaccaacctccgctaaaaggccccccaaggcccgatagcacagctccctcgaaccctggatccagctgagccaaatcccctgtaacaaactatccactcagcaaacgacagccggacgccccctcgccctaatggatccacgcgcacgcccaggcggcccgcgcaacccaacgaggcatgggacccacaacaacacccgccaccgagcccacgccataccccttccaaacccaccaccaaacccatgacacgtgcgggcacacgacaaggtggcgaaccacaactacgcg

SEQ ID NO: 649961 - DNA, 202 bp, Homo sapiens
cattaggcaataacgcgcgaatcatgactgcggcgttcgtggtggtggtgatcggcggcctcggcagtttctggggcgtggtactggcagccttgctggtcggcgtggtgcgcggcattaccgtgcagttctatgcgccggcaggtgaagcatcaatgtatctgctgatgttgctggtattgatcttccgtccgcgcgttat

SEQ ID NO: 649962 - DNA, 926 bp, Homo sapiens
atgtggtatgaagatgaaaaacattccctgaattcttcgtcgagcctccaacccacagatacctcgatttcccagcaacagcatatcattgcattgccatgccgcattgcacacccaaaaacaaaaggggccatatgcatattattcctgcaatgcaacaagcagcacaaaccatagtgttcacatagctgacacacctcacacgccccctctccattcaacatctcactgcatagtcaagcacagattcattctttacaccacagccaactgggcacagtgcacaagctcattccgcggcagcaccccaacaattccaaggggctttcaacaattggcacacccgcattgcctgaccccaacccagcccgcacttcaattccattaaccgcctacggttaagggccggggcatatatattagcacaagcaggcttggtgcaccaaccacaatggcacaacacaagtaatgggggcatccagccagcacaggcaccgcctctactaagcgctcaagacacgtggaccccccgctggatcaactaccccaggcccattggcccattctgcaaggcggttggactggtaggaacacacacccttaggcaacaagtaagatttccagcaacacaatggtttcacatacatggaacctcgaaaggaccctcccacttgcgaagtatcccaccaacactgcggtaacatcacaatcacaaccacacccattcggccttacggccccttcccaccactcacacagcacatcactacaaccacttacgacttgccccgccaacttaagacaacgaacatttggaaccacattattggcctcacacttcccacgcaagacaatttacaacggtcatcaggaccccccgcacataacttacagggacttgctggcaatactacaattacgcgcaa

SEQ ID NO: 649963 - DNA, 445 bp, Homo sapiens
  misc_feature (194)..(194): n is a, c, g, or t
  misc_feature (209)..(209): n is a, c, g, or t
  misc_feature (214)..(214): n is a, c, g, or t
  misc_feature (322)..(322): n is a, c, g, or t
acacagtcctctgacagctggtaaatcctcggtcccagtaagccctgcccaagaagccacaacccagccccagcacaggctcctcagatttatctggagcaaggatttagggacactgttctgggggtgaggcttctagggctgagcttctctgagagtatctcaggggctcctcaagccaagccctactcagntctccagggtctttntcagngtcaaatttatgaagagggcatgaggtgcttgtctgagactgatctcctcctgctgagtccccccatcagactgtccttcctctgcagcgagtgtctgcagggtctgnatgcgggaaaggaattctgatctgttgaaatttgtctcctctgtgtgtcctgcactaaatgcccaaaccccagcatgggacttaatgcagagagagacacaggcagagtccaacctgagcata

SEQ ID NO: 649964 - DNA, 284 bp, Homo sapiens
  misc_feature (148)..(148): n is a, c, g, or t
  misc_feature (156)..(156): n is a, c, g, or t
  misc_feature (222)..(222): n is a, c, g, or t
cctctcgcctgagcttacgaagtgctgggataacggacgtgagccactatgcctggccacaattttaaattgaacttattttagcagcatcaatttcttgatatatgttaaacaacagcaaatgatcatatatattctgtgtgctcancttttctngcttttcaaagaagatttctggacagatcatttcatttgcttctgtagcagttactcgtactttantgatttggggttgcaagatcagtacttatgagacctgcttcttctcatgcactttgtcaacc

SEQ ID NO: 649965 - DNA, 114 bp, Homo sapiens
  misc_feature (81)..(81): n is a, c, g, or t
atcaacatcgagtcgtaaaccctatgttgatatggactctagaataggatgcgctgttatccctagggtaacttgtcccgnggtcaagttattggatcattgagtatagtagtt

SEQ ID NO: 649966 - DNA, 143 bp, Homo sapiens
cccatggggggagtgacacaaaaatagggactgtgttaaggataaaaatcccctggtttcctttgttttttgggctcttgtgatcttgattgacacaagtggccccgttccgcaaaagtaaattaccttgttgagagaaatta

SEQ ID NO: 649967 - DNA, 528 bp, Homo sapiens
ctcattagaataagaggaagaggatgatgccaattcagaatctgagggaagcagttagctgaggaggaagatgactgctgcagagtcagtgaaaacaacaaacacaaaaaagaatgggagcatcaaacatttctcgcgggggtcgctggcctctggtaaagacgctccatggccctgctgattgggccctcgaggctgctggatgtgctcgtgggactgtgggccagacagcagattctgaggtggacaccacgggatgctcgaaagagcgggcgtgggcctgtctcggagatataaaaaagccccgtggccgtggagagatacagtctgttgatggaacatataccacctagcgtgggtcattcaagggatcggctagcggggtgttgcctaggatgggagttgtcacaagcagggaattctgaagtgtgcagaccaagctcccagtggcagtcgcggcgcagacccacgtccgtggggtagaactgcatcatccaagagactggagaggacctcaagcaagatgac

SEQ ID NO: 649968 - DNA, 732 bp, Homo sapiens
cttaattttgcacagggagcaggagcagcaaaaaatctctggtgctccagagcactcgtcctctcttggaggggttattaggtgggagaaatgtgatactttgtttgtgtgtgtgtgtgtgtgtgtgtgtgtgtgtgtgtgtgtgtgtgtataacatctgtgaaccaggctaattagcgtcgtgcgtaccagagcgccatatcgtggtgtggcagagtctcacccccttcctaagagcagggtagaaaagatgttgtgtattcttttctaccacaagacgcagattccgctgtcccttcagctctcaggagccctaggagagtcataagctggggcatcccgctgggcccagaggactcgccggtggtgggcacagctctaatgtgtgctcaggctgtcttgggtgcactggacttggaagcaactacctagagaagtcaggggagagaaagtagtagatctagaaggccgcgatgtgggtagtgtgtgccccagcatatcacccaggccaagcagagccaaacctaggagagggcaagggagtagactctctgccccaggcacgcgtgaatacatatatataccacaaatcactcagaacttcagggcaaagagtgttgtctcactatggtgatctcataagatacacatcagtgtggtgtgtaagcatcacagacaatggaacccctgtggaggaagtctggcagaacataaagagggccaaaaggcccc

SEQ ID NO: 649969 - DNA, 1074 bp, Homo sapiens
  misc_feature (68)..(69): n is a, c, g, or t
  misc_feature (478)..(481): n is a, c, g, or t
  misc_feature (483)..(483): n is a, c, g, or t
  misc_feature (485)..(486): n is a, c, g, or t
  misc_feature (490)..(491): n is a, c, g, or t
  misc_feature (497)..(497): n is a, c, g, or t
  misc_feature (507)..(507): n is a, c, g, or t
  misc_feature (541)..(541): n is a, c, g, or t
  misc_feature (547)..(548): n is a, c, g, or t
  misc_feature (551)..(551): n is a, c, g, or t
  misc_feature (556)..(556): n is a, c, g, or t
  misc_feature (574)..(574): n is a, c, g, or t
  misc_feature (580)..(580): n is a, c, g, or t
  misc_feature (587)..(587): n is a, c, g, or t
  misc_feature (589)..(589): n is a, c, g, or t
  misc_feature (596)..(596): n is a, c, g, or t
  misc_feature (599)..(599): n is a, c, g, or t
  misc_feature (607)..(607): n is a, c, g, or t
  misc_feature (625)..(625): n is a, c, g, or t
  misc_feature (632)..(632): n is a, c, g, or t
  misc_feature (656)..(656): n is a, c, g, or t
  misc_feature (671)..(671): n is a, c, g, or t
  misc_feature (681)..(681): n is a, c, g, or t
  misc_feature (689)..(689): n is a, c, g, or t
  misc_feature (695)..(695): n is a, c, g, or t
  misc_feature (701)..(701): n is a, c, g, or t
  misc_feature (714)..(714): n is a, c, g, or t
  misc_feature (718)..(719): n is a, c, g, or t
  misc_feature (721)..(722): n is a, c, g, or t
  misc_feature (727)..(727): n is a, c, g, or t
  misc_feature (806)..(807): n is a, c, g, or t
  misc_feature (820)..(820): n is a, c, g, or t
  misc_feature (1041)..(1041): n is a, c, g, or t
agcggaggcgcgcgggggcggggcgagtgcggcgcggggtataagtagagggtgcaggaggcggagcnnccttctccccggcggttagtgctgagagtgcggagtgtgtgctccgggctcggaacacacatttattattaaaaaatccaaaaaaaatctaaaaaaaatcttttaaaaaaccccaaaaaaatttacaaaaaatccgcgtctcccccgccggagacttttattttttttcttcctcttttataaaataacccggtgaagcagccgagaccgacccgcccgcccggtggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctagccgnnnncntnncccnngctaangcccccagcnccggcactcgctctcctcctctcacggaaaggtngcggcnngtngcccngcgggcagccgtgccganatgaancccagtncncccaacnacnccatggcntcgctctacgtggggganctccacnccgacgtgaccaaagcgatgctcnacgagaagttcagcncggccgggcncatcctcnccatcngggtcnacaaggacataancacnngnngctcnttgggctacgcgtatgtgaacttccagcagccggcggacgcggagtgcctttgggacaccatgaattttgatgttatanngggcaagccagtncgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaaatctattganaaatgaatggaatgctcctaaatgatcgcaaag

SEQ ID NO: 649970 - DNA, 690 bp, Homo sapiens
  misc_feature (68)..(69): n is a, c, g, or t
agcggaggcgcgcgggggcggggcgagtgcggcgcggggtataagtagagggtgcaggaggcggagcnnccttctccccggcggttagtgctgagagtgcggagtgtgtgctccgggctcggaacacacatttattattaaaaaatccaaaaaaaatctaaaaaaaatcttttaaaaaaccccaaaaaaatttacaaaaaatccgcgtctcccccgccggagacttttattttttttcttcctcttttataaaataacccggtgaagcagccgagaccgacccgcccgcccggtggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgctttgcgtccacaggtgcacgtactcagctctagcgttgtcaaggcttcctggggtgtaccggagcaggctcctaatgccgggcaacagtggacccggcttgaccttgcagatcaaagcagacagaggagctggagcgctccaatgatttcagcctgacggctcttcaaaacatcccattctgcttaccacgcatggattctgaacattggaatctctaacccg

SEQ ID NO: 649971 - DNA, 177 bp, Homo sapiens
cacccctctgtcattcggcctgcttttttttacatgacaaaaactaacccccctctcaatcatataccaaatattcccctcactaaacagaagccttctcctcactctttcaatcttatccatcataacaggcaggtgaggggggcgtaaaccaaacccaccttccccaaatttttt

SEQ ID NO: 649972 - DNA, 2375 bp, Homo sapiens
  misc_feature (202)..(202): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttca

SEQ ID NO: 649973 - DNA, 1020 bp, Homo sapiens
  misc_feature (68)..(69): n is a, c, g, or t
  misc_feature (424)..(427): n is a, c, g, or t
  misc_feature (429)..(429): n is a, c, g, or t
  misc_feature (431)..(432): n is a, c, g, or t
  misc_feature (436)..(437): n is a, c, g, or t
  misc_feature (443)..(443): n is a, c, g, or t
  misc_feature (453)..(453): n is a, c, g, or t
  misc_feature (487)..(487): n is a, c, g, or t
  misc_feature (493)..(494): n is a, c, g, or t
  misc_feature (497)..(497): n is a, c, g, or t
  misc_feature (502)..(502): n is a, c, g, or t
  misc_feature (520)..(520): n is a, c, g, or t
  misc_feature (526)..(526): n is a, c, g, or t
  misc_feature (533)..(533): n is a, c, g, or t
  misc_feature (535)..(535): n is a, c, g, or t
  misc_feature (542)..(542): n is a, c, g, or t
  misc_feature (545)..(545): n is a, c, g, or t
  misc_feature (553)..(553): n is a, c, g, or t
  misc_feature (571)..(571): n is a, c, g, or t
  misc_feature (578)..(578): n is a, c, g, or t
  misc_feature (602)..(602): n is a, c, g, or t
  misc_feature (617)..(617): n is a, c, g, or t
  misc_feature (627)..(627): n is a, c, g, or t
  misc_feature (635)..(635): n is a, c, g, or t
  misc_feature (641)..(641): n is a, c, g, or t
  misc_feature (647)..(647): n is a, c, g, or t
  misc_feature (660)..(660): n is a, c, g, or t
  misc_feature (664)..(665): n is a, c, g, or t
  misc_feature (667)..(668): n is a, c, g, or t
  misc_feature (673)..(673): n is a, c, g, or t
  misc_feature (752)..(753): n is a, c, g, or t
  misc_feature (766)..(766): n is a, c, g, or t
  misc_feature (987)..(987): n is a, c, g, or t
agcggaggcgcgcgggggcggggcgagtgcggcgcggggtataagtagagggtgcaggaggcggagcnnccttctccccggcggttagtgctgagagtgcggagtgtgtgctccgggctcggaacacacatttattattaaaaaatccaaaaaaaatctaaaaaaaatcttttaaaaaaccccaaaaaaatttacaaaaaatccgcgtctcccccgccggagacttttattttttttcttcctcttttatcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctagccgnnnncntnncccnngctaangcccccagcnccggcactcgctctcctcctctcacggaaaggtngcggcnngtngcccngcgggcagccgtgccganatgaancccagtncncccaacnacnccatggcntcgctctacgtggggganctccacnccgacgtgaccaaagcgatgctcnacgagaagttcagcncggccgggcncatcctcnccatcngggtcnacaaggacataancacnngnngctcnttgggctacgcgtatgtgaacttccagcagccggcggacgcggagtgcctttgggacaccatgaattttgatgttatanngggcaagccagtncgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaaatctattganaaatgaatggaatgctcctaaatgatcgcaaag

SEQ ID NO: 649974 - DNA, 242 bp, Homo sapiens
gcttggattcaaatctctcaggggcctgggctgcaggatttgaccctaatcagaagcatccggcgctggaagtacggcaaggttctcctggttccgggtgaaggaagaatgacccaatttacgccatgaaagtggtgaagacagagctggtgcatgatgacgaggatattgactgggtacagacagagaagcacgtgttcgagcaggcatccagcaaccccttcctggtcggattacactcc

SEQ ID NO: 649975 - DNA, 2013 bp, Homo sapiens
  misc_feature (202)..(202): n is a, c, g, or t
  misc_feature (1936)..(1936): n is a, c, g, or t
  misc_feature (1971)..(1971): n is a, c, g, or t
  misc_feature (1996)..(1996): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatctttttccttccagatgttccattcagtgccacaccagtgaatgccttttataatggctgcatggaagtgaatattantggtgtacagttggatctggatgaagccatttctnaacataatgatattagagctcactnatgtccatcagtttggg

SEQ ID NO: 649976 - DNA, 231 bp, Homo sapiens
tgcgatattcgaagtttgacatatttaaatttacataaactataatatttttatttctatttgtatatgtataaaatgtgatcaataccttgtcgttacttgcagtcagctagggagaaagtgtaaattgtcttgactttagactcacgagatttatgacggtggacatgacattgataccgaatatacacgtgccttttgttttagggactcttcggtaagctgaaaaaa

SEQ ID NO: 649977 - DNA, 2983 bp, Homo sapiens
  misc_feature (202)..(202): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataatt

SEQ ID NO: 649978 - DNA, 211 bp, Homo sapiens
tctatcttattcctagctgcgcgtatcaggcggcatcgcggccttgtcttgagcatctaatttgactaagtaaagcttcgggtcccgatggaattcagctaagagcatcgaggtggcgtcgagaggcaaggggcggggacgggcggtggctcgcctcgcggaggaccgcccacccggtcccaagatccaatgtacgagcttttaactgcag

SEQ ID NO: 649979 - DNA, 3061 bp, Homo sapiens
  misc_feature (202)..(202): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttca

SEQ ID NO: 649980 - DNA, 3122 bp, Homo sapiens
  misc_feature (202)..(202): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacacgtttgaatctaccattcatagccagatgtgtatcagatgtttcactgacagtttttaacaataaattcttttcactgtattttatatcacttataataaatcggtgtataattttaaaatgcatgtgaatatctttattatatcaactgtttgaataaaacaaaattacataatagacatttaactcttca

SEQ ID NO: 649981 - DNA, 2536 bp, Homo sapiens
  misc_feature (202)..(202): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaagaaatttttttttgcaattccatctggcaggatgaaattctcttttgttggataggtgggtt

SEQ ID NO: 649982 - DNA, 2440 bp, Homo sapiens
  misc_feature (202)..(202): n is a, c, g, or t
  misc_feature (2383)..(2384): n is a, c, g, or t
  misc_feature (2387)..(2387): n is a, c, g, or t
  misc_feature (2390)..(2390): n is a, c, g, or t
  misc_feature (2395)..(2397): n is a, c, g, or t
  misc_feature (2401)..(2401): n is a, c, g, or t
  misc_feature (2403)..(2405): n is a, c, g, or t
cgaagaactgtgcaataaagaagaagccaggaggtctttgaaaatgacccggaaacggattattttgatccaaaatacttagttgtcttcgctcttttcaaactgggttattcactgctgcacgtcagtcaactaatgcttatcctgacctaagaagctgtgtcaatgccattccagaccagtgtagtcctctgccatgcantgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaaggcttcctgcttctgccatccacagtttcagttttggagtgtggtctacacactcatttaacttcattgcttcctgcttctgccnnaanacnctgcnnnctgntnnngccggccctctgtcactgatgctgatacggcctgg

SEQ ID NO: 649983 - DNA, 590 bp, Homo sapiens
gcgaattcactagtgattgtgagctgagatcgcacccggtccaagcactggctttgagataagcaatattaaaaacattttcagcttcatcagatgctgactaactgacctccaaccactgttccaccagccataactacagctttgattggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtatgtttagtcaatccattgagcatgaagctcctaccctaaaccctccttctttgaagtgcctgtctctggtcttggctggagacatgcttcccagcaggtctcactccctttcttgggctggagtgcagtggtgggatctcaggtcacaatcgaattccccggggc

SEQ ID NO: 649984 - DNA, 379 bp, Homo sapiens
aacctacatgtaactggagcagaggaaaggacagagaaggtcccaaatcaaagtgccctgattgtcccttctgtcccttgaaaattcagctatgggccctggcacagtggttcacgcctgtaatctcagcactctggggggctgagttgggtggaccacttgaactcaggagttcaagatcagcctgggcaacatggcaaaactttttctctacaaaaaaaatacaaaaattggctggacacggtggctcacacctgtaatcccagctactcgagaggctgaggcaggagaattgcttgaacccgggaggcagaggtgagccgagatcgcgttattgcattccagcctgggcaacaagagggaaattccgtctcaaaaa

SEQ ID NO: 649985 - DNA, 546 bp, Homo sapiens
aattatccggcctatccaatattcggcctatccactggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataatt

SEQ ID NO: 649986 - DNA, 330 bp, Homo sapiens
tgggattacaaggtgcgggctattgtgtctggctttttttcttttttagagacagagtctcactgtgttgcccaggtcgctgctgaggtcttgtgctaaagtgatcgtctccgggactcccaggtgctgaggtcggaggcgtgagtcactgtgtccagcctcaggtgttctttctgctgttagcttgagcgcagttactcatgtgcagaagcttcactcagaatgaaaaagtttggatagagtagcattagtcattatgcatgtgtttatctggcatgccataaaatgttattctcttaatgaaatgtggcaccttttctgtttctggtt

SEQ ID NO: 649987 - DNA, 530 bp, Homo sapiens
  misc_feature (16)..(16): n is a, c, g, or t
ggcgatggtggcggcntgcgtggacccagcaggcgcttccggccgcggacacgggctctgacacgcgggacaaggggcgcggcgagtgcagcgggagggcagcagactttgatctcttggtgatccggtgggggatccggtggcctagcttgtgccaaggaagctgctcagctgggaaagaaggtggctgtggctgactatgtggaaccttctccccgaggcaccaagtggggccttggtggcacctgtgtcaacgtgggttgcatacccaagaagctgatgcatcaggctgcactgctggggggcatgatcagagatgctcaccactatggctgggaggtgcccagcctgtccaacacaactggtgagagagaagcccttgccctctgcaggtccccattgaaaggagaggtttgctctctgccactcatctgtaaccgtgagcttttccacccggcctcctctttgatcccagaataatgactctgagacttcttatgtatgaataaatgcctgggccaaaaacctta

SEQ ID NO: 649988 - DNA, 626 bp, Homo sapiens
  misc_feature (491)..(491): n is a, c, g, or t
  misc_feature (516)..(516): n is a, c, g, or t
  misc_feature (531)..(531): n is a, c, g, or t
cacgtccgcacccctgtgtagcccagttggccgcttctcttccagcacgttgttcgttggtcccccgcgggttgttcccccctggggggccctgaggagacccccttctcccgtgtcccttcttggcgccccatatgttccccacagtgtgtaaaagggcaccagcccccagtgccacatggggggtagagagggcagagggacatgaagggcgcccctggttgcgcccttctctgccgaagagagcactgcgcgccgtatgcgcctggcggccacatcttgccggagagctgtgcgggctggctccttcttggagcccctggcgttcttccccaccctggttaacgccccggttagcacaccccacacctgattgttgggttcctcgcccaggcgttgtagaggacaatgtatcttgagatatttttctctccctttgtggttttcattttgtgtggttttattttgtggtgtttcttgttcttcccttnttggggggtattccagagtgggctngggccccgtgggcgnagaccaccagctcaccttctgttggccatcctttttgaatacccggagaccccacggctttagacccctgagcggctaaatgaaataaaatggga

SEQ ID NO: 649989 - DNA, 1531 bp, Homo sapiens
tgctctctactcgtgccctcccctcgcttcgttggtaggctgtcttgttgataccatgtgggactgatcagcctacttgttgggtgataccctgctgtgtgctcgtctactacacaacaagactcgttgttgctgtttcacccaccacgcggtggtgggtttctcccccgcccgccacatggtgtggtatgcgcacaagccaccacactgttgcgtgtcggcgatcacacgcgggaagtggttactgccccccgccacctacattttgggggagggcccctgctcttcgtagatgctcgccccgccccggaggagttgttttctcgttcggaccagctgttccagatgtcccttttgtcctggtggccaaagaggtcgtgttttataccccgggtgggggaccccaactcccctcgcccaaaggttttgcctctgtgtgcttcacactttggtgttctctctgaaggggcccccccgtctttccacctgccccccctggaggggaaaaggggatcaccccgaccctccacgaccacgcttgttccggaggagaaatcttttccccctcgggaaggaccccgaccattgggggcctgctgtagaaagggagtgtgtgcccccccccgggcccacttttcacgtttcagcctcttgtacacccgcccctttttgtgcacccgggagcactcctcgcgcgcggtgaggacccccgtggtgtgcaccctcacaccacacttccaccacgcgtgtccacgccccacgcccccaccactgtgtgagagacacacggggaacacacacgcgagcacacggcgcgtgttagtagtgtgtcccccgcgcttcgcgacacaccccctccacagagagtgggtgagagattagagagttgtgggagcaccccgcccatcttgaagtttcttccgcgagcacacatccacggccacaggcgcacacactttgagaggccgctctggggggctgtccacgcccactgtgagcccccacgcgagactccacgccacttgagtggggaccacactggggattgggggggggacacacccacacaccctcttccgccgccacagttctgtctcactaaggccttcttcccacgagaagagagagtctcggcccacagagacctctggcgtggtcaccgccccttggtggtggccaccgggaagaaggccccccggcccacagagatggcccccgggccggcccacaggtccatctactcctgtgagaaggagcgcacagggagagcctccccgagagggaacacccgagccctccagttgccggggtggaaaggctcttttcgcccttgtcccacccagggctccaacccaagccctcgccagtgtgtcccccgctccggggaagggccccggcccgacaccggcgccagggagaacccagtcctgtcggctgggcccttggacggctgtccagttttgcaccatgatgttcctattgtgaactctccgagacccttaaaaagaagtttactgcccaagtgaataat

SEQ ID NO: 649990 - DNA, 763 bp, Homo sapiens
ggacagagtgctatggatcttaatgacagcaataatgtgattcgtgcagtagtgctgaaacaggagaatacaatgatacagaactaaccaaactaatggtgcagaacgtatgacaggttactcatgcactgatgtagtgagatgatgccaggagagatcattaaagaaaatttgagtacagaatactaataatcaattatgtatgcagtctcatgctctcgacataatggcgggcagaagacatctattttagaattctcttgtatctattacccttgtcgagttgaggcaaattgactactgcaatatgaactatgaccactgtgagagagtatagaaaagtacactctagacatctcagacgttccttgggtatatttgaactctgaaaacgacgttattcgcacggacatgttctaggcaactggtctctgggagacacctcagactggacagaggcagctgcatggccgtgccttgtgcaggcctggtccagaagaccagagccgtccagacgggagggccttggttggttaacagggtgggacagttctcaatcgaattctgcatcgtgattataaattcttcttttaaacaattcaggaggaaatgcataacaaaagagaaagacacatttaacaaatagttttggattaattaaaaccggtggaaattgactgcatgtttcccaaaacaaattgagaacatgtaatatgggataaaagaaatgctgagagtaaagtaatatgacgtgtggatgagg

SEQ ID NO: 649991 - DNA, 246 bp, Homo sapiens
  misc_feature (21)..(21): n is a, c, g, or t
  misc_feature (23)..(23): n is a, c, g, or t
  misc_feature (69)..(69): n is a, c, g, or t
  misc_feature (104)..(104): n is a, c, g, or t
  misc_feature (165)..(165): n is a, c, g, or t
ctcgtgcaatttcggcagagngngttacacgcaccaagacagaccatatccaggggtgtctaatttttnggcttccctgggccacgttggaagaagaataatgntcctggaccacacacaaaatacactaacactaatgatagcttgtgaggtaaaaaaaaaaantcacaagaaaatctcataatgttttaagaaagtttatgaatctgtattaggccgcattcaaagccatcctgggctgcatgt

SEQ ID NO: 649992 - DNA, 662 bp, Homo sapiens
gcaccccccatttggccccgagagacgagaaaattcttggagaccggtcctcctgtggagtaacaggagttcagcgaggtcctaactaggcaggaggaactgggcaaacgagaggaggaacaataatatgtactaatagtcaataatagagcagagggggaggaggaaccgcaacaagagatgtcgtgggaacccccggcatctggggctggccgggcttccaaagcgcagcctgtcacgcagggttccggtccaccacaggcgggaacctggctgttaaggggggccccaagaggtgccacccacgaggcgcagagtctccacacagcaggcaatcggcaccccacaaccggccttttagagtcaggtccaccatgggggacggcccagcgtgggtgggggtccagagggtcccgaatgggggccgtgccctttgccccagaccgtgcactcttcaacccaggcacagtccggctctggggacacaggggcctccccggccaacagccccaggggcctctgagggtttgaggtccccaaccctgttgccaagaggaccttgtccccagcgtccctcctcccaggctggtttgagtgtgcgtgcgtttgtccgagcttttatttcatcattgccaataattaattaaggaaggccagtttta

SEQ ID NO: 649993 - DNA, 500 bp, Homo sapiens
tgtccccatagttggaaggcagtgtggcaaagggaatatagatctctgtgcgtatcatttcttacctctgcatataaaactacagttgtctctaaaggtttaatttagaaagtatttaacgaaaaagaaccccaggatctaacacgatcagagtcagataatcacaattgctaattaaaaagcacttatgtatttggtgattttctgaaattctggctcagtttcgttatgatatggagccatgtgggtccatgatgagtgagtccctgctgcattggtatatgattgacttttaccctcatgtgcttctaatttgggatgttcttcactgtgtgccctttgagtgtctcttgcctctggtttcttgtttgactaaaaaaccagttctttaagatgacagttccaatggtctttgctggagttcggataatctttcatgatttactactttattcacgtgtgttttcacctctgggccatggtttctagagcactacact

SEQ ID NO: 649994 - DNA, 262 bp, Homo sapiens
  misc_feature (1)..(1): n is a, c, g, or t
nctttggtccgagagaaattagttgtcagctcagcaaagatacaacctggtataagaacttcagcgagcttgggagactgacagatcagatgccactagaaaaggggtgccaccctgtaaataggtttgatttctgtcaaagtgttctctgagcctcactgggatagaagccttcctactgtgaggtcatactatttcaatttttggaaacctatgcagtctctgaccttggtgaagatttctaatttctctcggaccaatg

SEQ ID NO: 649995 - DNA, 1303 bp, Homo sapiens
tcttgcaggaagcacaaaccacaggacggcttctcccgggcgggcaaagaccacacaacggccgacaacaacgaggggggctgtcttttctttcctattgaagaggggggggccccacagacgtcggtgggtgaagcccttttttggagagggggtaataaaacctccccgccacgagaaattaaaagaggttgtgttttagtgtgttgcgctgcctcgttgtgggcaaaaaagagaatatcaagaggagggaatgtttgaaaaagtgcatccgcagaccttagaccgtgttgtgagagagaaatgatatatggttcacaaaataaaggggtttaaagcctaaaaaggaatgattttgtggcttcttataggccgcttctaaaaagtgttctgtttaaaacaccgggtagaaaaatttttttaaaaatagagggctcttataaaggagatttctcctaaaaaggagagaggagacagtatattttggagtaaagagagcttcttatagagagagagtgtaatgccactcgagagggagaagggagacacagaggagtataaaaagaggttttttctttatagaaacacactctgagccggcgagaggtgctagagagagtgtagaagcttttctctctcaatcgggagagtgataaaagagaagatgggtatatgtgtatagaaagagagagaaattttgtgagagagagagaaagggagacttatacacagagaggcctccccgagaatgtataatacaccacacatatagagaaggcggcacaaataggctttgtatagagattataaaaatagagaagggtggagacttataaccccaggctctataaagtgttatagtttataaaagtttgtaaggtggagattataaaataaattttgagaagggcgaattctctcttataaaaagagagagattataaacccgagaagggtgagattataagagagcccctgagaaatccactgaacgccacgggagagaaattggcgctcacatttataaagcgctatgttataacgccacatttatctataaacgccacgagccgcagaaaagtggagaaagaattaaattgggaggtggtaaggagtgaaacacaatttggaagaaagaatatagaaagtttgaaagtggagaaaactggagaagaacacagaaagtatcgggagaaggcgaaagaaaaagaaatatagaagaaaaatataggggaattagaagataaaaacataacttttagaagaaaaaagataaatttaaaccctgaaaagtaggaagcca

SEQ ID NO: 649996 - DNA, 409 bp, Homo sapiens
tgccacatctctcgattgatacaggattggctgtgcttctatatgcttccaaccagtaagtggtctccaagggtgatgtgtgagtatgacctagtcttctttgttacgacatcctatggctgatttgtgaccatgctagaggctgcactgtatgaagacctcgactaccattcacaaggtgcagttgagagacttttggacagtacacagtgtcaacaaatgtcacaggctccgaccaagtataaccacgtccttggaaaatccttccattatagcggatttcaaaacatcctaacttgctgtaaaattccagaattctttgatcatctggtctcacttcaccgaaagctccccgggagccaattagccttcagtgaagacaggaggcgagccatcatgcttttgggca

SEQ ID NO: 649997 - DNA, 386 bp, Homo sapiens
  misc_feature (35)..(35): n is a, c, g, or t
  misc_feature (65)..(65): n is a, c, g, or t
  misc_feature (68)..(68): n is a, c, g, or t
  misc_feature (70)..(70): n is a, c, g, or t
  misc_feature (100)..(100): n is a, c, g, or t
  misc_feature (114)..(114): n is a, c, g, or t
  misc_feature (120)..(120): n is a, c, g, or t
  misc_feature (143)..(143): n is a, c, g, or t
  misc_feature (160)..(160): n is a, c, g, or t
  misc_feature (183)..(183): n is a, c, g, or t
  misc_feature (195)..(195): n is a, c, g, or t
  misc_feature (201)..(201): n is a, c, g, or t
  misc_feature (204)..(207): n is a, c, g, or t
  misc_feature (212)..(212): n is a, c, g, or t
  misc_feature (215)..(216): n is a, c, g, or t
  misc_feature (221)..(221): n is a, c, g, or t
  misc_feature (223)..(223): n is a, c, g, or t
  misc_feature (226)..(226): n is a, c, g, or t
  misc_feature (241)..(241): n is a, c, g, or t
  misc_feature (245)..(246): n is a, c, g, or t
  misc_feature (251)..(252): n is a, c, g, or t
  misc_feature (255)..(255): n is a, c, g, or t
  misc_feature (259)..(259): n is a, c, g, or t
  misc_feature (264)..(264): n is a, c, g, or t
  misc_feature (275)..(278): n is a, c, g, or t
  misc_feature (289)..(290): n is a, c, g, or t
  misc_feature (294)..(294): n is a, c, g, or t
  misc_feature (335)..(335): n is a, c, g, or t
  misc_feature (340)..(340): n is a, c, g, or t
  misc_feature (342)..(342): n is a, c, g, or t
  misc_feature (345)..(345): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (378)..(378): n is a, c, g, or t
ttttttttgaatttggatattttggttaggttgtnccaactttcactttttttaccattccatgnttntntttgggtaatcccttttaatggtgaacttnaggtcacaacagtnactatnagttcaactactccaaggtttcngaagacaatggcttctncacccaagcaggttgtatatganttccaaattggncctggnttnnnnctggnggnnttttngnttngcgctgttggggggntttnnggggnnggntttngggtngggtggttttnnnnagcacattggnngggngggatttgttctgcgtcacgatcagactgttacattttgcnatcancngcntggggtgcnaaaaanaaaatntgcgttggggcnctttgttg

SEQ ID NO: 649998 - DNA, 592 bp, Homo sapiens
  misc_feature (109)..(109): n is a, c, g, or t
acacaaaggcagcggcgaagtaaagccttggatgacttctacaaaatgttacagcacgagcccgaccgagcgttctatggactcaagcaggtggagaggccaacgaagnccttggccatagacactttgctcatcagtgatgagctcttccggcatcaggatgtggccacccggagccggtatgtcaggctggtggacagtgtgaaggagaatgcgggcaccgtaaggatattctctagtctccatgtgtcgggggaacagctgggccagctgacgggagtagccgccattctccgcttcccagtgccagaactttctgaccaagaggatgattcaagttctgaagaggattaagactggcagttaatagtttcgtccctggttttctcagcatccttgcaggtgccagagcagcacttgttgatcctgctggggtttcttgtgtgttgggttcacattaagtgttttatgatttgggcggcaggacatgtattcaaattaaataaatcacgacgatgtccaagcttatgttttctagttcgagttactgttttttaaatacctggaaacagcaacttgtgtagttaagaga

SEQ ID NO: 649999 - DNA, 179 bp, Homo sapiens
taggctgtggacgacggtggatgatgcataaactgaaagaggtccagagccgctctagatgtcatagttttcgacctgcaggatcgtggtgagccagccgacttcattagagaagcccatggacagcatctgggagagggtctgaatcagccaccactgagcctctggcggaagatgtg

SEQ ID NO: 650000 - DNA, 523 bp, Homo sapiens
gaagactatgaatcttttgatagcatttccttggggttttgggagagaaatttacatcttgcagatatctgatgaaactctcatgtgaccaaaaagactgcaaataagagtttgataaacagaaaacagcatgacatatagtttctgggtaactctttgaacttcttaggtacagcatatactgtccttcacatcacctgcgtgctatttgtgagatatctgagcttattcgaacacgccacagcggaatcatgtggaacgtgagctagctgggtgacgggcatgcaagctatgttagccactctgtcctcagtttccctagataatacaatgaagctggagtagtcagcgggtagtggtcctcacgatcttttacatcttatagtatggaatgcggacacggatttgctagactttcatttttctgtgtaagtacattaggaatcaataactactgcctactattaccatctttcatgaaataaaatattttctagcctgaaataactggcgacgacatacc

SEQ ID NO: 650001 - DNA, 161 bp, Homo sapiens
  misc_feature (1)..(1): n is a, c, g, or t
  misc_feature (97)..(97): n is a, c, g, or t
nattcggcacaggctaacaataaaatataatgcccatataaggaaaaactataaagttatttatttatttatttatttatttatttatttatttatntgagatggagtttcgcactgtcacccaggctagagtgcagttgcgtgatctcggctcactggcc

SEQ ID NO: 650002 - DNA, 434 bp, Homo sapiens
  misc_feature (28)..(28): n is a, c, g, or t
  misc_feature (34)..(34): n is a, c, g, or t
  misc_feature (121)..(121): n is a, c, g, or t
  misc_feature (178)..(178): n is a, c, g, or t
  misc_feature (199)..(199): n is a, c, g, or t
  misc_feature (249)..(249): n is a, c, g, or t
tttcacactgcagctgaagttcattacntgaagnacgcctcatcatttcattccttggctccaaaccttctgctgcctctaagataaaagctcaacttcttaacagtgtacagtgtgcacnttccaacctttttatctgttctctccaccttcagtttagcgtcatccaaaaacacanccttgcaaagctttgtactcngcaccccagatgatctccaggcagctcagatctctttcctgcttttgccntgcactgttcccgggacttcctctttaatgtagcactcagctccccagccattctgtccatccttcagagcaaccattttaatgaattggtttttgaatcccaaaaaggttctgccatgaagtggccagtcatcacggtagatggcgtatgttttggctgatttttaaataaaatgaaacccata

SEQ ID NO: 650003 - DNA, 526 bp, Homo sapiens
cgggatagtctagagatcccgtgtcatcccccttcgtcaggaggcagaggtttagtgagccaagattgtgccactgcactccagtctgggtgacagagcgagacctggtcttaacaaaaaagaagacatgtggctggccgcagtggctcacgcctgtaaccccaacattgtggggggacgaggctggtggatcccttcaggtcaggagttcgagaccagcctggctaatgtggcaaaaccctgtctctactaaaaaaaaaaaattacaaaaattagctgggtctgggggtgcgtgcctaataatcccagctacttgggaggctgaggcatgagaatcacttgaacccaggaggttgaggctgcagtgagtcaagactgcactccagccggggtgacagggcaaaactgtctcaaaaaaaaagaagacttgtgggcaagaagtgtggggggggtgatttccctaattacccaaacctagaattgcctcagtgcccatcattagcaggctggataaggacgtagtggt

SEQ ID NO: 650004 - DNA, 185 bp, Homo sapiens
atgtcatgagaactgtgcctatcgctcgaccgtgagtgaccaacagaggagggaaggcaagctcaggtggccgctccctcagggcatccaggagtctctgcacactctccccctggaggatccagagagaagttgtcaagcatggaaccctgaagattctacagcaggatatccagtggaatttc

SEQ ID NO: 650005 - DNA, 623 bp, Homo sapiens
  misc_feature (29)..(29): n is a, c, g, or t
gctagcgaatatgtatagccggcccgggntgtatttcgtcacggggctcgtcatgtactggtgacacagggccctggcccgttcaacttcccagcgaaagcctcggcctaatgcagaatgtctacagatacttgtggaatgcagagaaaggtgcaacattccttagtgatgctgagatcatccagttagtcaactgctaagcatatcccagcctacaagttggaaacgtctgatggacaactcagtgagcgtggtgtatcgtattcgccgacagttactttccaagaagcttacagaaccttcttctctccaggtacctagccttacagggattataattacgtccttgcgtgcatgtgcgcagcttgttgtgcagcaatgttattggatactatgcccatccctgttggagtggcaggacccctttgcttgagatgcacaaaatgcaatttcaggttgccaactggcaagcaacagtaaggtttgtcttgttggccagcaccaatagtaggctgcagcagcaatagcgtcttgtgctggaggtagccagtcagtccgcagtccttgccagactgggactgactcgtggacccagttgtgcgtcttccacgtgcttgtgactc

SEQ ID NO: 650006 - DNA, 261 bp, Homo sapiens
cacggagttcctgtacaacctgtactcatcagagggaagggcgtcttcgacctgcaggaccaatgtcctgggccacctgcagcagggtggcgctacgaacccctttgaacggaactatgggaccagctgtggtgaaggccagctgtggttgtcggaaaacctggcggaggtaccggaaggcggtggttgccaagccccaaaccggcggaatcgctgaaaaaggggggctaccggttgcacaaaacgttttacctgcggatg

SEQ ID NO: 650007 - DNA, 1588 bp, Homo sapiens
  misc_feature (1311)..(1311): n is a, c, g, or t
gcccaagattcctacatctggacgcatgacggccgcgtgtgccagcaggaggtcccgcgggagtccgcttgcctgggcctctggagactcgtgggaagctccgcggatcggcttcctgcggaggcgttgcaggcccgctgcgcatcctggggtgcccgttggatctggttgccagtaggaaccgggcgcctggggggcctcagggccggcgggacccctcgctggacgtggccaaaggggacaccgcatggggaatagatgcgtaggctagcgcaatggtctccccgatgctagcaccaacaagctttcgagggacaccgccctatgcgttgcgaccgtgaacccactcgcacaagagattgctagacgttcctcgcgtcgaggaagcggacgcaattctgagtccttcccggtgtccatgcaccacctcgcccctccaatgtgacctttgggacaattcaagcacgaagttcccttgtcgcactgttgtccattttacccccttgcgagcgcgacgccctcctccttcccaagaaggggccctcgtaccgcgagttctttaggcagacggagtttcacctcgcccaccacgagtggcccctgtgaaagaagcaagaaacaccccccgtgggcgccgttggggcgcacagagcgacaccccccagggtggttatcctgaggggccccctatataggcctttcggagcttaatattcgctggaggacaaacgtaaaacaccatccgagggtcgccaatcgcgtttcgcggcggcctacattagcgccgccctggatatttaggtgcttttgcgcggtcccccctagcggcggcaccgtggtttgtggggctccctccggggcccctgaaattcactcgcctaggcgttgggggcccccacatttctgaacttacgccatggttgcccccaacaccggtctgtgccattcttgcggacttccggaaatcctcccccccgggctcgccttcgggccaagttgcgggcgaccgttaaaccctgcggcggaagcggcggaggaggcccattttggggcactcgccgggggggggttaccaccggtttccccccacacgaaacaccacttctgtgtggggtgaccaccgccggttttgtgcccttaccaccgtgggggttaacgcaccccgggtgcgcgccccgcgccggttaattgcgccaagtcggcctctttcgaatttcgttttgggtgccctttctggagggctgtgatgggcctggccaacccctctcctttatggttaaccttctccggttgggtgccacaccccgtccntagggcggccgaaggcccttggcgcatctcgggtgggtggaccttccccggctttttaaattcccccagagcggcgaattcgccaattcgtgtttggggcgccacctttctcccccggccaagaagacgggtcccgattaggcatctattggcgagacttccggacatattttgttggtcccctatggcggcgtttgaggataccaccgcagggtgggcacaaccgtatagtgactactattttggggccggcgccttcccccaccaggtttcccgc

SEQ ID NO: 650008 - DNA, 171 bp, Homo sapiens
ttcgtctttataaaagacaaaaaacaataaacgtagctgggcatggtggtgtgtgcctgtagtcccagctagtctggaggttgaggtgagatgatcgcctgggcctgggaggtcgaggctgcagggagatgtgatggcaccactgcactccattctgggtgaccctgtctc

SEQ ID NO: 650009 - DNA, 468 bp, Homo sapiens
  misc_feature (3)..(3): n is a, c, g, or t
  misc_feature (85)..(85): n is a, c, g, or t
  misc_feature (100)..(100): n is a, c, g, or t
  misc_feature (117)..(117): n is a, c, g, or t
  misc_feature (123)..(123): n is a, c, g, or t
tgnggggccccatgtcttattcaccaacacttccattactctggagtccagaggcgagatgattttctctcagttctaggacttnccagaggtacatagngaaaattcatctgaaancaaaangaaccaaaataaataaaataaaaacacataaaacaaaatggataaaaatgacatgtttattattatgataggtgattttgacatatttcttctacttattgaagatcaagtagcagaaaagtggagactacaaattacttcagagctgggcatggtaatgctcaggctcaaaaaccaacaagtaacaaaactcttaaaaactaaaaaccatttatttgatgtaatatacatgcatgagttgagtgttctacttaatgttagaaaaacaaatccaaagaaaatagaattagtaaagctgtaagagtcaaattaatgaactaggaatgattgcataggagagaatta

SEQ ID NO: 650010 - DNA, 493 bp, Homo sapiens
  misc_feature (20)..(20): n is a, c, g, or t
  misc_feature (40)..(40): n is a, c, g, or t
  misc_feature (43)..(43): n is a, c, g, or t
  misc_feature (49)..(49): n is a, c, g, or t
  misc_feature (51)..(51): n is a, c, g, or t
  misc_feature (55)..(55): n is a, c, g, or t
  misc_feature (62)..(62): n is a, c, g, or t
  misc_feature (67)..(67): n is a, c, g, or t
  misc_feature (76)..(76): n is a, c, g, or t
  misc_feature (102)..(102): n is a, c, g, or t
  misc_feature (112)..(112): n is a, c, g, or t
  misc_feature (122)..(122): n is a, c, g, or t
  misc_feature (133)..(133): n is a, c, g, or t
  misc_feature (135)..(135): n is a, c, g, or t
  misc_feature (146)..(146): n is a, c, g, or t
  misc_feature (196)..(196): n is a, c, g, or t
  misc_feature (198)..(198): n is a, c, g, or t
  misc_feature (239)..(239): n is a, c, g, or t
  misc_feature (248)..(248): n is a, c, g, or t
  misc_feature (262)..(262): n is a, c, g, or t
  misc_feature (274)..(274): n is a, c, g, or t
  misc_feature (276)..(276): n is a, c, g, or t
  misc_feature (285)..(285): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (333)..(333): n is a, c, g, or t
  misc_feature (365)..(365): n is a, c, g, or t
  misc_feature (393)..(393): n is a, c, g, or t
  misc_feature (444)..(444): n is a, c, g, or t
tggaagcaggtttatttatnaaaaacttgcaattgaatanaanaaacananatanatatgtnttatntatttctanaaatgcacataacatatatttgcctnttgtttaatnttttttccanaaatttattananaagggcatggngggatacctacttattcttcattatgagaacaattaaaggcatttattananaggaaattaacagatcatctgcttctataactttattagcnacattaaanaggcagtgagcaanaatttaaaaacncnccattatanaaaanaanaaanaacaaagtaaaagttaatgttataaaaataaactgntagttagggaaatctaaatgggcatgatcccnttttagaagaccaaatgattaatagggntgtcatgttataatagacaattgtctaattatttctgtgtttttatttagngggtagcagaagttgttcagaagagcagaaatatgtagaaaacatctct

SEQ ID NO: 650011 - DNA, 341 bp, Homo sapiens
gccgagatcatgccacgggactccagcctggcaacagaggtggctccgtctcagaacaaaaaaaaaaaaaaaaaaaaaaaaaaaaatcatattagtttatctcattataaccaatctcatcagaaaagtcttaagtattgagaagttgtcaggctgaaaggcaggtaaaagttttctaaacattctaagtttcacttgaaagcttgaattttatcattggcaacaatgcttttcttgaaatgacgggctcacttattatagttattactattattattattattttgagaatcgcttgaacccaggaggcagaggttgcggtgagccgagatcatgccacg

SEQ ID NO: 650012 - DNA, 362 bp, Homo sapiens
ccaagaattcggaacgaggccgaactttgcgagtctttgtttgggaggctggggcctgacttcgccggggaccgggccgcgggctcggccgtgcgctccggtgcagcggccgaggagccccggcgcccgccaccccgggacacgccctcgcagtcgagcccggaccccgacccggaccccagcgccgccgggcgagggcgggagggggagcgcttaccagatcgtcccgagcgcgccgcggtccaggcgggcacagcgcagggtcaagttcacgtccggcccgcgggctgcccgaggtccccgggcgcggctggggcagcgggaggcgcgggaggccgaggtccgggtggccgccgcggccg

SEQ ID NO: 650013 - DNA, 147 bp, Homo sapiens
attgccttcccgtacttctgtcttccagtttaccacttcaaacttctatcttctccaaattgtatcatccgtaccactcccatattaatctttccattttcgtcatgcgtttatgtaaatgcgattaactacggctttaatatgacg

SEQ ID NO: 650014 - DNA, 494 bp, Homo sapiens
aaccaggtgttcctgttggcaaacgggtgggtttggctttttgcaaagcatcaccccgtcttcccggatcattctgtataagggggtcctgggaggggcagcctacgtgaaccccttccccaacatcgccctggagaccagtgatgagcaccgggagtttccaatgggggccccctgcattttttacccactggggatttccccgtcgggggtccggggtttggctttgcaagaattcctttgcaggctctccttattatgggggtccccaggaagcaggtcacattcccctgtggggaaagggaaaggttaaacccccagggcccccccaaaaaccccccattaattggggtcccccccttcccggcaggtttgggagtagggaaggggttaaaccctgtttcccctgcaggggggcccccccttgtttcccccttggggggtttttttccgggctcaagccttttgaaaaaaagccggttttttccctggga

SEQ ID NO: 650015 - DNA, 184 bp, Homo sapiens
gtggtctatatatctcttcctcacactgttagttactgtgctccccgttagcatgagggctgcgtcccagggctttctcatcttggtcttcctgcacctagcatcaccttggagacctgagctctttgggacagggtgctcatcaatcaaaactggcaacctccagatgaacgctctgggcttc

SEQ ID NO: 650016 - DNA, 349 bp, Homo sapiens
  misc_feature (186)..(186): n is a, c, g, or t
  misc_feature (290)..(290): n is a, c, g, or t
ggccgatgggaaaaaaaaccctattactgcgccacgggttaattgtccaagaccgccacgacgggtaataacgtgcgtaaacgctcaatttttctgggctggcagaagcgtaacaggtcatttaaaggatgcgttccacgcactgttcgtggaactcgttgtgatgacggaatgagaccaggtaangcagcagtttttctctgtcaatttggcgtccacgatactgaatttggagcgaaccccaatctggttgatgggtgatcaggcagtttgatttcagcaggtggctnacaagcgtctcttccactactttttcaccacaggtggcattctccagatagtcagtagt

SEQ ID NO: 650017 - DNA, 170 bp, Homo sapiens
  misc_feature (95)..(95): n is a, c, g, or t
tgcttgtgctataacgtgtaagcgctgtacggtccgaattttgggatcggctgctgcttttctcagcgccgaagccgcgccatgctcgtcctcangaagcgccctgacgtcgggcgctggccctcacgggacgctgggcgcccctcagatgttgcttcatctgtgttttg

SEQ ID NO: 650018 - DNA, 156 bp, Homo sapiens
tcagctttttattggtatggtattggttcgcaaaattaaaaacaattacacatttccaggagaattgacttgcttctgtggacacgtcatcatatttctcatttacttttttacacacttccctgagtcgctgctattgaaacttctaaaactagg

SEQ ID NO: 650019 - DNA, 251 bp, Homo sapiens
gatttgatggatcaaactctatgagatattccagagaactaaacacacagtattcaggttgtgtatgctttctgacacaatgccaactgatgtgttggacgtgacctaaatattcatgagagatccaattcgaattctggtgaaaaaggaagaattgtcccttgaagtaatcaaacagttttatattaatgttgagagagaggaatggaagttggatacactttgtgacttgtacgatacactgaccatta

SEQ ID NO: 650020 - DNA, 396 bp, Homo sapiens
gttgttgtgtcaatgctctgcagtcccacaaggaacgcatagagcacattgagtgtagacatgcaaggccaggcgctacctgattgtatagggaaaggtcatgtggctgtagggaacagcttaccagtcaatgcccaaccttgcaggcctaccttctacagatagtcatctctggcctgccatgttcactgttttctgcacagtcagccaccaaccttatgatgactgactatgcagaaaagaataagccgcatcatcagctgcatgccacaaaactctattcttttaaaggcaggtggttcagtgaatattgtggcaccgaggcatctgagaggcaggtgtgctccggatatgaccattcatttctctggcgcattaattctccctttgttgcta

SEQ ID NO: 650021 - DNA, 678 bp, Homo sapiens
gctgttatcacctctagacggatcccccactaaggatcaactgaagagaaacttacaagtgtcatgaatgtggcaaggttttaactcgaaaatcaaaccttgaacgtcatcatagacttcatactggaaagaaatcttagaagtgtaaatttgcaaggtttttaggcaacagtcaaaccttgcatgtcatcatagactttatactggagagcaacaccttacaaatgtgaagacatgtgcacaaaagttttcaatttcaaatcactccttgaactacatcaggcagcagtcatactgggagagaaaccatacaaatgtaaggtttgtgcacaaggattaggggtgtgcatcacacttggcccaacatactggactccacactggcaaaggcattgtacaagtgtaaatgagtgtggcagcagccttgggtggtcagtcaacaattactcaccatcaagccatccgtggtataaaggaaattgcataatgtatgattgtcacaaagtctacagtaatattacagccattgcaaaacatgggagaatccataatgaaggaggtctaacaagtgtcatgtggcaagtcatacagacatcatacataccttgcagttcattggcgatcttatacaggagagacatcttacaaatgtgatgattgtggcaaggtcttcagtca

SEQ ID NO: 650022 - DNA, 117 bp, Homo sapiens
cgaaataaaatggcatgccttcccccgctgaaataatcagatgagaaatgcatggcgaaataaaataaaactgtggccgactatttaatgaagatgaagggaagcgttatttattgg

SEQ ID NO: 650023 - DNA, 290 bp, Homo sapiens
atctataaagcgatatacagatgaaaatttgagactatttgaacttataaatcatattgatgaaaagatttaagcgcaaactttagggtaaaaattgccaccccccccgtctccaggtgaaccaagggtttgggcctgggaccatttccagcttgaccacagttggtcaccatagggtattcaattaaactctgtgtgcctccacatccacctctgtatatcgggtccagtcccggcccctcccaacctcacaggcatgttgtaagaattaataaggtaacgtgtaaaaa

SEQ ID NO: 650024 - DNA, 277 bp, Homo sapiens
ggacgaagcaccagaaggaagcataagcatccagaaatgattagaaattaaaagttacaagaggccagtgagaacagagcactagtgaattttccaaattttaaatgggatggtgtaccgacaaaaataatggacaaagttagaaaactggctctgatttcctcttaaccacttgaagcactgagatttgatgtttagaccgtaactactttgagttactgctattaattagtaaagtatgagatttccaggtacatgttaggcattagatgagatt

SEQ ID NO: 650025 - DNA, 1106 bp, Homo sapiens
gcttgagagacagaggcaccccggacagagcacgtgaagccactgcaataaatagactcagacatgactgacaaagccccagagccacatgatggaggaggagtgacgaatgagtgagctggacacccaaagctccaacttaactaacgccatccaccacagcaaggtccctgcaacagacgcagcctgctacgggacaatggaccacaacgcattgcatgccgcagcctctcactctcccggtaccgtcgcacactaccggcgtggccttggcgcagtactgggctcctgctgcgctgcacaggagctcctgcctgcgccgccccaagtgctcgggtcggtcgaccccccggggtcttcagcccgctaggctttcgtggtagacggacgctgtctccccggcgtgtgaccctaggacttccaccacaactgcgctagctccttctccctctcgggcgcgacgtccttgcggatgacgcgccccttcgcgccacgccgcggaccagcctcgatgttgcttgccttcctgcgcggtgcaaagggctttcccttggcgcctcattcacgcgcgccttccgccgccccttcctcccaacctcttccaccagcatcgctgcaccatccctggcggcccctcactccgggtcgctccccgcggccctctcgccacgtgttcaccggctctccccatgacccgactccaccccccttaaccccggggcacccttgggggggggttggcacctcggctggggcacttgccttgctggcgcaactgcaacttttcagttggggttctcggcgcccgtcgcctttagctgtggacttccttcggtgcccccttcgcatgcggctgctcacctggcggcttccgccgcccctgctccccccccgcggtctgcaacggggcgcgcggcctcccgtccaccgcggccccccttgcctcgcgcctgcctgcacgccgcctcacggttacccccacggcacgctccaacatgctagcccgtttgctccccatccccggcaccccaatcggaccagtgcgtccacacgaaatccgacgcccttcacgcgttcgatgggcgtgctttgcacacaccctctgg

SEQ ID NO: 650026 - DNA, 226 bp, Homo sapiens
ggcgtgatagaggatccccggtaagacgcggtctgtacctggccgtcgtgagcgctacctttgtgtcccagcatttagggggagaggcggctcttaaccaagaggtgagcgtggaggtggttagtggtgaaattcctaacagggcaggtttaggcatctaaaaagccaacttctccgggccacgcaaagtgggaagatggagttcagcttgtattcggttagcagg

SEQ ID NO: 650027 - DNA, 334 bp, Homo sapiens
  misc_feature (8)..(8): n is a, c, g, or t
  misc_feature (51)..(51): n is a, c, g, or t
  misc_feature (226)..(226): n is a, c, g, or t
  misc_feature (228)..(228): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (281)..(281): n is a, c, g, or t
acagaagnatcgctatcaccgcccaaggtcagaacaggaccagcacccacnagcggaaggaaattcgcccaggcctgctgagggacaggctcaggggtcctcccaggcaatggaacttgctggttactgcgctcctgggagctaggggcgcctgggtttcccaggtgtgaaggggcagtgccccttggcagggaccggcctctctctgcagcgccacggggttctngnccccccgcggcgggagtaggggntncantccgccgccgcaggggctacaatantccgcgccgtcggggttgcactgcccagaagaacactttcggaacgggggcgt

SEQ ID NO: 650028 - DNA, 186 bp, Homo sapiens
  misc_feature (106)..(106): n is a, c, g, or t
  misc_feature (108)..(109): n is a, c, g, or t
  misc_feature (114)..(114): n is a, c, g, or t
atcgcttctcggccttttggctaagatcaagtgtagtatctgttcatcagtttaatatctgatacgtcctctatccgaggacaatatattaaatggatttttggancnnggagntggaataggagcttgctccgtccactccacgcatcgacctggtattgcagtacctccaggaacggtgcacca

SEQ ID NO: 650029 - DNA, 350 bp, Homo sapiens
cgaagatggatgttaaaatcagttgcccaggataaaatgcaggcaggatctcagctcactgagaaactcgtgcttcccattttcaagtgattctccgtgcctcagcctcccaagtagatgggattacaggtgcgagccaccacgcctggataattttggtattttaagtagagatggggttcaccatgttggccaagatggtcgcaatctcctgacctcatgatccacccgcctcggcctcccaaagtgctgggattccaggcgtaagccattgcacctggccaccaatttcttaaaataggacaatgatgaagttggctgctttgattgactcttctgttcacaaaact

SEQ ID NO: 650030 - DNA, 98 bp, Homo sapiens
  misc_feature (45)..(45): n is a, c, g, or t
ttcaagcttctaacgatgtacggggacatgggaatttggcctttnttgattaaattccgtgctccccctgcaaataaagcctttttacacatctctca

SEQ ID NO: 650031 - DNA, 1616 bp, Homo sapiens
  misc_feature (325)..(325): n is a, c, g, or t
tggaaacggagtggtcccctctgtcccccaggtgggagtgcaggggggcgctcatccggggctcacgggcaactctccgcggctctccccgagtttcagcgcctatttctccgcgggctcttaagtctctcccccagacaggcggggaatctaacgagggcgcccgccacgcggcgcccgcggttaaatattttttgggtgatattttaagataaaaaagcgggtgttcacactcgcggggtctctccgaatctctctctcgtagagactctctctgtgagtatccgcgcgccgcgcgctctcgacgagcgctctccccaaccanatgagaaatatctctcgtgaaacccctagtcgtgtgtgtgaaagtagtgcggagcgcggacacacacagagacgccacatatatatctctctctatctactttctcacaaagacgacaatagagtggggagaacacatatatactcgcgcggtgaatatctctttattctctctcagcagactagagtgtgacacacaatactcacctctgtgagagaaaagagagagatatagtcgcgccaccacctgtggggggagtggggcgctcctccggaaaatatgtggggcgcctcctctcttccccgcgtgggggcgcgtgtgggaggcaggtctctcttatataatgaggtcacagaggtgtgtgagccaaacagatatgaagaatataaaaaatctcccagaggtctctcccccaatataaaagcgtgtctccacagagcgcgttatatcaacgggaggaagggggaggaacatatctctcgcgcgcgcctatataatataaaaactttgtggggctccagaaccgcgggtgggctctccctcaaaaacgcgcgtgtgtctctcgcgtgagatctacagacagtgtgtatacctacacatggtgacaccacatggggggtgggccccaaaaacactttctcatatataaggcaaaattcttacacaatctttagagcggccctgtaggagagcacccctggtgggggggccccctgtgtggagaatctcttcgcgccctgttgtggcgtctcctcacacaaatagttgtgcccaattggtggaaggacaacacattccaatattataaccccccctgggggtgaaaaggcataccatttatgaaagcggccttcgttgtgaacacccccaaaaaacactaataattatcgacgacacaaacttcccctctcccccccctcgttgtttgatgataaaaaaacactccctctacaaaataaaaaaacacgttggggagcggcgacagagagggaggaccagatggaggaggcggagcacacacaaaggggggatccctaccaaacccaacggggctggggtgagatggtgttctccccccccgggggagaaacccacaaggtcttttcaaacaatttccaaaaaaaacaaaaaacaataagagaaacaacacacactaacaacactacaacacgcacctactacaatcaaaacacatacacgacacacaaaaaccagcaaacaacacacagtacgacaccacaactattcgagcacgagaaaaacaacaatcaaacaacgagacaactaagat

SEQ ID NO: 650032 - DNA, 148 bp, Homo sapiens
  misc_feature (11)..(12): n is a, c, g, or t
  misc_feature (112)..(113): n is a, c, g, or t
gtgaagcaaanntgcgacagacagctcccagaggcgaggggtgcgtgtgcgtccgcttctcacctcaggtctccttcggccccgctgccctccctcgcggcatgggtgacanntgggtcggtccgtcgcgggctgcctggggtgcgag

SEQ ID NO: 650033 - DNA, 111 bp, Homo sapiens
tcctcgggaggaccttctcatttcccctgagtgagaaggagcctccggagggctttgagcagggtagggttctgatctgttggatattaaataaagatccccccaggaaca

SEQ ID NO: 650034 - DNA, 751 bp, Homo sapiens
tatgtgttgccgtccaggtaaaggcttcctaaaaacgtgtgaaaacgtaggcttggattaaggcgacagcgattcctaggatagccagtaaaattaaaattgtgaagataataagtgtaaagggaaggtataatggttcgatattggctagggtggccgctcccaattaggtcgcactgagtagtgtgcgcctagcagtacatgttacgcggttagagcgtacggccagggctatgggttcagaatagagtagcgctagatggttccgataatacctagtatggggataaggggtgtaggatgtcgcccttgttggctacaaaaggtgcgcgctagggcattttaaactcttagagcgaaacgcctataactccactgcccccgcctcataaggggatgcgccagtggctaggtattatagatagcttgggctggtccggcggtaccatgacgtgacggccagagagcccggagaaagcgtatcagtcgtgtggcgcattcaacacatggattacagcgagtccccaagcatcatcaacgaagactcccagcgtccccgcccccttaaagggagagaagaaactaaacgcggaaacacctcagaggcacggaacggctcacccgtgcgaaataacagcccattggatcaggggggggcagcaacaaaccccccgatgcgtggaccgcagacaatttcggggagagagggggacccccaaaaacaggcgggaacacaaacaaaccaccagcc

SEQ ID NO: 650035 - DNA, 542 bp, Homo sapiens
ctttttctttttttctcaaaaaataaaattatttgggtgggggggactaaaaccctaaaaaaatttttctaaaacataaaaaaatcccccctttttaaaaaaaaagcccaggatttgttttttccggggttttttttttaaaaagggttttccccaatgggagggggaaaaaattggggtttgttaggattttttttcaagagccaatccgttggccaaatttaaataaaggagaaaactttttttttcttggatccggaaatttgaattgtgtaagatggcaatttttcccaaagcattttacagattcgggggcctttttgccaaagggccaacaagtttttttggaaaaagggaaagccacccctcaaattctttttgaatttgggggggggttttgaggggcccaaacaattttgaaaaaagaaaaaaggggggagggctggcttgggcctctaaaatttaaaaccctttttacaaaaagcccagggagccacgcccgggggggggaatgaccatccttatatgcaaacactggcacg

SEQ ID NO: 650036 - DNA, 899 bp, Homo sapiens
  misc_feature (405)..(405): n is a, c, g, or t
aagagtgtctccgctgcgcgtgtactggtggggatagaacaaagatttgttacgctagtatcatagggtggtagtgctaatcgaatcccttctttccactcgcgatcgcttcattcccttgtcactcgagatagtgcgttgatcttcacttatgagagtcatctatgtagtcgtagtgaatattagtgtcacattcagagtcccgccagatttttatacgacctgagtgttccaagtagtcttcgctgtgctaacgctgggtaaccttactcgcatgaaggggtgaagtcactggatgtctcaagagttgaccgcgtcgcaaatagcaagtagccaaagccgttgccaaatgccacccataaatcaattgggcccgtttatttatgacgactttatttattctanatatgactttctagtagtattgtatatatattgggtcgtctgcttcgccttgtatggttctcttccttgtttttgtaatagttgaaaacgatgatataattattataagtagactataagtatatttagtaagtatatattattagcttaaaagtgtatttagtgtaggggcatttttaagagtaaacaatctgagtgtatacagaacaggaacaacaaggaaactaaaaaagggacatgtggatgcgggatctgtgccgcacgaggagtgtgtctcaggaagccattgttttgaggtgtcgtcgaccctgaagcacaggcataccttagaccttctgcaaccatgacgtctactcgcagataggacaaccgggggacctcacaataggagtctagtatcactctacaccctatataaacaactcacgtggggcctgcagaagctttgtgaaacacaggctcactattgaattgctggggactcttaaggggat

SEQ ID NO: 650037 - DNA, 182 bp, Homo sapiens
  misc_feature (1)..(1): n is a, c, g, or t
  misc_feature (115)..(115): n is a, c, g, or t
  misc_feature (129)..(129): n is a, c, g, or t
naagaagtatgagtcacatgtggtacccgaggagttattcgtaggcttttcagaacttctgtagtgtgtggatgtaggctgtttcttgatgattaggtttcaatttgtctacgantaactcctccgggnatccgtgcacgttaacgattactaggactatgcagaaaccaggccgacgaaaa

SEQ ID NO: 650038 - DNA, 394 bp, Homo sapiens
  misc_feature (30)..(30): n is a, c, g, or t
  misc_feature (37)..(37): n is a, c, g, or t
  misc_feature (91)..(91): n is a, c, g, or t
aagccacatgaaataatccctgttagcttncctgggngaaccttacaacaagagcaaaaccccttatgcaatgaaagaaaaacaaaagcantgtcagaagacagcagaacaggccgggcgcgggtggtcacgcctgtaatcccagcactttgggaggctgagccaggtggatcagctgaggtcaggagttcgagaccagcctggccaacacggtgaaatccccatctctattaaaaatacaaaaattagccatccatggcagtgtgcgcctataatcccagctactcgggaggctgaggcaggagaatcacttgaacccgggaggtggaggttgtagtgagcccagatcacgccactgcactccagcctgggtgacagagcgagactccatctc

SEQ ID NO: 650039 - DNA, 1035 bp, Homo sapiens
  misc_feature (1)..(1): n is a, c, g, or t
  misc_feature (313)..(313): n is a, c, g, or t
  misc_feature (625)..(625): n is a, c, g, or t
  misc_feature (690)..(690): n is a, c, g, or t
nggccaaatgtcacccccctggagagtggacacggaacaggtcaattcccctccccagaaaggacgcgggggacacaaaacacttgccgggaagagccgcccggtttgttctccgccccccccgttttgtctcgcggcgtacaaacatttgcccagagcgggcacgcaagacgctctctcttctcagtgtagttagaccggccgcaccacacacaatctgtggtggagacacacccctcttgtgtaggggagcgcagataccccctaactcctcacagcgtagcgccagagcgccccacatacccctttggcnagacacaaagagggggttacatagtggggggcgcacacacccccgagagacaaaggatggagcacacgtggcgccccaacccaaaagagccactgggggcccccccttgggggggcgctgtctcgtccctggggcgcaatagacacatactttctctccaccagagaaatttctttgggcggtttttataacacccacacagtgttctccatctcggagaaagcccctctcctccagagtagagtttacatcttgctgtccatgtgagagacacagaattcttgtggcgtcttccaaagacaccagaggaantagaggtgtggcacccagggagaacacccacccacagaatgtctccgacccacctctgggggtcnttgtggagatgtggacacgttcaaatttggtctcagcgccacccagacgtgtctccggcgcaccctaccagaagaaaaaggtttctcacagagtttggccaatttaatctcctttgtatagatgggattgtgcctgcctggttagcccttagatttctcagaggcgtttacaacagacttctgccgttaatatctctcattgggatttagggatgcacccaacaccacgggtggttattctcccccccccaaatttgggtttttggatttcaagtagaacaaaaaaaaatggggaataataggggaaattatttatagcgatggaaaaaaacccgggggggggga

SEQ ID NO: 650040 - DNA, 254 bp, Homo sapiens
tacccccaattttccaatcccccgttggagaatggccgttaaccttagccggggctttatttttcttcccaaaccgccgaagggcctccttaaagctttttttttggggaaaaagctgttctcccttaaacgaagaagaaagggccgaagaaaagtgggcccccttagaaaccgagaaaaccgaaataaccccccgggactgctttttcttttcccgctgggggctgctaataaaaggggttttttttgctgga

SEQ ID NO: 650041 - DNA, 206 bp, Homo sapiens
cagtgagaatcaatagtgaccaaaagtatcagacttctccaacttgaggagagatacggctctgggaaatcatggacatgtctttcgaccttgtacgaaacagaaacctacgaaacgtctgggcagggacagttcttcacggcatcttcagcaacagagacagcgaatatccggcaggagattagcctcatgaactgcctccacca

SEQ ID NO: 650042 - DNA, 799 bp, Homo sapiens
cgatgtaatttttttccaagaaagcacaccccctggctttttcactcaaggtgcacttttggcacacactcaaatgtttggagaacgttatattaaaaccgctctcgcaccaacatatattgtatcgcaaactccctcacatagcagatggcagcgaaaaaataattcccccccacctccacgtgtgtttttatattccacacatcagttacatatacattacccgcgtgttattctttctcgcagagtaccaagtttctatcaatgtctgttttaccctcgctttctttaccaaaccaccccctttgttcgttcatcattcctttgaatttatgtcccactcctcccacgcatgttcatccacgtatttcattgtcaacacatataccacactctgtaggaagtgacgacttatgtttatattaatacgcacacacctcacacacactctcttattgtccccatctgtatacaaattcattgatgtcatatgtcacactatatactctcagtgacaagaagacttctccacacatatatgagacgcacacaatcaccacccccgcacacacatttatttagggaaactcaccacacactatttggagagaccacctctccaggtggccagcggtacatacatcggcgctcaaacgcctcgtaatccccagcaccctcgaggcggagacacacagagccacaacatgccatgtttggaaggagcacatgaagcatagcagcccccaccgaggcaaccaccatgaggggagccccctctcctgtcccacagaaaacagag

SEQ ID NO: 650043 - DNA, 901 bp, Homo sapiens
tcctattccgagctagcagagagtgtgaatatacgcatctgagtgctgtgcgtcgtgtacaggtgacgcggttaccctgggtgcccatacaggcgatttggaacacgattgtggacagtaagtactatgtgctaaatccggttgtccttagcgggactaatagctaatgggggtcataacacacgggtgaggcttgctcaagagagtgtgggcgcacaaacaaataggttggttgttgttaacgcagagtatcgcttgcgctaccttgtgagtgtacattgtgacacctgttctttgatgtggtgtcgcggcaacacacgagttgtagaacctgtcacaacacgggttagcttgccgcctctcggtgacacatcgatggttctccggccccacagatgttgacagatgattttgtcataatttgggagggacagcatactgagtctctgctggctaaatcaacgtcgtcgtgtaaagcaggtgtagatgaatctgcccccttcccgtcagagtgtggcgccccgccgccgctctgggtgtacatacttcttggatataggtggtctggtgtccgcagcgaggtgtgggcaatacctgctgtgtgctccgccctgttgtgggtgtctcttcgtgcgcaccggaatgtgcagggcgcacctgttgttagtcgaccagagtgagagtggacgcccccttttttcaatagatattataatgataggtcaagtctaaaagaagagaaacggggtataaagaataaaaaccaacacaacatccgagggaacactacttaatgtcaagagcagcaccgatatcagaagcattgttgttcgccccaaaaaggaaatggatttaaacccccccgggggaattgtggtccccgtaacagaaggaacaaaac

SEQ ID NO: 650044 - DNA, 280 bp, Homo sapiens
gtccaactcatccaggagtgcatcatcggaacaagtttgcctgtatgggtggaatatctggcagcgatggaaggttttctggatgggtaactgaggggattagctctatcgctgtaacagcatgggctggctgggacctcggctttgcatttgccactagttgctgtagcacgggctcgctcgggttgacttgctggtgcttgtgtaccggactacatacgcggaacagggctccacgcactgcccatgggatattgagctgcttgctctcttggcaggc

SEQ ID NO: 650045 - DNA, 201 bp, Homo sapiens
  misc_feature (197)..(197): n is a, c, g, or t
ctctagaggatcctgttgcgggcccggtgggatccttaaaactactgagggctgggcacggtggctcacacctgtaagctcagcgcttggggaggcggagcggggcggatcacacctgaggccaggagttcgagaccagcctggccaacattggggaaacccctatctctactaaagaatacaaaatattagccggngcgt

SEQ ID NO: 650046 - DNA, 454 bp, Homo sapiens
  misc_feature (400)..(400): n is a, c, g, or t
  misc_feature (418)..(418): n is a, c, g, or t
  misc_feature (444)..(444): n is a, c, g, or t
  misc_feature (450)..(450): n is a, c, g, or t
attttataggctagaatacaatctctaaaaggccctttctgattatcttaacccaattcattgcaaatattcaccattaagataagagtcactctgtagaacctgtcaattttctcagtcttaaggctttgagaacactttaatttttctataaatccgagttgaatgtactgccgggaaggaaaagctggagccccagggcctatggttcactccaccatcattaatgtttacatccacctttcagatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctngcaaggttcttggttttnaccttcggcctaatgattttgggganccagtnaggg

SEQ ID NO: 650047 - DNA, 155 bp, Homo sapiens
agtatgatcttctacagcatcttgccagagactacacaggaacggaacatatacagagcactataaacatgtctttggacagtaaaacagtcatttatactatctacactcttgattattccaatcatatcttcctcaaggccatgtaacttatg

SEQ ID NO: 650048 - DNA, 713 bp, Homo sapiens
cgcggagcagtccatgtcccggccgggaccgggacggcgtccgatgtgccaatggctagctctaggtgtcctctgctccccgcggttgccgttgcctccccggagcttctctcgcatggctggcgacagtactgctacttctcgccgactgggtgtctgctccggcaccgcgactgcccccggcatattctccctggctggttgcccacctgcgtctgccactgtctccgtggtctgggctggtgggcctgagccgctgggccgtgtctctggctggtgggcctgcggggtccatcagggcaacggttggctccaatgagcgaaaacgcaggtgcccagggctggctggactgctttgaagaccattatgctgcgagcactgtggcttgtgccctgccgggacttgccttgtttccgatgagctgatctcatggggagcccccgggtccgcggatatgcatcaggctacttgcacgtgagggaagtcacccgtaccagtcttcgttgatcagttatagccgcggtactgcccgcgagcaactcctgtggcacaaacgtcgggagcctcgtgggtgccgcggcgggtcgagggcggttctggaaaccctgtgcgtcgcgcttcgtaggctgcctgggcgtcggagacgcgccgcctctcagctgtgcctggtcctggtggtcctctccgtctcttgggcgagatggccattcca

SEQ ID NO: 650049 - DNA, 215 bp, Homo sapiens
aatgtgatagtcatacgttttagttctcgaaatgaatctccacagtgtataccatagtggctgtactagtttacattcccaccagaagtatagaactgttccctgttcaccacattcacacaaacatctattttttttttaatggtcattcttgcaggagtaaggtggtatcacattgtggttttgatttgcatttccctgaagattgttggtgg

SEQ ID NO: 650050 - DNA, 413 bp, Homo sapiens
ttagaggatcctgtgtcatccccttcgtgaaggggtctgatggagatatgtcctcggcggtgtcgtacgacctgagagcgaacctgagctgagtgggagatggctgtcaaggggagagctcaagaatgcggctggcgtagttccgacgcatctttgaactgtgcagttactctctgccttttacctgtattacacggaagtgctcttgttgcaggcttgtgttgctaattgcaagagaccggtcgggtttgctgtgttgtgacccgatcgagaagagtcaggaggcgtacctgctggctgttcgagcactacgtcaaccaccggaaacacaacattccggacttctggcccaagctgctgattaaggagagagaagtgcagagttcgaattctgtacggaaggggcgatgaca

SEQ ID NO: 650051 - DNA, 208 bp, Homo sapiens
agggtttctttggccggcttggctgggttggctggctggcttgcttgcttggctggcttgcctggctggatggctccctgacttggctggcttcgctgcctgactggctcggctggctgtctggctggctggctggctagctggctgggttgatggcttgactggctggcttgctggcttggctggctcgctgcctagaaactcttgt

SEQ ID NO: 650052 - DNA, 859 bp, Homo sapiens
  misc_feature (590)..(591): n is a, c, g, or t
  misc_feature (646)..(647): n is a, c, g, or t
accacagatcttggccagagctgggatgctggtatcagaattgccagagtggaatgttaatgttgatgccactttcaactgaagatcgagtgttgatggaccagtctgtgcctggaggcacaggtaagtatcatgtgcttacaatttgtgaaggagacccactagtacatagatgtgtaccattattcccagtcaatcgaatgagttaggaactccgtggagctctgcacatacctgtttagggctactgactgtgattccacgtcgagagaagggagtggacattagggcattgcccgtagtgacatgtcatcagtggtggtcgtttagctctggtgggtgcctgtatagacgaagtctgatacgcgtgtactactcacttcgtaccgcgagcatactcatcgtggcaatggcaacctttcgtatgcatgaattcgtcacgggatcagtccatactactcgtcacagacgttgagcacggctagaaaatagagaggtgtatgccccacccccaagtgtggaatgttgggcgacggactggcggcatgacgttgctgtatgagtcacgtatccagacctagttcctctgnnatgacatgaatgctcaagaataaacgtgtatgtacgccgtatacagtgagtgctnntcacacgatagacgaaggcatcacgcctatgtctgtgctacaggacaaataactcatctcggattaagcaacactctcccagtgcttttacagttcgtgctgttggaagaaaggctgtggttgacttgatcagtcctaggagggatcgtcagcgtgcccaaatttgttgttttttcgcatggctaggaagtatccatgataacacattcctg

SEQ ID NO: 650053 - DNA, 212 bp, Homo sapiens
actcgagcggaacagcggagtaaaatttcctaagatcctggaggattacctacccccgtcctctatcgagaccccagtcgtgatgtgacaggaagagccaccatgcaagatggacacgagccacaagctgcactgtgaacctaggcactccgcgccgatgccaacggcctgtgggtctctaaagggaccccccccccatcggactagccaaa

SEQ ID NO: 650054 - DNA, 350 bp, Homo sapiens
tcccagttcgacggagactctcaaggacatcgcttgaacccaagaggtggggatgcagtgagccaagattgtgccactgcactccagcttgggtgacaagagtgagactccgtctcaaaaaaaaaaaaaaaaaaaaaaaaaaaaaaaatgattacttcagccttgaacaagggttctcaaaattaggggcataaaccaaattgattgtttatatacgggtctcacaaaataaaaaaagggaccaaaaattggaccggggcagggcgggggatagggggggtaccattaaacgcttcccacgaactcaagcgctccttcttacgggcttgggtccaggtaaaaccccctat

SEQ ID NO: 650055 - DNA, 875 bp, Homo sapiens
  misc_feature (12)..(12): n is a, c, g, or t
  misc_feature (78)..(78): n is a, c, g, or t
  misc_feature (97)..(97): n is a, c, g, or t
  misc_feature (122)..(123): n is a, c, g, or t
  misc_feature (126)..(126): n is a, c, g, or t
  misc_feature (219)..(219): n is a, c, g, or t
  misc_feature (310)..(310): n is a, c, g, or t
  misc_feature (325)..(325): n is a, c, g, or t
  misc_feature (468)..(468): n is a, c, g, or t
  misc_feature (478)..(478): n is a, c, g, or t
  misc_feature (589)..(589): n is a, c, g, or t
  misc_feature (595)..(595): n is a, c, g, or t
  misc_feature (601)..(601): n is a, c, g, or t
  misc_feature (607)..(607): n is a, c, g, or t
  misc_feature (617)..(617): n is a, c, g, or t
  misc_feature (619)..(619): n is a, c, g, or t
  misc_feature (623)..(623): n is a, c, g, or t
  misc_feature (627)..(627): n is a, c, g, or t
  misc_feature (630)..(630): n is a, c, g, or t
  misc_feature (634)..(634): n is a, c, g, or t
  misc_feature (658)..(659): n is a, c, g, or t
  misc_feature (681)..(681): n is a, c, g, or t
  misc_feature (741)..(742): n is a, c, g, or t
  misc_feature (754)..(754): n is a, c, g, or t
tgccggcgtgcncccccgcgcctgcctggttgtgtcctcttttccctcctccgtttttcctgttccctgctgcttttngctccgctgtcggcctccncctgtccctgcgtttttttcttccnnccnttgcccttgtcctggcctttccctcctccgccctccttccggcttccctgttggtttctcgttttctcctttctttcctttcctccctctgtnccctgccgcggttccttcccttttcctggggtgggctccgtgccctgcgccttgttctcggccccgtgcgtgtgcctggggctctgttctnctccctttgcccttngcgtttgtcgcgcgtccccccgctgtgtccgtttgccccctttgtgctcgtgttccctcccttttcgctttcgcggtttcctcttcccgtggtcgccgggcttcgtccccttggttggctttccccgcttttctttccctgcnccccgctgcntctgtccccctgcgcaccgcttgcttcccctctccgcgcgtgggcggcctttgcgccttggcgtgcggcgctgctttggtgccttttttgttttttggctcggtgttttgnctgccngtcttntttggntagacttttntngttngacngtngctnacacttgggttttataggcacaanncacaagtcttatactagctgtnctttattttttgagttcttattaatgaggaacatccacttttgcattgacagtgatttcnngattgctttttntgcctttaaaggattcttgactagtcgtgcacatcagaactgccaggtccccagtggttctgaagcagtaagctttgggtgggctctggcatcagcactttcactaagcttcacagataat

SEQ ID NO: 650056 - DNA, 139 bp, Homo sapiens
tattcttcgaatgatgatgcgccaggattcaagaatacaccaacgaatgctcctgctactttagagtatacagcttcttataatgctaatcagaaatatgatgataaaaataaatggaatctcggaaccaaagttgtag

SEQ ID NO: 650057 - DNA, 380 bp, Homo sapiens
  misc_feature (44)..(44): n is a, c, g, or t
  misc_feature (46)..(46): n is a, c, g, or t
  misc_feature (54)..(54): n is a, c, g, or t
  misc_feature (56)..(56): n is a, c, g, or t
  misc_feature (58)..(58): n is a, c, g, or t
  misc_feature (171)..(171): n is a, c, g, or t
  misc_feature (221)..(221): n is a, c, g, or t
  misc_feature (380)..(380): n is a, c, g, or t
agatggccgcgctcctggccgcctagagccggagcgcccagcgnantgcggagnancnagtggtcggggcgctgtgcgcatgctggttccgcctggggggcccgcgcatcatcccgttggcccgactgtggtacagacctccatgagccggtcccaggtagccctgctggncatgagtctgctgctcatgctcctactgtatgtggggctgccaggccccntgagcagacttcctgcctctggggagaccccaatgtcacagtcctggctggtctcacccctggcaactcgcccatcttttaccgccaagtgctcccactcaaccaggcacacagggtggaggtggtgctgcttcatggaaagggctttaactctcacan

SEQ ID NO: 650058 - DNA, 1553 bp, Homo sapiens
  misc_feature (747)..(747): n is a, c, g, or t
tggagcacagggtacttaattggatggtacttgacaatgttgcgtgttccctagtgccccttccccttcttcagggggctctacatgtggcactgtgtgtgaggaggggagatctcaggtggtggtgggggactgagtgttgtggcagggactccccagcaggtgagggtctctctcttcctctgggtgctctgtgctggggcgctgggtgggtccagggggtctaacctcctttgagagggccattggtgtcgccatgtgaggtgtccacacacccttgtatgcgttgtacgccaaattctcggtgtgtcaataccaggagaacactgtgagcgtctttggaccacaagtgggggctctgtgagagtgtgcgcaattgccgcccagtgctctccaaggtgcgctccaacgtgtgttgtgagagtgagactgtgggtgtgtgtacgcgctgtgtgagagaagtgtccagagatgaggaaagaccacactcttagtgtgtgctctcccgaggttcttgtacaactcgccgagttgaatagttgtacctcctcttgttgacataggtgtggacgtccctctcccgcgagaccgccctcgtggagtttataaccacccaccacctcctctctcttgtagagcatttgatccctcaatcaccatactatattgggaggcacgaagagatataatacctcgtaaagaacaagcgtgcacgacagtgtggctccctagtcgttgctcctcccnccacacactttgtagaactccaccatgttttttgcagacacttgtgtgtggtgagaaacaccacgtggtgatcaagtgggcccatattagccgcacatgatacgaacggcttatccccccggtggtaccacaaaggcctccatcgggggagagttaagaaccttttttggcccccaaactgagagccctcttatgcgcggcaacagggctgacgccaaatgattacaagagacgcggcacattggttgagaatatcggaacttggttcactattatggagaggaacaaacatgcccccccctctcgtgttgtggcgcacaatacaacagggccaacacaaaaggttatattccgcagcagagagaacgggggtgaggcccaaattccccaacaacaaagagtccttactctataggaggaagctatgggagccaatgagacgataaatgtgcctgccttattatgcgaccccttcggtcggtgtgatcaaccaatgggacagtagtcacgtgattcacacagacagaatacccccaaaagaacatgtgtgcaacaatggtgcggctaatcaccaccctcttggggtcaccccacgcgagtgggatgattgtctcaacaacaagcccacgatcatcgagtgatgatcgtcgatccaaagatagaacgaatcaatagtggacggctaaattcgaaacatccatgctgaagagacgcaatcgagatggccaacaaccacctctctcctcaccaatgagttttaccacaacacaccacgcacgatgagatgctcacacacatgtagtcgc

SEQ ID NO: 650059 - DNA, 456 bp, Homo sapiens
  misc_feature (190)..(190): n is a, c, g, or t
  misc_feature (220)..(220): n is a, c, g, or t
gtttggcccacctgaaaggttgagtggcgaaaaattgggtcccccctttcccccttgcgttcaacaaccaagttcaccctgaaatgctggctgtactcaacccttttcaaattttttgtagatgtagcttaaggacgtgagttatttttccgcagactgtccaagagccaggtttctaaacttggacctnaggtagaaagcttcccatcgggggccctanctcaaccccaccaggccctctgttgggcctgcacacaactctgtggctagaacactccgaggcccttcggtacccatcagagtgggccccttgccaggtggcttttcagttacagagtccagtgggccattttgtagaaccattcagccccctccgggaggtggggtagggtgggaaagaggaacaggtctgggggtttgtggaacccagtccccttcagaatctgtaaaacctaa

SEQ ID NO: 650060 - DNA, 337 bp, Homo sapiens
gagtttgcattagataaaagtatcatgtccatgattaatttctgtatcgatagtcgtactgtgcttatgagaagagaatgttcggccagacatggtgacccacgcctggactcccagcactttgggaggctgcggcaggtggatcacctgaggtcaggagttcaaagaccagccagcccaccatggtgaaaccccatctctactaaaggatacaaaaatgagccaggcatggtggtccatgcctgtaatcccagctactccggcggctgaggcaggagaatcatttgaacccaggaggcagaggttgcagtgagccaacattgccccgggccgaatt

SEQ ID NO: 650061 - DNA, 221 bp, Homo sapiens
aactactgtatttccatgtcagctggggctctcagccgcccaaggcgaggacagcagaggtcagctgcagaggaaggctggcaccagccaccaatcccaaccccacctccaggctaatgcatgcccctggcacgggctcagtcccagcaccaccctgcaggctccagcaaggagcgtggtgtcccctgtcactccttacagctcatacttaggcctctagc

SEQ ID NO: 650062 - DNA, 1085 bp, Homo sapiens
  misc_feature (745)..(745): n is a, c, g, or t
tgacaacagggtctcgctccatcaccccaggctggagtgcaggggtgcagatctcagctcgcgtgcaggcattgaccttcccgggcccaagttgactcctccgtgccgtggacctcccaaaagtgtgttgggatttacagggcattgagccactgtgcattccagcttgtggttcataatttttccatacccaggggtggttttaaaccttagtttctctccagcttaagttaaaagtggtgcccaaagtggaaacacgatcttaaactctctcgtgcagcccatttctttcacgtggtgctctttgtggtgttgtgaccaaaaccttctataaatctttcacagtgtgtctttgtggtgttgtgaccaacacctataaccctttcacagtggtcttttgtgtggtgtgacaacaaccttctataaccctttcacagtgcgtccttggggtggtgtaacacaaacctctcttcccagtggggtgtgggtgcattctgtgacccctatattcgcccacaacaatgtgtccttataagagaaaggctctcaactctttccttttgaacctgtgttctgtgcccaattcccccttctcccaaaacaacataaagtggggagagggcactcgtggacattattcgcatccaaaaggatgtgtgaggggctctccccccctactcccccaaggtgttccttcacagagtgatttcccacatagtgggctctaagacagaatacagaattncttaggcttgaacgaaaggggcacaaagagaagctacacttccgtggacacacccgtgttaaaaacgccaaacagggcctgggtggcgatttaggaacagggggggacaaacgccgcggactagaataaaggggccagaagtagagtaaacgcccccacaaggggaggcgcccccgagaaagcccacatagttccccctaatggattaaggggcaccccgctgggcgaagcacagagggcacacagcggggtgtacacacgtgactacaacaaccccagaatagctcaaaacaccggcacgacacatacagcgacatacaacccgggagaagacaacaca

SEQ ID NO: 650063 - DNA, 805 bp, Homo sapiens
  misc_feature (193)..(194): n is a, c, g, or t
  misc_feature (202)..(202): n is a, c, g, or t
  misc_feature (289)..(289): n is a, c, g, or t
  misc_feature (291)..(292): n is a, c, g, or t
  misc_feature (296)..(296): n is a, c, g, or t
  misc_feature (318)..(318): n is a, c, g, or t
  misc_feature (357)..(357): n is a, c, g, or t
  misc_feature (387)..(387): n is a, c, g, or t
aatcttgtggcggccctcacgatggtccttccacaggacctttacctcgcccgcttggggtcgtcttcggttttccgggagccttgcaaggtcctggctcgctttgacgtctgccctctgggaggcacaaacctttcctaggaacgaggaacctgtccttgacgattgccggctgtgcccctcagtccctccnngacctttntcgttgggacatggtctgttgctggaagacaatcatagccccgggggccgacccggactccactcctgatacccgagctcctgtcancnntcgngagctcttgtgaaataaaagcngggttggcctcagccttgggtctgtctcatgctctcccngttcctctccccgccaccccagggcctccnagccacctctggaaatacttggctctgcccccatgggcaccgggaggggcgcccacgtggagctgtggaattgggccccgtggcagagcccccatcccttgggggcttgtggggatgcgcccaagcccccgagggagaggcctggggacaccaacaaatctaagccctccctagctgcttggtaactgtgtcatgaagctgccggacagacacacgtggcatctccctgggcaaggagagcaggcctgcagcaatgggtcctgttcccgtgtgccgctgggtggcaatggctgcacctggcactagggctgctctgtggatgtgggtgacaacggcaaggaggggatgctggccttcctgcacatagacctgccgttagtaaatcataagccccaattaaccggttgtttgaatatta

SEQ ID NO: 650064 - DNA, 237 bp, Homo sapiens
tggacagaggagccgagatcagtctctctgcgcctcccatgcttccccccttgaatggagctgcgtacaggagctgcctacagtgccccgggcatggcaggtttagtgttgcctgacttcagatatggcctatagtgggggctgaatgtatgggcctcgtggcttgcccaccaaatggatgaatccaacagctacgcatctgctgagctcatgggccagacccacgatcagtccttg

SEQ ID NO: 650065 - DNA, 135 bp, Homo sapiens
tgcctggcacggacgcagctccctgctcgtccggggtgtgatcccaccggaggtaggcaatgtggctgtgagtgtgggtgagtgactggagagacggtgggccaccagcattctcccatcacacgtgttaggaca

SEQ ID NO: 650066 - DNA, 854 bp, Homo sapiens
gcacagacccgtgcccgtcgtccgtgagcctcccgagagccgtcccttcgtccggccctggagcattgctgtatgtcgccggtgtcgcagtgctgaggattggcgccgcgggtgtacgcggctctctgcgcaggcctgagtgggcccagagaacgcgaggaactccgtagactcgtcgacacgtctcgtactcctgtcccaatatcagggcttgtgtgaggtgactcgcgagtctgctggagtgactcgcgcggacaggacacgtgctcatggaacgccatgtgagacgccatccacactgtcagacgtcatgatccgactatccagccgaaatcgtccatcgtgagcgaggatcctgacacatcagtattgcgcggacatggacggcacagcggagaagccacagtgccctgcagaacgaaggcttgacacaggtccacaagaatagatttgccccgcggtccacggagcttttttcaagagttcccgagagaccagtcagcgaagcattccttgacagatgacatcgaatatatgcctcgtactccagttttcagcagtcttcaacacaacgtaaaggcgagggacaggcagagtctatccccaaagtcccatatggatatatgggggacagcagttgatagaaagcctatccggcgtagttaggttcgttatgcggcgggaacatggcacaccagttcgacctggagaagtgcaacactcagccgacatatcacaataccatgggagcaggcagttttcagtgagtagccagcagatagcattggcggaaccattatgcacagttagcaacgcagaggggggatcacaacagagcctacaaataccaccaa

SEQ ID NO: 650067 - DNA, 1228 bp, Homo sapiens
ctccctcaagtttcacttctgtgaagttggaacgctgacgtttgttcctgaaagtatctgaagagagagtatgcataattgagctctgtatcccacgtgtttgtactgtatttatcaagaattcatcagtacagaatcgatcgacttgagtatggtcgcgacatgtcccacaggagctatgagccaaaaaacagtttcaagaggacatgtgatcgtagatggcgtccagtaccgtaccccagcgcgtgaatgaacgagtcttagacatgaatgatcgtcaaaccgtatcgcgtatgtaagcaaattgacatcaatgcgtgcactcgcctgcaatgctgctttgattgaagaaggaactccatcgatagaatagcgcagagtcgtgtggttgtacagtcgtaggcgagattggtggaaattcgttgctacataatagtaagtattgctagtttagcgagtttatgaatatcttctcagagtgaagatggtatcgtagcagggacttcagaagcacctatttccacgttggccttacctattcctcatgcgtcatatgtttctggacgagcttcattagggagggacttggagtagtaagtgtaacggagcgtacgaagacattctgagtggaactagaatacagagtttggtacccaacagacatcccaacattacgcaggaacaggcgtcacaagatgctgactcaaataaaagcttctgtggatggctcgttttatgcacaaggaaaaagaaacagtgataggcaaaaattgtgggacttcagggaaaacagaagttctggacaaatactaaaataggtactgggttgttggaactattgacaccattccgaatattattcggaggatgacaaaaagtcagggaaaggacttaaaaaagcttagtcgacaaatggggccacacatagaccctcagggtgaactcgggaaacgcgggacgacagggggcacgacagagggaaacgcgcacaggcaatgcacacaaccagtggggcagaacgcgggggccacatcacgcgaacacgggaccgcttcaaaggcacgaataacagggggcgccacatatgggaggcgaacaactgtaagccccgcgtgagaacaatgatataaccatgcaacgggtccagcataaaaaacacgcagcacgacacaggggcgggcgacaagaaggggacaacaggagatgttagacccacccaaagaggtaa

SEQ ID NO: 650068 - DNA, 565 bp, Homo sapiens
tgtcgatctagaggtccccctcggtctaccttgttctgataacatcttatcaggagacagggttggagagtagaaaacgggtcggactgaaatttactaggcaggaatttcctcgtcctaataggccggggagcactatgggagaccggggcttatttcgtcccttatctgcgactgtataagacagacattcccagagtggccatttcagagacctccccctaggaaagcattctctttctcagggctgttccttgctgagaaaaagaattcatcaatatttctcctattggctttggtaagaagagaaatatggctctgttccgcccggctctcaggcagtcagacctgatggtcagctcccttgtgtcctgaacattactgttatccggttctttttttcaaggtgcccagatttcatattgtttaaacacacatgctttacaaacaattggtgcagttaacgcaatcatcacagggtgctgaggcgacatacattctcagcttactaagatgacaggattaagagattaaagtaaagacaaggtagagccgaggggtaccg

SEQ ID NO: 650069 - DNA, 128 bp, Homo sapiens
ttgaggatccccttatgtctgacccaccggcacttcaggagcttgataactagagaggcattgcaacgcacgagtggggaaactgattgcccaggcatgagggctgcttgccaaggtcagaacataag

SEQ ID NO: 650070 - DNA, 634 bp, Homo sapiens
ggtctggtctcttgctgtcaacagtgttgggacggaacagatccggtggactctcttaccagctctcacgagccgccctcgcgatttcgcatcatccgtcttgcaatgcatccggagaccatcttctcgtgccatctcctgctttctgggacctggccagcagcgatgtgttgtggttgagctccctgtcttgcccaatcaaaccatggagcgtcccagaattcgtgcagaattattgcaccgaacgttgagaggcagaccgatcaaacaggcctggtcaaattatgtagcctgcgaggtcgccatccatacagcctatcgcgtcgtctcatggagcttctagttatcagatccggcgactgatgtgagctcgtcggaaggcgtgagcctacgttctctccgcgagatggacgaggagaagcgctgatgggctacgagcgtcctccgtgatagatgcaaagaccagtcgtgtgacggccgtcgctctcttccaggacatcaagaagccagcggaatgatgagtggggtaaaacccagaggccatgaaagctgccatggccgtggagaaaaagctgaaccaggcctgatggatcttcatgccctgggttcttgccgaagggaaccccatatctgt

SEQ ID NO: 650071 - DNA, 1087 bp, Homo sapiens
  misc_feature (457)..(457): n is a, c, g, or t
tacgtcgtactgcagtgctattccgtcgacagtacctgttggttctctggaggcgaatgtgcggcttcatctcttgctacccctgtacatcgaaaaagcaggtgtcaaatgtctattacttgcgcaaccgccattcgaagacatcgatatgcctagtggactcaagacgtagaatcagtggatcgaaagacgtagttcagatgactcagttgagttggaaacgctggaatgggtgtattgcatagttgatcggggcatggatcgcgtattgcgacggtatgcgacctcctaaattagttccgtagcaaggttctctggatgtcttggctaggaaatgcaagggatcgagtcgaagtaatccaaatccattgagttggcatccccgtcgtgaggacgcggaatagaccttattagagtccaaacaaagcagtcgttgcctgtcacaattggtatgtantcactacttggggtctccataaagtctggttgattggggaagagacttgcatacgcaagcatacgtgagcgacaacgacatactatgacatggaaaaaggaaaaaatttgttgaaattgcacgagggtacgtattaacatgggacattcggaagaccatcgatggaccacgagtggactcggcgtaggagaaggtaggtggcataggaatggggacccgtatggtaaatgaagggacatgatggtaatgaagggcgaagaaagaaagaattgtaggtaaatggcacaaaaattggtaaggttagtaccccatagaatctgagaatctatcccacacattgtaatgcctgcggtctacctgcctgggacagtctccaaattgtgaatacctatgtcttcattgcaagtccccatgttatgtaaagtaagatactagtaaagtacactcgtaggcttgctaccaaacatttggccttggaattgcttgggtatgggtttccccttgccaaaaagttgcgaaaacccaaaaaaggattgtacttggggcaacagtgggagttaccttactggatttagcctaaggttggccccaaaacaaataaggtagattaaggccatgaaaattttgtcc

SEQ ID NO: 650072 - DNA, 141 bp, Homo sapiens
ctcttcttctgttgagcatttttggcaagcaagcgtgtgcttgtcatcattccctgttatccatctctgaaatggtgacagccagaatccggctagaacattagtcgagctgcttcgctgctccgaatattggatactaag

SEQ ID NO: 650073 - DNA, 263 bp, Homo sapiens
  misc_feature (38)..(38): n is a, c, g, or t
  misc_feature (46)..(46): n is a, c, g, or t
  misc_feature (147)..(147): n is a, c, g, or t
cacaccccagcaccagcagcaactcttcctcaagcagnaacagcancagcaacagccaccgccagcacagcagcagccggcaggacgttttaccagcagcagcaggcccagtccttatccaagtattcccgtcactatagcccagangacgagccaagtccagaagcccagcccattgctgcctacaaaattgtttcacaaaccaacaagcagtcgatagctgggtctgtttctatcacatcccttttcctccagggactacg

SEQ ID NO: 650074 - DNA, 205 bp, Homo sapiens
agtgactgtccccagtgcttcataatccgcatgcatggatgtgtgctggtcccggtggaccctgggatttttgtttgccccttggagcaggtgtggagtgtcactgtctgtcatcatagaggggtagtcagaaacgggcgggtccgccagccaggtgctgttgtgcttaatttgacaataaagttgttctccccccgtaaagaga

SEQ ID NO: 650075 - DNA, 363 bp, Homo sapiens
cgtctacgctgaactatgtgtgtgtgtgtgtgtgtgtgtttgagatggagtctcgctctgtcgcccaagctggagtgcagtggtgcaatcttggttcactgcaacctccgcctcctgggctcaagcaattctcctgcctcagcctcctgagcagctgggattataggtgagcgccaccacgcccagctaatttttatattttcagcagagatggggtttcaccatgttggccaggctggtttcgaactcctgacctcgtaatccgccctgcctcggcctcccaaagtgccggatttacagacgtgaaccaccgtgcaccacccagttgctttacttatctgtgtcacatagttcagcgtctga

SEQ ID NO: 650076 - DNA, 294 bp, Homo sapiens
cgacagagctaagtcttattgagactaatctatatattgacatacttctatttaagaactaccagactacaaccaacaaatgtctacactatgcagcaaatgagagaaatcatgatctacggatactcatcccactgacatgagcacatcatgtacaaatgcattgtaaacttacaaaataagttacacaatttctgcaagcctctcactatacaaactcaaaatccttctttattttagtacacagtggatctggtctctgatcacccagcactggtagttacatgtgacaca

SEQ ID NO: 650077 - DNA, 397 bp, Homo sapiens
aatagacgaaatcatttgccacaacacagatgaactggaggctattaagtgaagcaactcagaaacagaaagtcaaatattgcattatattagtctgttctcatactgttaataaagacatacctgagactgggtcatttataaaggaagcgggcttatttgactcacagtttagcatggctgaggggaccttaagaaacctgcaattatggcagaaggggaagcaaacacgtccttcttcacatggcagcagcaaggagaagtgctgagcaaagcgggagaagccttttataagaccattagatctcgtgagaactcactcactatcacagaacagcatgggggtaatcgcccccacgattcaataacctcccacaacatggcttcatagtgaagt

SEQ ID NO: 650078 - DNA, 142 bp, Homo sapiens
actcactcttgtcagcagttgtatatctgggcagggtggcggagagaaggctcaataatgccacctcgaggcgcaacaccaggtgcagggtggagtctttctggatgttgtcgtctgagagagtgcggccatcctccagctg

SEQ ID NO: 650079 - DNA, 584 bp, Homo sapiens
cggtgacataagtgcgtatggacttctcacctaatgaccgaatgatccggaggtaatccgagtcgttgtgaacaacttcgatgatggagtcctggggtcatgtagctggactctatcaatcaggtagttcgcaggcgagctcggagatcgaccttatgccccgaggctgaagaatggatccccttccttaacaccttatacaaacaatttaaattccaaatggattacaaggacttaccatgttaggacctaaaaccataaaaaaactagaagaaaaactagggcaataccattcaggacataggcatgggcaaggacttcattgtctaaaaacacaaaaagcaaatggcaacaaaagctaaaattgaacaagtgggatctaattaaaataaagagcttctgcagcagcaaaagaaaccaccatcagagaacagggcaacctacagaatgggagaaaattttgggcaacctactcatctgacaaaagggttaactattgcagaatctacaatgaatcacaacaaattataagaacacgaaaaaaaaacacacccatccacaaaagtggcgtgcacggcatatga

SEQ ID NO: 650080 - DNA, 572 bp, Homo sapiens
cactatttgtgcaagtcagtgtttttgacaattcagtgtcgcaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggaggtaactgttcagctggttatctactcttcaggtgtttggacgaaacacacaaataatgttatgaggaaaaagcaaatattctctccgtgagatattgtacagtgtctgctgtagtgctcagaataatgcaagagtgtagtcccatatagcggtgtagtatatagcattatttatttgaggtctcatagcacattgttaatattcattctcaatgtgacttcgtcacatattcgtttttcctttcgcacttatgatacaagattaaagagcattttgtaaatgcttaaaaaacacaaacaaaaagaa

SEQ ID NO: 650081 - DNA, 416 bp, Homo sapiens
ctacagttttactgtaagataagagtgtgtgtgtgtgtgtgtgtctgtgtgtgtgtgtgtgtgtgtgtgtgtgtgtatatatctatattataaaagacttctctccatgtggcggtatccactctcagttccaggcgttaaatacagacgtattttcaaaaatatatatttatttctacaagcatctgcgatgcgtgtccattatcccactctgggtgtttgtttcgtgaatgatatctattatgccatcgtgtagagtcttcctgaataattgcatcctcccgctgtgagcgaggtaccacaggagaatttgtgagcagaaaaatctgtgtgcttctttaagataacttcaagagtcgcagagccacacagtgtgtagacatatttcttctgcgctcagggaattggggctataa

SEQ ID NO: 650082 - DNA, 288 bp, Homo sapiens
taatttgatttcccttttaagggggggtttgggcagctggggtccccgattttggctgtcctatgtccaggaaaaagcccctttgttgggggtgcccttcctgtttatacacccccccagcccagcaaaagcctttcttgaaccaaacaaacctgttggttgggagactgcccaaacatgatttatgaggggttcccgcctgctgtcccccccctgatcccccagctaacgagggggcccccagcatttcctgatttcctttggggtaataaaagctttttgggctta

SEQ ID NO: 650083 - DNA, 470 bp, Homo sapiens
ctgctcccttcttggaaagatgcaaagtgctttagtaggctcctgggtaagagtgcactttatgttaatcctgcccctggccctctggttgtacctgaaatctgactgagtcatgccggtgaagtgaaaaggttttcatttggcatccaacctggaataggaccctgagccgcccacttcctctccaccatcttgaggtcacccctggaggctgcctagtcttcctaacactttgcccccttccatgcatcatggtctcctgaaagccagtggaaactcctagtcctctagccaccccatttattcctagttaattgtttgagcctcccaagcttttggagtttggctgctctctagtctgggaacattttgagggcaaagattgtgtttttgtccatctgtatttcccatgctcagccccatgcctggaagacaataaaggtctgataaatactgttgagctaaaaaaa

SEQ ID NO: 650084 - DNA, 813 bp, Homo sapiens
atgccaggctggtacggtccgagtttttagatcgccagcgcatgtgttggactggtgctgtgcggactagtgcacagagctgcgggagcaggcacatgggagtgtggagcctggtggctgggacgtgcgggatccggtggtgagccggagtccctgcctgagtgggggctggaggtggatgtgtggcccggctgatgccgcgatgaagcctgagcggcgagtgaccaggcggctgctggctgtgcctggcccctgggaggagtgcttccaggcggcctgtgcagctggcgctgcgggcaggacagatcatcagaaaagcccttactgaggaaaaactgtgtctcaacaaaaacatcagctgcagatcttgtgacagcaaacagatcaccttgtggaagatttaagttattttctgaggttgcgagagacggttccttcacacaggtctcctttttctctagtacacatgtgaacccggcacaggagactgggatagagaacctctcgggcaaggccacatagtcattgcagcaggaacagatgtttgcttagcgccttgcccaagggcctcagcccttagttgaaccttggggacagtccaggagtgtcgcaaaggcactgccctgaatggcttaggatctaggtctgacttggatccttgagaagtgcctttgtgaaggttgtaaacagcgggcaagctccacatgggacccatgcctgcagcaagggttcattgcgagagggaggacggcggattcatggggccaaagtgtgtgctcaccccagaggcccgagcgtggatcatcgaacccc

SEQ ID NO: 650085 - DNA, 902 bp, Homo sapiens
ttggcaaaccattttcccttggtgaaagtaatattagagcctcgttggatgtatcttctcctggtccattcatgcttgagcggacctttttgaaccgggaagaccggttcgcctgttttggggcctcctatccgcgtagggaaactaacggggcgcttttgctccttgggtaccaatcccccttgcacttgcatagcgaccctggcgagccgctccagcgcaaaaacgctctcggaggctatggctgggacagggtaactatgctggccagaggcctgcgaatggtgactggtggtcggcgtgcgaatcgtctctacgccaagacacgccatggcaggaaatccttgacgacgagaacgcattgaaagctagatggcgcgaagcttggagctgggacaagactgctcggaggcactaggcaccagtcctagcgggctagcccgtcaggggaccgaggagacagggccccgagaaggagcatcgcacaggaagacacctaggctcgagcacgcaggacaacgtgtgcagcatcggtgtccggcgtgtcgaggccaccagtcaatcatacgtgtgacaagaacgttcgtgcagcgccacgctgctaggacctgccgtggacccagggctgagcagtgctataggcaccagtgacatggtgagcacaggcatagggccagcagtcatcgtccaggctacgacgtgtcaagtcggcttatgctacaacggagcgcatggagcgcgcggtctgcagagaggagccagaaggccaccccgcaagtgcctgtcctgcgggggcccccggcatcctgcacacagggtcgcagtcaccgcacagtgaagcctgagcctgtgacaggaacggaagggtgtaggggtcagacagggactggtgcaaatggtac

SEQ ID NO: 650086 - DNA, 219 bp, Homo sapiens
gatccccttacacggctacgccactgcactctgtcctaaacatatcttttattaattagttttcactttatttattttaatcttcttagttagtatattcttgaaaatcgttgacaatagaattgtttatgttctctactattgtcgatagactcaaagttttcagatgacaatcttgtccttgttggcatctcagtttagtccctcaatatgctagaa

SEQ ID NO: 650087 - DNA, 849 bp, Homo sapiens
tgggcacgtattctctttccccaggatgtaccttgcctgagatataaggattcagcggacatttctcccatttgcttactgaaagaagtagaaatatggctgctgttccgcctggctcaccggaggtcagagtttacggttatctctctctgtttcctaaacattgctgggtatcctgttctgtttcaaggtgcccagatttcatattgtctacgacacacatgctgtacaattcgtgcagttaacgcaattatcacagggtcctgaggcgacgtacatcctcctcggtttacgtagatgactaggattaagagattaaagtaaagacaggccataggaaatcacaagggtattgactggggaagtgataagtgtccatgaaatcttcacaatttatgtgttagagattgcagtaaagacaggcataagaaattataaaagtattaatttggggaactaataaatgtccatgaaatcttcaacaatccacgttcttctgtcatggcttcagccggtccctccgtttggggtcactgacattcccgcgaacacgaagaattatactggtattggaatctagtgtccgcacgcaaatcgtcaatggtcaggttgtaatcatgcaatgattggaggaaggggcctggtgggaggtgactggatcatggaggtagggtttctgatgaatgtgtagcaccacctctcttgccgtgagttatgagatgtggtcattttagaaagtgtgtagcacctccccgtttgccgtctagctgcgtgctcccaccatgtgagatacttgctccccgcttcacattctgcgagtgattgtaagcttcctgaggcctcccatat

SEQ ID NO: 650088 - DNA, 374 bp, Homo sapiens
cccaggagttcaaggtcagtctgggcaacatggtaagatgttgctgagagattttgtcaccaccaggcctgccctacaagagctcctgaaggaagcactacacatggaaaggaacaaccagtaccagccactgcaaaaacatgccaaaatgtaaagaccatcgatgctaagaagaaactgcatcaactaacgagcaaaataaccagctaacatcacaatgacaggatcaacttcacgcataacaatattaaccttaaatgtaaatgagctaaatgctccaattaaaagacacagactgccaaattggataaagagtcaagacccatcagtgtgctatattcagcagacccatctcacgtgcagagacacacata

SEQ ID NO: 650089 - DNA, 426 bp, Homo sapiens
catcgagctcggcccgccgtgtcaatatactctctgtacggacttgagtgttcgcacgtaaggccgctgtgtttattataccaattgctcctagaaggatcctacattagaactctgtacctagcagacaatgcagacttgaatttggacgatgatattctctatcaagtgaggcatctagcatatattacttcaataatagtttcaaaactgtttcaactccctattactagtaaatacttataaggtctttataagtacaaatacttataaggtctttgtaagtacaaatacttataaggtctttgtaagtataaatacttataaggtctttgtaagtataaatacttataagatctttgtaagtacaaatacttataaggtaacttacaatgttattaggtaaccttaactgaatacttactc

SEQ ID NO: 650090 - DNA, 152 bp, Homo sapiens
cctgcctgaaacgctaaagctgccttgtgaacaaactgggaaactagtttagaaaagtgatacggaattgtgaaaaaaagctcagacttgatgctctgtaaccacatgagtgtcttcttttttatttagtaatacgctgctggaaatgcgga

SEQ ID NO: 650091 - DNA, 810 bp, Homo sapiens
attatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctgggtggagctccagggctggggaacgtccgcaagtcaatgctcagagatgcccggagctgcctcttagactcgtctggcccatctacctgctgacagagcatgacaaagatgacgctcaaaagtaatgccattacttctttttttttttttttttttttttgagatggagtcttactctgtcacccaggctggagtgcagtggcgtgatcttggctcactgcaacctccaccttcccgggttcaagcaattctcctgcctcagcctcctgagcagctgggactacaggcgcctggcatcatgcctggctaatttttggatttttagaagagacgggtgtttaacaatattggccaggctgggctaaaactccaaccttgcgattcgccccccttggcctcccaaaggctgggattccaggcggtgacccctggccccggccgaatggcttttttttaaatgggtcaaaagaaccccaaaaatttttttctaccttggaaaaattttttaaaccgaaatttccctgtggaaaaaaaaggtggttggacacaaaaaaaaaattcgggtggcggcctttccttatagg

SEQ ID NO: 650092 - DNA, 1366 bp, Homo sapiens
  misc_feature (237)..(237): n is a, c, g, or t
  misc_feature (671)..(671): n is a, c, g, or t
  misc_feature (687)..(687): n is a, c, g, or t
  misc_feature (1304)..(1304): n is a, c, g, or t
aattcagtgaagctcatctaggcgaaaataaggcttgtggttaccaggcaaagacgagaatagacctatcgtaagacttgtaatttattgtaaagcactagatgaatctggccataactcgttagtgtacctcaacatgtagtcacacagcatgccggtgttcatagactttcaggtgttagggcgctacagcagtcagtgtatgactaggaatcctcaatctcttcacgtaggacnagcctcctggtgtctgaacggaccaatcacgacccgagtgtcgcggaaggcagcaaaggctagctctatgtaattatcccaatgtattgaactcgcgacaagtacccacgttggacaagtcgcgcacgggggtatatggataagggtgcaggctcggcttgatttgggatgagtataggccatgtttggctcatggtacacctaattatccttaacgagaggtgacgccaggttatcgtatatctataatcctgcgtgaatattgtgctgtccatactgttcagggaatgtgtctcgcggcactccgtacggaggacacaagtcacactcacaattgggactgtgcttagtgcgccgagcttatggacactccatacagagtctagtctggggtggatgtgtactcttataactgtcgatttacataatcagtnatcgccattcgacggncattctcaggccatggcagagattgtcacaaaagcaacatctgttgacagtttacaacgttggcccaaagaaggtccaggcgatattatcctttgagtatcgtttaccctatttcaagactattcattcaccttcctcgcctagaattatctggagaacagtgtatcggttggtatggcaagtcttagacttgttcacgtccgtaaacatcggtatagagaacaggccggttatcccacacacacgataaagacatcggaatacatacacattctttcgcaaagcacttaagttcgcagacaaccagaacgtgtggagggagaggcgcccgcgagtaaacactccacgaatttgcggggccgggaaccaagggtagaacgtccagtaatattcgcccatatttacggatgaggatcaggtcggtatcctaaccatcaccgtagagacaggccttgttggacacaaccccctgtggcgggtatccgggaacaatatcttcttggcgtttgaagcacatacaccctcgtatttggccaaagactattcgctcctattagcgcaacaatgggcgcggaaccatagttacagccatgctcctaacagaaatgagcacgttntcaacagtatgtaagggcagccaatatataggagaatgtcaacttatgggccatcatctttg

SEQ ID NO: 650093 - DNA, 328 bp, Homo sapiens
cctggtgtaatctagaggatccctagcgacgtttgcaatgacaacaacgaccttcgactcttcctgccacttctttgccacaaagtccacctggagggcaccaagaagggccacaagctccagctggactacatcgggccttgcacatccatccccccttgcttggactctgagctgaccgaataccccctgcgcatgcggaacctggctctaagaacgtcctggtcacccgtgtaatgagagggatgaggacaacaaaccttctgactgagaagcaaaaagctgcggggtgaagaagactccatgagaattgagaaggcggcctgga

SEQ ID NO: 650094 - DNA, 987 bp, Homo sapiens
tgcaagaggagacctcacattcaggagtggcctatgaagtaatccatgctgtaacatctggccattacacgagtcccagcatggtcggattgttttggtatttaaggaattagattctgccccaaaagctcttgtcaacatagcctcgttgcacccatcactttgaaacgtccatgtcgatggtgttgaataaccatagactgtcgttgatcatacctggacatcctagttgatatctgtgaactggtataacatgcgtacggacttaaaaagaaaaaccgcgtgtactgtgattccatatgtcaacccgagaaaggtctgcaaggaattcggaggcgaacgaactacgccgtcctctggcacacaagggccggactactcagcagcacggccgtcggactacgccctccggcggggcattcttctcaaagacggaaagccaatttccgcgtgtgagatatctcacacatccaacgtggctgtttaaacacattttctcctgcacactacagcggctcctacatgcctttgggccacacgcgcattagtatgctgtcacccaatatacccctcggggccccactctcttcgcctaattctctagcacgtcattgcggcgcgcctctccatcccgaaactgtcgcccggtcttcgcaggtcccgcagcctccggcgagtatcacctcctcttccccgaccttggcctctccctctcaaccacctggtgtgcctgcgacggcgtcccctctgctcgcccgctaagtgggcaaacctcgatgttcgcgccagcccttctccaccgtgcgcgcgcgccgcttacccgcccggcatccgggcgcttcgggatcgctcgtaacactctcctcaccacagcccccatcacggctttctccaagggccagccgcctgacccttcttttcgtcagtttccacgcccactttgcgtcggccccagcgcactccgcgcgacatttaccgtgttgtatc

SEQ ID NO: 650095 - DNA, 148 bp, Homo sapiens
taagttcccagccgctacagcgcggtgatgacccagcggcgaacgcgtgatctgcgtgtccaacagcgtgcgcgagtacgtgcagcggcactatccgagcgtgccggaacagacgctgcaggtcattcccacgtggcgtcgatgtcgg

SEQ ID NO: 650096 - DNA, 299 bp, Homo sapiens
acgtgcattgtgtactcagcggaaaggcagctcctgggctcggaagacccagactccagaaatggagctgctattgtagggtccaaacaggatgacactggtgaaggcattcttcctcagcttgtccagtcgctggcaccttcccgtgatgagattgcagctcatgaaggtctgagtgagttcttcagggaaagcgatactctgagtaccacagggaccagccgtccttatcaaagtgctcccagaaatactggaagtgccacagagagtgtgtgctcataggcgtacatgcgctagaa

SEQ ID NO: 650097 - DNA, 345 bp, Homo sapiens
tacttcctttcttcctagcttcctacaccaaatcgcactgtctcctaggactcttttcctatcttcaccacgaactgctgctagctcgcttgctccctcagtcctagctttatcatatatagagtacctgtaatcctgtctgctgttgtcttcctatatacactgaatccacttctgtgtagcacctgggtcagctgtcaattaatgctagtcctcaggaattaaaaaataatcttaactcaaagtccaatgcaaaaaggattaagtccggtaattactcttgatcttgaattacttccgttacgaaagtccttcacatttttcaaactaagctactatatttaa

SEQ ID NO: 650098 - DNA, 205 bp, Homo sapiens
attcaatttgcggagccatctgcatgttcatgttggtgaaatgccttttcatattatttgcccagttttaactctggggtgttcatctatattgatttgctaaagctctttgtctattatagtgtaaccaatctttggtccttcatttgaattattttttttcaatttttcatctattcttttacttctacagaaacttttgccc

SEQ ID NO: 650099 - DNA, 399 bp, Homo sapiens
attcatatgtgtcaactggacgtaccttacaactcaggtgattttagcttataggagagggggtgatctaaaacactctattacgccggcatctatagactcgggttactcgtgtgaccgcggtggctggcacgaaattgaccaaccctggggttagtatagcttagttaaactttcgtatattgctcaaggttaatccactgctgtttcccgatgtgggtgtggctcaggctcaagcgtaacgcagctgcattgctgcgtgcttgatgcttgtcccattttgcatcgtggtgcatttcagagggtgaactcactggcaacggggatgcttgcatgtgtaatcttcactaagcagctaatcagaaaggctaggaccaaacctatacaaatgactacaaa

SEQ ID NO: 650100 - DNA, 129 bp, Homo sapiens
ttagtaactgtgtgggataaagaattccctcctgtaatggggggcttccctcagtcagcccagactgggggtcgtcaacagacctgcgtgactgctgtgctcgccacaggcctgcttcactcacagcca

SEQ ID NO: 650101 - DNA, 248 bp, Homo sapiens
ccagattgtatgtgtcagtggagtgagtggtattacaggggcgaaccaatatgatcagacgggaagtttgactggtcgtttcgaactgggcggtcacccttcttaagaactggtggtccccggtccgggaggcaccatattgatggcgaacttagtggggacacccgatcgggatagcggactacaggccagaactcctgggctcaagggaatcttccatcttagtcttccgagtcgtgggcccgaaa

SEQ ID NO: 650102 - DNA, 104 bp, Homo sapiens
cgtaacgcagcgccccagtggtggtggtggtggtaacatcatgtagagggagtatcgggctgttacggcggcgctgttacggacgtgtaggagggctcgttacg

SEQ ID NO: 650103 - DNA, 277 bp, Homo sapiens
tgatgttatcccaacacattgatatctagcctgaaaactaagtaatgatgcttattaatataacaaaacaatcattggtcatcggctagatggaaccttatggatatgagaaaatcatggaaaatctgagagctaggggccctggaaggacccagtgctgtgaacaacatggagcttaatgaggtcatgggtcctaacaaaaagaggaaagctctggaagtgctggttttaataaccctagagccttgttcctttctgggaattcttcgtgtccccc

SEQ ID NO: 650104 - DNA, 336 bp, Homo sapiens
gctgcaatcatctcctggatctgggtgccagctgcatgcgaagcgagctttggtctcctccatggctggactccatgtgatgctctcatgctgagcttggtgactgcagctcattctccagtgttctgcatggtgcgccagagctccgagatctctgctcttgctgctctgcccctgctcgctgtgggagcgccacctcgctggccagctcctctgtcttggagacgaaccattcctcggcatcctatgcggttcttctctgcaaatcttctcatacttggtcacgcatctcgtacagaatgcggatcagttccacgccaggtgcacgcaccacaa

SEQ ID NO: 650105 - DNA, 162 bp, Homo sapiens
  misc_feature (28)..(28): n is a, c, g, or t
  misc_feature (81)..(81): n is a, c, g, or t
  misc_feature (117)..(117): n is a, c, g, or t
  misc_feature (126)..(126): n is a, c, g, or t
atggagctgctgacgctgacgtttggcngcgacggagctctgacgcgcatgatgacgcatcttcaccaaggccgccctgangacgtttgcggggcatactgctgtgctgccctaagnctaccaggncgctgtcgggcactacgggtggttgacacccaccca

SEQ ID NO: 650106 - DNA, 605 bp, Homo sapiens
  misc_feature (29)..(29): n is a, c, g, or t
tttactaattgttatgagttagtgcaacntggttatattctgcacagatcttacgaacttatcatgtcattgtcacaggtactattttgcattccatattcggatgtgacaatcgtgtgaataggatcatggccaggatctattccatcttaggcatctcgagcatacccactagtgaagtaggcatatgttaggcgggtacttgccagcttttgcctcccaccttgttcatggcatagtctgcagtactggttctcgcattccagtcttgcagttctggtcttgatgcataccggatggcattttgtgtgtttttctaatggatcttatattttaagagccttaattctgttgtgccagtaccttttcatatgtaccaatcgttctttatgttgaataaagtttttctttataagcacgcagccaaccagtctcttctgatgctcagtccatgggtgtccagacccatggtgttcacatattctgagaattgcgggttagctttctggggttttataaagtatagcccgctctgtttagctaccttattgacaatgtcttgacaatctttcccagtgatatcatgcatctccagactagttctc

SEQ ID NO: 650107 - DNA, 672 bp, Homo sapiens
agctctaagcaggatccgtccggcacgcgcgcccgtcagttaaactgagcatggtcatagattgttgcatagaagatcaagtgcctaattattgctggcctactctccgcttctgaaagcccgggagataaatcatactgagtgatgaactaagctccgtgttatgtgcatgtgacgagatactcggtgtagtgggactctcatcatctcaagcgatgtccaagcgagctctgatcgtccacgttgattgccccttgaacgtgtaggcagagcagctcagagcacggcttgaaagcggatggtaggaattcccttggcaagaggttcctccagaagaactcaatgattaacatgaatgtcacgtagcaaaagtctcgagtctgatggtatctggggtgaacatgacgttgattacctttcgttggtgaggaagaatgtaactttgaatccagatcccaatgagattaagcagctatggttatgtgtcaaaggaagaactacaaacgaacttctgaaaaaagcagtcagtggtgaaattaacgataacgccatggtttacaacttattgcagcgacttttctctttaaatggtgcgataacttaaatcatttgacactcagtttgttgaccatgacaacactatccgaatgtgaatatgtaggtacaatgatc

SEQ ID NO: 650108 - DNA, 597 bp, Homo sapiens
ctgagcacggagaggctgacggacaggatctatgggcagatactaagagcgaacttcacataggaagggatctgcgaacacgttgccaggggctcgagaaggtcactgagtgagttattgggagtcttaatagaataacactagatattaggtccattcattaattagttccagtttctccttgaaatgagtaaaaactagaaggcttctctccacagtgtagtgccccttcactcatttttttttgaggagaagggggtctctgttaacatctagcctaaagtatagaactgcctggggggcaggggttaggaatctcttcactaccctgattcttgattcctggatctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgacccactgcttctcttttgaaagtagagctagctgccactttcacgtggcctaggtagtgtctccactacaccctgtgctccctgccacatg

SEQ ID NO: 650109 - DNA, 291 bp, Homo sapiens
gacatacgtctatgctggtccatcacatgacgagagatgcccatgccgtcaccatgttgattcggggggtaataaacccacgcgaggatacagaccaaggtttttggcccccaaatttactgggaaaaaggatgcctgaacacgccaagtcgggtgcgaattattgcagttgctgctgctcaccgccccttatcagtttttcttctcttctttgacattctaagaacttatagataacttaaaacttttgtgaggcagattaatgtgggccataaaacctttaaatgttta

SEQ ID NO: 650110 - DNA, 372 bp, Homo sapiens
  misc_feature (70)..(70): n is a, c, g, or t
  misc_feature (72)..(72): n is a, c, g, or t
atttctaatttttaagaattggggaagggggtagacccctaattcataacccctctaatttttggtaatntnaataagggggccccatgggggagccctttggtataaaatagccaaatagaaaaggggcccattggtttcccttttaatatgcttaaaataagcgggggggtctatttcaggtttttggccaaaaaccattggggatagggatggggagggtaaaccagtaaagggggttttttggacccctgtttgggccggtttccccggggccttttatcccaagggggggggaccccgcggggatacgaggctccaagagaaaatgggggtataaaaaaggggtcagaattaaccttttttttcata

SEQ ID NO: 650111 - DNA, 277 bp, Homo sapiens
  misc_feature (157)..(157): n is a, c, g, or t
  misc_feature (159)..(159): n is a, c, g, or t
  misc_feature (161)..(161): n is a, c, g, or t
  misc_feature (241)..(241): n is a, c, g, or t
  misc_feature (270)..(270): n is a, c, g, or t
ggcacgagctggcagtccttgggtctgagggggttatctaccgccgcttgcattgcatctgtcgcgcgcttattgagcggaacagtccgatagctattatttttggtgtctggaaggtgcgcgactcgttttttgagatcaacttgggagagcgttngntngcaatctcagatgagcgcatcgtcgtttccacggcgattcgtgtcatccatgcgagcatagggttgctatgtgcattaanccgcccccaggaggcgttgctcctccgtnccctacg

SEQ ID NO: 650112 - DNA, 234 bp, Homo sapiens
gtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgttgtgcagctatcacttacatctccagaggtgccttgtggtaagaagtgggctagggcatttttaatcttagagcgaaaacctataatcactgcg

SEQ ID NO: 650113 - DNA, 1096 bp, Homo sapiens
gggaagtcgctgagtgggtggtgaagctggttggtgaaatgtgtctgtgtttatcttcgcgccccttgcgttcttgcctgcgtgcttgcctgtggcagtgtaaatgctgcgattgcgatgatgctctggcaaccctgccgactcatgcctgtgaacctggctccctgtgccccagtggtgcgtggttgtccttggttgctccgaactccttcctgcatgggctccttgtggaccctgctggtatcctgggatgtccgcttgctccagggtcccttttccttgcatgttgatgtgctgcctgtcctggccatcctctagtgtcccctgcaggaacccccagtcattggggcaaataccatgcatgtgaagcgcagcctgctgctgggacgctggcactgtgtgtgccataatgactgccccaggatggtgacatgctctggggtgtgcaccaaatggactggggacatgggcccaatgactccttgatggtgacatgccccgaagaacgcctgacctcttccactcctgaggaaatcaatggcaccatgagaaggacggaattcctggttctggcatgcatgatctaggaaggtcgaatgatcaaatgctcccgcccagtgctcggccaacggagatggtatcgatgtgacggggggccggacaaggacacgtttacttatctgggtccttcaagcaactggagtaaacttccccatcaccagaagccacaataacttttgtagccatcctggatctgccggcacaggacgagcatcaggaccagtccttctgtggagttggtcagtggacgcagcgaacccttccgagcccaaagtaaaccagcaagcttggacaagtaaccagcatcactcacgtgcagaaacactgctttcgacggtattcgagtgctaattgacgggatcaccaaattggccagaagatgttagacttgccacgtctcccccagtgccttcctaatggggcccaatgttgagcaccaagaatggatgggcacccatatatcccaggattcccgagtacagagaacagccggcgaccttagcacacatgcgcgagcagcaagttgtgcacgcag

SEQ ID NO: 650114 - DNA, 369 bp, Homo sapiens
  misc_feature (369)..(369): n is a, c, g, or t
gagagagagagagagagagagagcgcgagagagagagagagagagagagagagagtgacagagtactagagcctccaggttcagggctgtcttcagctatggtcccttcacggtcttcctttctgcgtgactgcatgtgcccttgtcttctgcttgctttctccgtgtccagccatgaggtactgctctgccatactctgataatcgggtgctccattacttattgcagatgctctgtttcgtccttatgtgtgctcgatgcattccgatcactagaccttgttgaatccccctgtctactgccattattgggcttgagtctttgactgtgtatcgtattggtggctcccgtcttcctgggcccgggtn

SEQ ID NO: 650115 - DNA, 112 bp, Homo sapiens
agctgttaaggacggggattataaacgtgaaactcttgtcgatggtgatatcgttgtaatgataggtggtagaactggtcgcgatggtattcaaggtgcgagtggttcaagt

SEQ ID NO: 650116 - DNA, 166 bp, Homo sapiens
gcacgagatatgagcctataattttctcaataaaaatttgtatttgaggctgggtgcagtggctcatgcctataatcccagcacttcaggaggctgagacgggaagatcgcttgagcctgggagttcaagaccagcctgggcaacatagcgagaccccatctttcc

SEQ ID NO: 650117 - DNA, 148 bp, Homo sapiens
aatcatcctccaacctgtgactgaagcaggaactcaactggatgtctctcacccactattcacatcttcaatgactaacaggccattaactgcacaactacagtgtcaaacatttattttactagtctcctgtagtgtaaccattaac

SEQ ID NO: 650118 - DNA, 81 bp, Homo sapiens
actctcaatggcttcaggtgtgtgtactggggcagcaccgccttgagtctggcaggaggtgattaaacagctcagcttctc

SEQ ID NO: 650119 - DNA, 350 bp, Homo sapiens
tgagcctctcaggtagatcattactgaggttagaacagcagctgagcctgcaaaagtcagtgatctagtggctgagctggcactagctggacctgtggaacgctggaactgcatggcttctctgccgcaacttctccaaatttccacacatggcgcaggtgccccccatagggtgcttgtgggagctcctggctcctatgcttcctactggataggggggcttcagtggcaaccatttgggccaacatgcaccctcatgctggaccagggttggccgcaccagccccgggtttgactgggggcactgggggtgcgaacgttggcttgatgacctgctttggtgcccgcca

SEQ ID NO: 650120 - DNA, 164 bp, Homo sapiens
  misc_feature (115)..(115): n is a, c, g, or t
gtgggggggagatgacgggcagtaatgcagaggaggacgcgccaaacttaggggcgagttgtccagctctggccgcaaggtttgcatccgactggattctttccttcccccaggncatgatggtggcccacggcaataagtgtggggtacctgagctcgaaatt

SEQ ID NO: 650121 - DNA, 1021 bp, Homo sapiens
gcttcaaatggcggatgactccggtgcagcgtgggggcccgggggcccctggtggccctggcatggggaaccggggtgtcttccgcggaggtttcggtcgtgtcgtccgggtgcgcggtcgcggtcgtggacggtggtcgtggcctgggtctgtagctcgcggtggccccgtcgtggaatcatggagctggcatggccgtacactgatagctggtgctgatttgggatcacgaggacaattgaatgactcagggtcccgtggagggaagagtcctaatctctatctcctctggtgtcctatatagggaaatcccagtctccttgctttccgtggcctggaggagtccctttctcaagtgcaatgagggtgtctggagagaagtgagtgtgcagtgcggtaatgcgatccggttgcggtcatgtcgccacagagttgttcaagggcttgtggttgctttcgggggagctacagtggccacgttggtcttgggtgcttggttcccgcttgctgcctgggtaggcgtggacgtcggccattgcgttggtgccactctagtcctggtctagagctctcgcattcgtcgccctccgattgcgcagatggctttcctgggggaacaagttgcggtagagcccctgagtgtccgcttggccatgtgacaagtgccgttgtcgggtctgtgctggtgcgcctcgtccctgcacaccaggggcacctggatcgttgccggctgcctgtggtctaggaaagctgttgcatgagggctggtatcgatgtctggtacatcttacgtcgggtggttgggtgctccctgggtgagttcgcgataggcccttttgttgccgttttcttacaccgacatggtactgagctccggcctgtggagggtctgtgtgcccgtcttcctttaggaggtcttggcacctgttagccccaccgggtcgggggggggggcccacggggtccgccggtttccggccacgtcttcggggccccccttgggggccccctttttcgggg

SEQ ID NO: 650122 - DNA, 111 bp, Homo sapiens
ggtgaatgtcgggcgagacgcgtatgatgcgcgctgagggcgcaatgcatcaggccataaatcggagatacgtagcggtaacgtaacaacggactcagaatatagtagatg

SEQ ID NO: 650123 - DNA, 1002 bp, Homo sapiens
aaggagaaagagaaggagccagaggaaacttgacaaactggagaactctgcagcacccaagaagaagggatttgaatgaggagcacaatggacagtgatgatgacagcagtgatgacgagcaggaagaagaagtccagaagcgccccaagctgtccaagaagatagttgcgcgcgagatgaaccgcttcactgtgggtgaactcaagcagctgggtggctcggaccgatgtcgtggaagatgcacgatgtgacagcgcaggaccctaagctcttggttcacctcaaggccacatcggaactctgtgcctgtgccacgtccatctggatgtatgaagcgcaaatacctgcagggcatacggggcattgagaagcccccgcttcgagactgccagacattcatcaagaggcacaggcaattcaggagatgcgagaggccctgtcacggagaaggaagaacagaagaccatgaaggtcaagaatgcgagagaaagttcggcctaagatgggcaacgattgagatcgactaccataaactgaatgatgccttcttcaaagtggcagaccaaggcaaagctgacatccatggggacctgtactatgaggggaaggcgttcgagacacgactggaggagaagaagccaggagatctggctgatgagctaaggattacctatggggaatgccagaagaacgatatggcctccatgtgtgctcccacaagggtgcatggccatgtcaagaaatgtgacaaccccatggattcgcactttaaatccctgggtgaaatctcctacctgaaacggcgtcctgggggtcccacgcgtggggctgagggagaccccggggcataacaggggacaccccaatggagccgctgtaaacaccagttagaaataagagaccagggtgccacaaaattgagacccggtggacgcgagacacttacaaagctgcaggagacaacaagccgaggacagcaaaccgcagggaagacgggctac

SEQ ID NO: 650124 - DNA, 106 bp, Homo sapiens
gctggtgtctcagcacaccacacggtccctcacaggtctccacgggggcgcagggagcaggatttactcctcctgttatgtagtagtggcggcagcgggtaccgag

SEQ ID NO: 650125 - DNA, 273 bp, Homo sapiens
cctttttggggggaaggggctcccctcctggatcaccattttccagattaacgggccccgggggggggcccttggggaataccttttctttcccaaaaccctgggggcccccctgaaaattttgggaaaaaagggggcccggtttattttcccaggaaggggcccttaaaaaaaaggggcctgtccctggggccccttttcaaactcctaaaactggtttttatgtccccggttttttggggaaatcccccaaaaaagggccctaatttttca

SEQ ID NO: 650126 - DNA, 1100 bp, Homo sapiens
ggagttaaatggggtccatggccacgtgcgttgtagttgccccgctaaggcgcactgacaacgtgtgcccctaaggctatgtttgtatatgtgtcctcagaatctacacagaaacgagatgaaagattcggagagattgacccacatgctaatctgaagagagtgcggataccacaatcgtaggcgcaagatccgagagtattgagccctagatattattactacggcacaaagacgcaatgcgcacattggagacatctggactagtatacagctaattgctgattcatacagacgtattcaccgcgtggactcattgcaatgcttgcaccatgaaacgcataggatctgagacgcaatagaggataggatagcgagcttatgtagttagccaacttggttggaacgttagtataaacatagccactatatccactaggcgagccaggagttgaaacgaacaggtgcatgctgacgaggacatgcttgttcattgcaccagttagcactagtgcgctcgacacgggtcaagagcaactccctgaaattcgggactctgaaatgggaggatgcaaggaactcgggcgattactgggtttccagaaccttgtgcttccccttcgactttatacgggaaatcgccttaatggtgaagttgtttaagccaagaatcagagaaacctccatggcggagttcgactgccttagagatcgttatgcaccgattctcaaggacgttatgagtcattaacacttaacgttcgaaaataatctatgagttacgttacgttagattaacttacttcctttcacttttgtaaccagcaccatagttggaaaaaccaatacatgtacagcaacgcataaggggaaactatcagaacaaacatctcagagaaaatacgacaataaactgcgagaaatagatacaccagtgttatatagacgacgagacagaggatgaacacgaacggtcgtgaaaatccgaggaacagtccgccctacaggacgcagtactccacgtaaacgctattcgaatctcataggacacccaggtagatgaacagatttaacagagcacaagagagtatctacgaact

SEQ ID NO: 650127 - DNA, 474 bp, Homo sapiens
cggaagttgcagtgagccaagactgcaccactgcatgctagcctgggcaagagagcaagactctgcctcaaaaaaaaaaaaaaaaaaagaaaaaaatctaagctgttggaacattaaattattttgagctttaaagaaatgtgtttatgagacttgagtcatgtgacaggcagctgtaacctaggaaactgtaaacattttttctctgattatagattagcctccttccttatctacataattttgtaaaatgttgtaaatgactaaagggtacttccctttagtcccacttcactgctgatcttcattgcagattaacttccttcctacctctctcacacaaagccttcatgactgttacattatatactcttttaaattagaaaataaatgaaaccaagccacaaggaaaagaaaacaaattaactaattgaattgttttaattcataaaccagctttgtataagaaataaa

SEQ ID NO: 650128 - DNA, 385 bp, Homo sapiens
  misc_feature (28)..(28): n is a, c, g, or t
  misc_feature (75)..(75): n is a, c, g, or t
  misc_feature (94)..(94): n is a, c, g, or t
  misc_feature (167)..(167): n is a, c, g, or t
  misc_feature (187)..(187): n is a, c, g, or t
  misc_feature (246)..(246): n is a, c, g, or t
  misc_feature (284)..(284): n is a, c, g, or t
  misc_feature (333)..(333): n is a, c, g, or t
tggatggacccagcagagggcactcctnacccacggggaaaatcgtgcgcccggcctcgtcccaccgcccagaanacgccgctacacaatggantctcgctctgtcgacccaggctggagtgcaatggtgcgatctcggctcactgcaatctccgcctccgggtganaggtgaagccagctggactnccctgggtcgagtggggacttggagaacttttctgtctagctaaagatttgtaaatgcnccaatcagtgctgtgtctagctaaagtttgtaaacgtnccaatcagcactctgtaaaaatgggccaatcagcactctgtaaaatggnccaatcagcactctgtaaaatggaccagtcagcaggatgtgggcggggtcaa

SEQ ID NO: 650129 - DNA, 268 bp, Homo sapiens
tctctccacacggataacacgtatttttatgagacatctctcctttaattatttttatattttaaaaattgttataaatatataggtataatgacagcggggagatacataggcataggtacagctaatgataaagacaaggagatataaagatatagataaagactatagacagatattaatatagggatatagatatttagagatagaagtaaaaacagaaaaaaaaaagatatttaaagtaaaactatgaaccagtgtgagagag

SEQ ID NO: 650130 - DNA, 367 bp, Homo sapiens
  misc_feature (237)..(237): n is a, c, g, or t
  misc_feature (279)..(279): n is a, c, g, or t
atgagatggaatctagctctttcgcccaggatggagtgcagtggcgcgatctctgatcactgcaacctccgcctcccgggttcaagtgactctccagcctcagcttccagagtagctgaaactacaggtgagtgccaccacgcccggctaattttgtttgtatttttttagtagagacagggtttcacagtgttagccaggatggtctcgacctcctgacctcgtgatccgcccgtntcggcctcccaaagtgatgggattagaggcgtgaccacccgngcacggcggaaaacgagattttttagatcaactttacattgccaatgcccattggtattccttcacaacaaattcacaagagtgtcag

SEQ ID NO: 650131 - DNA, 150 bp, Homo sapiens
gcccagcgagccagaagtggtggctggtcccgcgcgaaaattcttagctgtacaactctagggaatgaaacaatagttcaagaggaggcctgttaaactttttttacaaatacaattgggttattcaccatgggggttaggcaaagctta

SEQ ID NO: 650132 - DNA, 364 bp, Homo sapiens
caggactcccccactgctttcagagcccccagatcacaggaaatcaagtgatgatctttgaaactttctgaaactgagctccccaagtctacaggggatctaaccatgcctggccttccccaccaacacagagcacatctccccaaggctcccaacccacgtgggccacaaatcagggtctgctattacccaactcagcaggtgttgcagcctgagagatgaagcctcaccaaccccaccatgttaaaagctcatggttcttggtttatcacccgtcccctgggccctgactgtacactgatcattcactcatctgggaaccactggccacattctcccacattatctgtctctctatacctta

SEQ ID NO: 650133 - DNA, 152 bp, Homo sapiens
atgtcatgatgcctaactcatacactctttgcctcaaatataattactaaaaacaaatatagtataaacattaaacaaatgaacaataatcatcaatagacgggttactttcaaggaagagttgttttgtgacaaattctactcttgatcta

SEQ ID NO: 650134 - DNA, 1039 bp, Homo sapiens
tgtgcaccccatcccctcccccccgctgccccgattcctggccccagctctgggggtggatgtgcctgggctgccctgggccagagtcctgtgcctggatgctgtgatgctgctgccctgtgccccagatggagcatgcatctgtgcacagtgcattgactcatcgaatcagcgaacggatgtgaagtgcatctgagtgagacacctgcgtgcatgtgtgtagccaaactgtgttgaaccatgagatgtcagagcatgacattccacacgaagactgccctccagcaagagcacacagagatgtgaacaatacactaaccaaactaacagactaactataacagtgactagttagatactaagaccctaggggcatatggattaagtgtgaggatgttgacacacaatagacacttaggacatacaaacaaagaaaggggggagacgcaacaacccttaagagccgtattatggtaagcgagacgcgcagcatcaggaagagctatcgtcgacatagacaccatacggtacccccacgttaaaaacgggaagcagcacaccaacagagagaatcgacaacgtgaaagcagcatataggacctatccccccttaagcaaagataggagcccaaaaacgtgggcaagcctccagcggtgggaaacccgtaccaatcggaagcaacaacaggaaagctatcattcgacatagacttcaggcgtgcatacaccgcgataaaccatggcacacaccccgttggggccgacccgggaaagtacaagcgcgccttaggaggatttatggccctaacacagagagaagcataagccacgttaatagacccgaacagggaaccaccgaaaggaactgcgagaaagacagccgaagaagactgctctcgggtgcacggacgtagagaacgaacatagaccacactaacgacaccaacgattaaggataaaggggacaaggagaaattcaatggggaacataagaggcggcgaggataagcgaaggtacacgacagcagacaccgcacgc

SEQ ID NO: 650135 - DNA, 421 bp, Homo sapiens
  misc_feature (12)..(12): n is a, c, g, or t
  misc_feature (151)..(151): n is a, c, g, or t
ggagcaggcccngagggccggacccgcggccgcaagaggaacaggcccccccccccccgagggagggagcacagacggagcggcgggaggagcagccgggggctgcaggggctggagcagcaccaggcttggactccactttttttaacgnggagaaggactcggagctcttccacagcagtgtggaggccattgtgaatgccatctcacacgctcgtgcccagaggtacgtgaacacactcctgaaactcatcccgctggtgctgggtctgccggaacaactgcggcaggcagtgcagaatggggacatggagacctcccatggcatctgtcgcatcgctgtggccctgggcgagaaccactcccgggccttgctggaccaagcgcagcactggcagagctccctggcactcgtaaacat

SEQ ID NO: 650136 - DNA, 204 bp, Homo sapiens
agaaggtggagctgcaggagctgaatgaccatcgcactcatcgcagtgcgttctggcagcagatagatctctgcgagctcgagagctcaaggccaaggagtcgcgctggggcctctacgaggaggagatgcgggactgcgcgacaggtggcacagctaacacgacaaagccgcacacgcgcgcgagcgcgacaaccacgcgcgc

SEQ ID NO: 650137 - DNA, 327 bp, Homo sapiens
  misc_feature (99)..(99): n is a, c, g, or t
gtcactctaaggatcctgtctgtgctggtcacagcttcgacaggtactgtcttctgctaggcagaggacacctggtgacatctcaagggtgacgcattntcttatcatcgatcttctgcacccatactttccgccgaaatcttttggagtagtcttgatgcggactcgtgcttggccagctttctcttgtaatcaaaccccacagcagcggagtctgcctctccgactgaaccaccgaatttgccttccaaaacagttctttatatctttttggggatttcatgcagctgcaattttctcctggtgatcccagacaagaaccacacg

SEQ ID NO: 650138 - DNA, 288 bp, Homo sapiens
  misc_feature (1)..(1): n is a, c, g, or t
  misc_feature (33)..(33): n is a, c, g, or t
  misc_feature (42)..(42): n is a, c, g, or t
  misc_feature (47)..(47): n is a, c, g, or t
  misc_feature (59)..(59): n is a, c, g, or t
  misc_feature (61)..(61): n is a, c, g, or t
  misc_feature (90)..(90): n is a, c, g, or t
  misc_feature (96)..(96): n is a, c, g, or t
  misc_feature (106)..(106): n is a, c, g, or t
  misc_feature (125)..(126): n is a, c, g, or t
  misc_feature (132)..(132): n is a, c, g, or t
  misc_feature (154)..(154): n is a, c, g, or t
  misc_feature (180)..(180): n is a, c, g, or t
  misc_feature (215)..(215): n is a, c, g, or t
  misc_feature (219)..(219): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (266)..(266): n is a, c, g, or t
  misc_feature (281)..(281): n is a, c, g, or t
ntttatcaaaagtttattaaatagaatacaatngcaaaattnaaggnttttaacaattnantggtaaagttcaagtggaagaaagcaaanctcagnggagtaaganaagaaaagaacaatatttnncctatnccatttaattcccacaaatttncaaagtgagcattgttattctcagtntccagatgaatgcactgaaataattgggatatttntccntccaaatttcatgttgaaatttggaggnggggtntgngtgggaggtntttggttactcagcnaaagaat

SEQ ID NO: 650139 - DNA, 306 bp, Homo sapiens
ttgattgagtggcatgtgatgtgagattactgaatctgtgggagctcggtacagccggggggggtcctcagactctcatgtgcagctctgtattcaccttcaaaaactatccatgagctggtgtccgcaggtccaggcaggagtctggagtgggtctcaacaataaagttgcagtgaccctgatggacctattatagagcgtctgtgaggggccgcttcaacatctcaagagacaattccatggacaccctatattttaaagatagacagtctgacaaggtgacgacgttcggcctttattttttg

SEQ ID NO: 650140 - DNA, 188 bp, Homo sapiens
agaggttgcagtaagtctggatgccacatcaaactgttttgtgggtactcctaaacttcgtggaggagccctctttcataaatctgagacagccttggtctgagggggcaaagcagagattcacgtgctgcccaggcatagcacatagcaggtggacatccctggacactttcctgcaaagcacgcaa

SEQ ID NO: 650141 - DNA, 168 bp, Homo sapiens
  misc_feature (88)..(88): n is a, c, g, or t
ttccccccccccccggggggtgtggtataatttttttttattatttgtgtgggggggggggggggggggggttttggggggggggggncctttcccccccccccccccccccggggccccccccccgggggggtttttttttaaaaagggttttaggggtttttttta

SEQ ID NO: 650142 - DNA, 668 bp, Homo sapiens
tgagccccccccccccccccccgcataaaatggggctccgtcccgtcgtttaggtcgcctcttaatctccggttctcagtaacttccttcattccggttctttaaagcgtcgggaccataggcgcgagttactatatttagttctacccacagctctccaataataacttcacgaagcgggcaccactaccgccaattttacccctagaggaggaaagtaagtctagagaagccatacaacccgtttatgcgatacggctaggaagcggcgcgattaggacgcgaattgtggtaagtcgttcctagctcgcgtccgcgcctatttcgttacgtcgttcctaaaatagagcaaagatagagaccctcagtaatagtgttcgaatgttactttgttcgttttcggacctctagcgtcgtgggtgaacttacttttctccgtccaagatcgagtgaggtccgtaagcattggaggtgaacgaaccgggtttgttcgttctattccttcttttagcggacgaagaggagccatccgcgctcgctaacagtcttctatcgggtagtagacttaaggggttttaggcggcgggttttctaggtcgggcgggtctcgcgtctggggggctaattattggggcaatcggtccttcgcaggaggtgctccggtcggt

SEQ ID NO: 650143 - DNA, 277 bp, Homo sapiens
gtgactctagagatccccctgaaatgtctgttttgactggggctcatagacgatgtgtgcagacttgcataatggtggcttagtgtgtatcagtgaacactacagcacaggtgttctgaccatgctcaggcttgcgacaagtgagcaactctagtggcttgcaaacagagaagtttactttgtgcccagtcatggggtcaccgttgggtgagtgcaccagaatagcagtgcagcatgttggtatcattggccgttcgatcctcatttcctccctaaa

SEQ ID NO: 650144 - DNA, 3672 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgccggggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtggaaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650145 - DNA, 5457 bp, Homo sapiens
  misc_feature (3309)..(3309): n is a, c, g, or t
  misc_feature (3341)..(3341): n is a, c, g, or t
  misc_feature (3464)..(3464): n is a, c, g, or t
  misc_feature (3476)..(3476): n is a, c, g, or t
  misc_feature (3488)..(3488): n is a, c, g, or t
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgtttttttttcagcatgttgggataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacacgggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccccatttaggaggaagaaggcagatctgggcctgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcgcgatctcggctcactgcaagctccgcctcccaggttcacgccattctcctgcctcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtcgaactagaattaggtatgtttgttactgtaaacgcagcttggtggcttacagtgattggcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccggaacactcggtgaggtttgagagatgcacaccacgtaacatctcgtgggcgaatcaaggcacagcaacgcagtggagcctgaggggagccgggcactggtgcaggggaccatgcacagggcaccctcggagctccgttcctggccacaggagccaaggcaggctggaatgtccagcacctgcatgctgggggcctctgctgcgccactggcagtgggaatggaagcccccacctcttagccgactgcagatgggggtgtcgtgttctgctcatcgtcatttcgttttagtggggtttttctgtaagactgaagatgacttcaatgattggtgccagcaagtcaaaaaggtttgtagccgccccacacccacagccgagctgagccacccagggagacaggcagtggggcgtgcaggggtcgaaggcctgcgtccaggtctcaggcagcctcactgggccgtggggagctttgtcccgcctggcacagctatgtagctnagcagggtggggcgtcctggattgcccatctngcaacacagttaacaaccctggggacggatgttgcgtgttgactttagaatgggatttccagtgtcctcatccgtctcctgttgagatgggggtggtgatggggtgctgagctacgccggccnagtgcgtgtggnccacccccctcngccgtggtggtcagactgtgctgtgtgttgatcaccacactgggttctcgtgtagcctttagtgtggagctgcctctgttttctcatcagtgagatgggatgacaggtttgtccgctggctgtggccggctggcccctttctcttggccgcagcaagcactggggtgaggctgcacctaacggccatgtctcactaacagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650146 - DNA, 258 bp, Homo sapiens
ggacggcacagttgaccagatattttgtattttgagtaaagatggggtttggcatgtgggccaggcaggtcttgagctcctggcctcaagtgatctgccctcctcggctcccaaagtgctgggattacagacgtgagccgccatgcccagacacctatgtatgtcttgatgcttagtcacaatgttctgattagttgaggcggtctttttctttcaggaaaggtatgtttaacattccacactgaagatgtaattgtc

SEQ ID NO: 650147 - DNA, 2438 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgccggggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtggaaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaga

SEQ ID NO: 650148 - DNA, 101 bp, Homo sapiens
cttccagcactgggacgaactcaaggcattcttcggcagaggtggtcagggatggtgtaccccttggttgctagcccttggcctcccacagtgtcctggct

SEQ ID NO: 650149 - DNA, 960 bp, Homo sapiens
gcgcccgccctttgtgtttgtgcccccttttgggattctcgtgctgccgtttgggacacctccccgggcgctttctgcttagtaacacccaattgggcttccttggcgtgtttttctagagctttccttcctgggtggctgctccgccctctatcctgttcaccggcggcggcccccccccagtgtgggtgaccccccgcggcgcccgtgcctgccctggttatgcttgtgccagaacatgcccgttggctggggcgtccaccaaggtgctgcgcagcgtggtccctctcttctcactcgagggacagaatccgtccgccggttcgctttgctggccaagcgggccaatatgttggtgtctctctctggccgggagatttcgcgtcccccttcttgattcttcgggatgtaaaaacccgacgcgctggaaaccaattcttgtgaaccacccacgcacaggcggtggacccccccgatgtgtctatcccaccggaggcgtttcatcactcgaggtattagcattactcgtgtcctgtctagaaacgaacagagactctttggttccgcggtgcctgccgtgagtccacacctccgctggtttcttcccgccccctctctgggaggagacagacatggcaggatccgtatcacagaggggcacgcgaggcagctacggaccacgctcccgcgcccaccacaagggtgggaaaacccctccctccccgctcggggaagccgcctcatctacttcgcggcaggtagctgcgagggcctgcacgactagattgccgccagcgaagtcacgaccatgtctcaggagggcggcagaatacacaggaggagcatcaccatgttgaacccgcgagacaacgaagagggtccccacagaggcgagagaggcgccacacccgtgcacaccccccccgcgggggaccaacagggtccctctccaacaaaaca

SEQ ID NO: 650150 - DNA, 1688 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccaggtggggtccctcggaattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaga

SEQ ID NO: 650151 - DNA, 2230 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagaaaaaaaaaaaaaaaaaaaaaaaaaaaaaaaaaaaaaaaaaaaaaaaaaaaaaaaaaaaaaaaaaaaaaaaaaaaaaaaaaaaaaaacgaaaacaataataacaaacaaatcatcacatcataccaatataaagggggggcggcgtctccttactttatctgtcctccgcctcggctgctcaccctctcgactcctcctcccgacccattttgttcatgtacccaggcgtcgtcctcttcttattgcgtcggtcatatatatctattcctaacttccccatcccggtcgcgtggccttcactaatcctatcactcgcactcacctagcatatatgaaactagtactatcatctctctattctctccttacttgtctccttcctctcattatactttccacaaaaaacctatccttatctctctgtttgattgttgcttccagatctttaccttaatttaacatactcataatctcaacaccactacagtttattctcattcacctccccccctctcaagctacactacctatatatactccctcaccatctcaacccacaacactaacaatcacaacc

SEQ ID NO: 650152 - DNA, 134 bp, Homo sapiens
ctcttagaggttcccccctcatcgagtcttcacgtgctatcatttcctttgatcttggttcctattcgtgtaccgagaaacttgtgcgaattattgttcaggtttagctgttagattttcccgagtccgggctt

SEQ ID NO: 650153 - DNA, 1673 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcaga

SEQ ID NO: 650154 - DNA, 2950 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650155 - DNA, 924 bp, Homo sapiens
  misc_feature (59)..(59): n is a, c, g, or t
  misc_feature (123)..(123): n is a, c, g, or t
  misc_feature (308)..(308): n is a, c, g, or t
  misc_feature (342)..(343): n is a, c, g, or t
  misc_feature (407)..(407): n is a, c, g, or t
  misc_feature (632)..(632): n is a, c, g, or t
  misc_feature (639)..(640): n is a, c, g, or t
  misc_feature (843)..(843): n is a, c, g, or t
  misc_feature (848)..(848): n is a, c, g, or t
  misc_feature (851)..(851): n is a, c, g, or t
  misc_feature (891)..(891): n is a, c, g, or t
tggctggcgtcctggtgcctgttccgcgtctgtgcgaccgtccgtcccgagcgcgcagncgcggcaggccaggtcagagcagcccaccatgggatggggagggggtggaggctgcaccccgcngcccacccatccaccagcagccgccggagcgccgcgtggtcaccgttgtctttctcgggcctcctgctggacctcctggccttcacgctgctgctgcccctgctgcccgggctgttggagagccacggccgtgcccacgaccccctctatggctcctggcagggcggggtggactggtttgccancgccatcgggatgccagtggagaagaggtacaannagtgtcctgttcggaggtctcattggctcggcattctctgtcctgcagtttctgtgtgcgccantcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagacctctccaaggccatcgttgctgacctgggctcgcctctggcccgcagtcaaggcatggcggtcatnggggtgnncttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggaanaaaanagnttctcggctgtcgctcgtggccccgcccccccctctggcnccccgctccccccctgcgccgcctggggctcct

SEQ ID NO: 650156 - DNA, 109 bp, Homo sapiens
ggtatgataggatgagcgcagcccggccatcgtacgaacgttcggctgggtggctgaactcgtgatcttgagcctgagatgtattgccgatggcaaccaacaggggtgt

SEQ ID NO: 650157 - DNA, 112 bp, Homo sapiens
agtagcaagtgaccagaatctgccatgtttaaaacgtttaactttcctattaaaagctgccgaaaaggttaacaataacaactttcaaggttctagatcgcgagcggccgct

SEQ ID NO: 650158 - DNA, 3039 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacaggtatcggccatgctggagcccaccctggtctgaccgcttggcctgcagaagcattttgtgatcactgttctctgctaactctgccataacttgtgacttgcaaacttaaggcgttgtgtgtgtgtgttttttttcttttaaacaacctctagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650159 - DNA, 354 bp, Homo sapiens
tccaaagcgaatacccaatatgtgtaaaataatgttctgaacaaatgttgacatgcttatttattgtaacaagatggtgtacttcattgttccccgttggatttccgaagcaaagcaatgggaccctacgcttcagagtcttattggggtggggcagtgtccattgaggtgtcctgttcgggaatgacaagtccctggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgctttggca

SEQ ID NO: 650160 - DNA, 2814 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650161 - DNA, 532 bp, Homo sapiens
tcggtctgactagtctccttcagtgaaggtggatatcactgaaggagataggaaacctagaatactacttgtttacgttgccatgtatcccatctaggtgcagtagagaggaggaagactagccccttcagaataatgatagtggcatctgtttgagcccagagtcctatctggggtctcctcaggcacagtccctctagcaggggctctccaaataggagcctcccatctcgaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaagacaaggtagagccgag

SEQ ID NO: 650162 - DNA, 3041 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattgccattcatcattgttgtataccctggagctggaaggagatggggactggttctcagccttgcctctcaccggcggagaactgaggccggaggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650163 - DNA, 5585 bp, Homo sapiens
gcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagccaaagtgctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggaaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtcaaggaagaaaaagttttctggaattccgtaaattatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgtaataattatttgtaaatattatttagatttgtatttagacatgatttatatctaatatagatacaaagtctgtgtctaaatattatttaaagaagtgatttttcattctcttggattctttccagtgtggtgccttttatatgcctcacatagtctccttgttctcctactaatattcccaagctccatatgccaattaaagaagaaac

SEQ ID NO: 650164 - DNA, 146 bp, Homo sapiens
ttctcggtccacacgccacggagaaggagtcacacacgccgggtgtgaaggagctcccagccccttgggggtgtcagttttgtttggggaaggactcctgttggggtactgcggtgtctttggcatcccttctccggtggcgtggt

SEQ ID NO: 650165 - DNA, 3243 bp, Homo sapiens
gcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacacaaaaacacgctgaaagaatatgctctgatagatgtgaggttgcgtggagagaagtgacacgccagagacgccctagagcttccactctcccttgtgagtcccagatttttatcttatgactacagcgggtggtattcacaaatacttggcctcagatacattagcagtgtagttcaacgccaccatctttaacaatataaagggacatttatttatatctcaaaaaac

SEQ ID NO: 650166 - DNA, 432 bp, Homo sapiens
gccgggctactctagaggaccccgaacatgtcgaggctatcatgtatgttggtactttcacttgttgattcgagtacatttctatcatctccgcgtttgggctattatgaagacactatcatgagcatccatacgttgcaggccaggtctcactagacacaggcctccgtaacaactgtttcagtaccgactgagtggttcaattaaatattaagaggaaaaaaaaaaaaggatcccatgtgcccttttacaagggtggacatgtcacacaagccctccaagagtattgcctagatttctccctgggcctaaaaggctgacgggactcacgggaagtttttcttaccaggcgccattgagatgatgtaaataagtcctaccttgggtggactaaaggacatatctccccaggggcccctacaaaccagttct

SEQ ID NO: 650167 - DNA, 787 bp, Homo sapiens
gcacgagctcgtgccgtgggattacaggggtgagcccactcgcccagcccagcagtggcttctgtgtgggaagaaggtcagggctgaaggaccctgggaggatgccccacccaacatgtcctctctcatcgtggggtaattgcccatgtttgcccagccattctcacctatcagggcttccaaaagaatggccaaagtaagttctaacaactttgcttctttgccaaggcaagcaccaatgctacttttctgccctctctggatgcccgtgacttcggtcccacaggaagccaagctcctgaggcagctgaaattcagtcaggggactggggtctgtgtactgatctacaccccacttcatacctacttcttcaaactgtccccaacactgggaacacctgtccttgaatatcctcagcaatttaaggggaaaaaaaggctgaagcagaaagactttttccttccaaaattgtgcctgcttgcttgggggcctaggcatgcagacttgaaaataaatcaagcttgggtggggcatggtggctcccgcctgtgatcccagcactttggaaggccgaggcaggacagacagggtgaggaggatcacaaggtcaggagatcgagaccatcctggctagcacggtgggaccctgtctctactaaaaatacaaaaacaaaattagccagggtggtggcgggtgcctgtagtcccagctactctggaggctgaggcaggagaatggcatgaaacgaggaggcaaagctagcagtgagcggagatcgcaccggt

SEQ ID NO: 650168 - DNA, 525 bp, Homo sapiens
  misc_feature (23)..(23): n is a, c, g, or t
  misc_feature (34)..(34): n is a, c, g, or t
tgcggtggacatgcggtctgcantactctgaatnattgtcaacgtgatgttgcatattctcctcaaacttgtaggcaagatagttcatcaccaggaggaagtattgatgatgggttttggattttaggaaaaagtacacccttgtttgtgaaatgacatgctgttcctcagaaaaatggcctttaatcagttgctacatttttctacctttcctcattttaactgccatcattggtcttaaatggaacaaaatgaagggattttgacactgagcaaaaagtgtaagtggaagaagacagcagtagtagcagcaacagtaacagcagtagtgacagcaaccagtcatagagtaactacatgataacatcaaaagccataagatagagaaaggatattaccaagaaacttaccattaactggcttgattcaacaatgaaaacaaaaatcgccttttttctcctttcattatggcttaaagctttcaattgcacaaacaaaataaattatatgacaggaagtaaaaaa

SEQ ID NO: 650169 - DNA, 96 bp, Homo sapiens
ggctaagatcatgcgccacagctccaaggggagccaccagcctccatggtcacctcagcaggcgctcgcccaccgcggagtccggccgcggtccgc

SEQ ID NO: 650170 - DNA, 583 bp, Homo sapiens
  misc_feature (23)..(23): n is a, c, g, or t
  misc_feature (34)..(34): n is a, c, g, or t
tgcggtggacatgcggtctgcantactctgaatnattgtcaacgtgatgttgcatattctcctcaaacttgtaggcaagatagttcatcaccaggaggaagtattgatgatgggttttggattttaggaaaaagtacacccttgtttgtgaaatgacatgctgttcctcagaaaaatggcctttaatcagttgctacatttttctacctttcctcattttaactgccatcattggtcttaaatggaacaaaatgaagggattttgacactgagcaaaaagtgtaagtggaagaagacagcagtagtagcagcaacagtaacagcagtagtgacagcaaccagtcatagaggaagtcagggaccctgaatggagggactggctggagccatggcagaggaacataaatgtaactacatgataacatcaaaagccataagatagagaaaggatattaccaagaaacttaccattaactggcttgattcaacaatgaaaacaaaaatcgccttttttctcctttcattatggcttaaagctttcaattgcacaaacaaaataaattatatgacaggaagtaaaaaa

SEQ ID NO: 650171 - DNA, 1433 bp, Homo sapiens
  misc_feature (89)..(89): n is a, c, g, or t
  misc_feature (512)..(512): n is a, c, g, or t
  misc_feature (1024)..(1024): n is a, c, g, or t
  misc_feature (1109)..(1109): n is a, c, g, or t
  misc_feature (1153)..(1153): n is a, c, g, or t
  misc_feature (1165)..(1165): n is a, c, g, or t
  misc_feature (1196)..(1196): n is a, c, g, or t
  misc_feature (1203)..(1203): n is a, c, g, or t
  misc_feature (1214)..(1214): n is a, c, g, or t
  misc_feature (1224)..(1224): n is a, c, g, or t
  misc_feature (1241)..(1241): n is a, c, g, or t
  misc_feature (1249)..(1249): n is a, c, g, or t
  misc_feature (1253)..(1253): n is a, c, g, or t
  misc_feature (1340)..(1340): n is a, c, g, or t
  misc_feature (1382)..(1382): n is a, c, g, or t
  misc_feature (1426)..(1426): n is a, c, g, or t
cctcagaacctcatgggtagcagcgtaggagggtgagcgttaatccatgatgttcaagttgttttgccacaaccatgtttctccgtggncccgcggtcaaaacctcccaaattgctgtactcagccacccgcagggcggtctctttttctccaggttcacggggaacgtctcacccccatcaaaattcctggggtaacctgccgggggggaccctaaaactgttacagtttcacccccaagaggcaacctggtccgctgttgggtgaaggttacaagcaggaagggcggagaccaggggagtaagcaccttattccaccaaatgatggaagaaactgacttccaaatattatgggcttcatttttcggcacagtccgtggacattcccagcccctgttccctcccctcatcatgttggagtgtcccagttaaaagtgcactttctttcccactctagtgtgcgctacacaagggcagaatatcgcacgtccaattttttactatttcctgangtgcctggcacgtcatggacttatgattaaataatgtaattgaacaaaagaaggaatgaatgagttatcatagtatttagctttcttagtcagagattaggtttacttccctctgcttcctgagatttatctttcacttaattctttcatcggttaataacaaattgattatacttcctttcctctcaggactggctcagaataggacactctacacagagatctttctttctttcttttttttttttttaaggaaaagcatgcaggatcttattaatttaaaataatttctgctaacaattgtagggtataagaaagagtataacaagattggtaataacattacaaaatatataataaataaacaatgcctccttctaaggtctctgttttgttaataataatggtccttataggagagcaactgatttcttctgaaatgaaaagtggaagctctactaatttttggatttctgtcattccccccatcttttttttttcctgtgaagagnttactaaatgtctacagcattctgactcaacacttatatcacactttttcctctaatgggcagtgtgcttgtctgaggatgccanagcagaatggcagccatgcagtacgactccagccaaatgagccnaactggactttnttgtcaagacagtgtaagcctttaccatcgnatcttcntcctccccatntctgagcatncacaatgtcagacatanccggagantgtnaaacaccaatcaggcaggtctactataaggaacctgaatatggagagtcagtagtaaggaacagatacaagtacgtagtaagttccngaggaggatatcgacagcctacagtccaacatccttcgtatngccaagcaagacctacatatccttcagttcccggtctgctggcngtgtttc

SEQ ID NO: 650172 - DNA, 156 bp, Homo sapiens
gatccgacagcggcagttcacatgatcttcgaaatatgttgtccgtcattagcagcggtctctcttatctgactttactaatttcagatagagtcgcgctgagtcagccatggagagcaggttgttacagactctgacgccgtccaagcacagggt

SEQ ID NO: 650173 - DNA, 289 bp, Homo sapiens
  misc_feature (237)..(237): n is a, c, g, or t
ttgctgcggtcgatctagaggatcgcactttacgcaggcgtttcaccgaggaaaggatcgtatcgtatgtccgctatccagaacctccactctttcgaaccctttggtgatgcaagtaagggtgatgaactggtttctggtgggactgagggattatattcctattagaattcaacagagaaacgggaggaagaaccttaataacggtccaggggatcggtggatgattacgataanaaagaaactaggtggaggggtttaaggaaaaagtttgggctggcaatggtac

SEQ ID NO: 650174 - DNA, 546 bp, Homo sapiens
tctcccattttctctttcctcctccccaacccacccctttctctaaatgcctgtgctttccagttcttcttctacccctatggcatgagacctggaaatcatgatgagtttctccttgtttgtaaactgcctctgcaccggctgaggttgctcggccgtgggtggctcctggctggcaccctccggcgagctctgctccgcacccagaacgggggcggccacagcagagtctcgcgtttgaccagctactgcgtccaagaccgactcggtggaggtgccggcctcccgcaggggtgtgtagcccttattgctgctggatgggtcatccgactgggagctcccggagtcccgcctggtggggggcgagccctccagccgcaggggtggcgagggggaggcggccttggccagagggctggagtccgggtccgcactccccggggagggcgggggctcgggggacggcggcgcccggtagtccgggagcccgctggtgctgcggcgccgcaaggccgcgtacctgccggtcctgggcaggcggccgca

SEQ ID NO: 650175 - DNA, 510 bp, Homo sapiens
  misc_feature (24)..(24): n is a, c, g, or t
  misc_feature (32)..(32): n is a, c, g, or t
  misc_feature (37)..(37): n is a, c, g, or t
gggtgtgggtggtggggcctgaangacaaggnccagntgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagacagccatcgaatggccggctggggctgggcatttccagcgggacagtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacg

SEQ ID NO: 650176 - DNA, 335 bp, Homo sapiens
tactagaaagtcttacaccataagaggagatgtactccatacatacaacatttattgaccgatgtagtatatgtaaaacctgaatcaaggattgggggccgagcacagtgactcacacctgtaattccagtactttgggaggcaaagccaggcagatcacctgaggtcagcagttcaagaccaccctggccaacatggtgaaaccctatctctactaaaaatacaaaaataagccgggcatagtggtgggcacctgtattcccagctacttgggaggctgaggcaggagaatttcttgaacccaggaagggaaggttgcagtgagctgagaccac

SEQ ID NO: 650177 - DNA, 787 bp, Homo sapiens
gtgtgtagagtttttcgcgtatcagaaagactcctgtccttatgatcgtggtgagcaggatggttaagagtcttttccattctgatttgacttgtgtgcattttgcgcgagagaatctagtatagattctatcactggcgctttgtcttcagcttcttcatcacaaaaatcatcatcatcatcatggtcatcatcatcttcttcatcatcatcgtcatcatcttcaatcagcagcgagttctacttttgttctgtggaactttgcatacacctacagggacagaccgctctccagataaacttaagagtttcacatcctcctcctcttcatcatcagactgtgcatcctcctccacagctaataagtgctgtccaaaaatatgcagtggccgtgatccacacttcaactataagaccactggtggtgttatttcagagcccacaagggaatctgttgtctgtacacacattttcagagttgccagtgttactttaattgcaccgccttcgtaattcattgcctctgcttcaactatgtgcaactcatcctgtgcacgagcccataagctgaccgttcttagagatatctggtgctcattttcatcattatccaccttagagtgataatctttgtcggcctttagttcacagcagaaaagatagttctggggccacagggggctcatgtccatgtccatagaatcttccatcgggtggcggcacgcacttaggtagcagagaaggcggacgcagataaaagaacgctgctccagagaacagccgagca

SEQ ID NO: 650178 - DNA, 707 bp, Homo sapiens
cttctgcacgctagccacacgcgaggtcttcctggaggccatgaacgtggggcccccggagcaggccgtgcagatgctaggcgaggccctccccttcatccagcgtgtctacaacgtctcccagaatgctctacgcctgagcactccctgtctggactctgcccctagagtgctgtggaatgccatggtggcctgcaccgtgctttcctgcttgcatgatctgtggctgcgtgtggccagggccgtgagtcccgtggcatgagccttctggggcgctgcggggaactggagatcctctgtcgcccctgtgagctgagctggtctaggaaccacagactgtgacagagaaagtgtggcgaccagcccagaagaggcccaccctctcggtccggaacaagacgcctcagccagtggtctccccctcggcctattacacgcgtgcggcagccagggcctcgccagtgtgctggtgcagagcagagcaggcaggggttgggtgccgggcccgcagagcccgaagggtcgcaccccctagccctgtggggtgcatctgcggacccatggttgaagttcccagtgtcccgggttgtggaggctcgatcctttcttcctttctggccagcgatttgtcctcatctaaggccgtcctggacccgtttctgccaggtggcggcttgagcccggggacagtgcctcaaggctggtga

SEQ ID NO: 650179 - DNA, 665 bp, Homo sapiens
aagcagtttataactttttggcctcttatcacacgccctgtttcctttttttccctagagatgcttctattagtcttcaacagtatatgattatgataggcaatgcatgtgtaaagttaatatatcagaagacttttccccgagatcgtgtatgtatactctgtaggtcttttgatataactctgtatttgcaaccttggcttcactttttgcacaattattgaatttttcttccgccgagctttagagaaaaggatggcacgccgacagtaataagaaatgggtgattatcaaatacttttcctaaagctatagaaaaaatgcacatttcttttgtttatatattacaaatgctttaatcattatttactttcttcttgacagaatcgatcaggatcttcagctctaatatactatcaggaatgtcctccttaccttgatcggccccatctagcacaggagtaacgggattaattggtgtttgacatatttcttgatttcccagaatcctttcagaaacgttattcaaatatacagatgtactcttctggttttcgattaattgttgggactgtatatcggtagtgttattcccgctaaaacttgcagctggtatgttgttactatggcttggtgtgctaacgggtaatacggtatgtaaacta

SEQ ID NO: 650180 - DNA, 366 bp, Homo sapiens
atatagtatcccacctgtcgaacttctccaattcgcccttcaaatgtccctgaagccccactcagattctcactcacattgttaatttttgtcaccagagaaagaatagatccctgttcaccagaattggaaccgaggtcttgattcctcttcagcaagccctcattaaagaaagtttcaccaggtcctgccttgacccgggaaaagcccttttcacacaaatagaagtcaaatggaatatgtggcacaaggccttgaaccctctttgtgggctctcctctggaccagacgcgcacaccgcgaacgcggcctctgtcacccctcatggcgccttaacacgcgcactatggagaacctctcgtgccg

SEQ ID NO: 650181 - DNA, 235 bp, Homo sapiens
ttcgtactattcgatataactttttcaaaaggaaagagcgcttagggtgactaatacactgttatacagctatactgtacctaaatgaagaagaagaagaggaagattttgaaaaagaagccgaagcagcagcagcagcagcagcggcagaagaagaagaagaagaagaggaaagaggaagaaattttaccaaaaatttgaaatattttaaaatattttccctcctttgttttgt

SEQ ID NO: 650182 - DNA, 142 bp, Homo sapiens
  misc_feature (138)..(138): n is a, c, g, or t
aagatgacgagtgactggaaatggcgtataaacagagcgagcggttcacatatcagagatgtatgctggactggggccgagggcgctctcgcggcatgacagtagctacgaggcaagatacatcgcctgacgagactngctg

SEQ ID NO: 650183 - DNA, 297 bp, Homo sapiens
  misc_feature (7)..(7): n is a, c, g, or t
  misc_feature (78)..(78): n is a, c, g, or t
  misc_feature (230)..(230): n is a, c, g, or t
  misc_feature (240)..(240): n is a, c, g, or t
  misc_feature (275)..(275): n is a, c, g, or t
  misc_feature (294)..(294): n is a, c, g, or t
ggaaagnaggctccccaggccttactcagggcctcagggtccatgggttgggcagccagtctgggcccttctcagggntcctcatctccatcctcatcctctttccttcacagcatttactttggagcttcttttgtgacacaccattgtcaagtcatgatgaatcggccaacagccagcccttgccaagctgactgtcacagtcttaagattgggaaacttgtggtacnagattagacnttgaagagagcttagcagtgattgaggtggtgacntaaatatacagttactttnata

SEQ ID NO: 650184 - DNA, 434 bp, Homo sapiens
accaagtgcttcccgcaggacgggcgcatgcgtacaagcctctgtgcgactctgcgacttcatcgtcatactgatggttgttcacttgaggatttccaatcatgatcagccatagaacccgttactcgctggcccagtttctatcgatacaggaggcctccgcttccatcgcactcttcagcaaatacggtgtcgagcatttgtccctgtatccgtcccagttgctgacgggcatcatgaacatcgtgcgtgaccaagacgaccgaaccttgctgctggtgctccaggaaattgttgcaacgcccggcaatctccgtgccaaatccacgcaatgccgtgatcaggtcgtcttcaacaggtgccgcgtcagcgatggaagggtccgcctgcagcaacttcttgtcctgcgcgagatagccgtcgatcagcaggca

SEQ ID NO: 650185 - DNA, 1464 bp, Homo sapiens
gcgagcggacgcggcagcgcctctgtctcgcttttcttatttttcccccctttcccctttcttttattattagtttcctttatcctttttcatcccactataccaacgcaattgaaacaaatatccacacatcgagaagagacaggcaaataacaaagggagcacgcggacacgaagcacacggaatatgaacgcagcacagacagtaagctaacagaacagcaagcaagagcgcagaagagcagcgaagaagacataaataagcaagaacaacagcgagcagcaagacaagagacgaggaacgcgtcctaaacagagagcgagaaacctaggcgagagcagagacgacgcgacgaagaagagaacacgacacaaaacgcgcgcgcagcacacaacagagagctagcgacaaacaacagtcgagcagcacgaacacaccacgaggagacaactgctacagcaacagggccaagactgagcacgccaggccagaccgcggacgaacggcagcagaggacagcagcagagcagccacagacgcgacgagagcgctagccgaacgcaggacagctcgccaaagaacaagagccggcaacacacgaccaaaccagatagagagcgcaacacaccgaacaccagaagcacagcagaacgaccgcgaacaagaacacggagaagacacgacagaacaaacagaaagagaagcgaggagagcgccggaggccacgaacgacagaacgacgagagccgaggaccgaccgaaacagcacgacggatgctggaagcgaaggagcaacagaacggccaacagcgaagagaggcgggccacgacaagaagacgcaacgcgaaaaagtaggatacacagagaccgaccgaaggaagaatcgagagcaacagcaaagacgagagggaggagacgccggacaagaaacgcagcagaagaagagaccaggggaagaacgaaccgcgaacaacgcagacgaacacgaacgaagacaacaaaacggaagaacagaagccgacagcaccgagcaccgagaacaggaagcgaggaagaaggacgaacgacagaacaggaagcaacagacacgagggcacagcggacccacaggggagacgaagaaacggaacggaaacgcgaagacgatgcggaccaacgagaccgcacgaaggacagccagccgaacgtccacacggagagagagggagagagaaagcacgaaaacagaaaggggagagagtggacaggagagcaacgaacggaggaggagcgaggagagaggcgcgtagagagggggaggcgagaaacaaagagagccgaagagcgggaggggggcgccgcgaagaagcagagcgtacacgaagggcgagcgagggagagcagtgcagaacaggcgagcagccagacgaaagggacacacgcgcacaaccgagagcaagaccggggagcaggcaagagaaca

SEQ ID NO: 650186 - DNA, 249 bp, Homo sapiens
ggaagaagggtgttcaaaactgtttgttcaattggcccttttagtttaggaggaaaaggctggttaatgaaaacaatggcttggtaacccttcgaaggaaaggggaatgttttgggggcccctttggttttttttttggggggggggggttttaagtttttagtttttaaaaacgggattttttaatgggaacaacttggcccaaaatttgttccagaattttggggcccctttaaaaagtttaatgga

SEQ ID NO: 650187 - DNA, 187 bp, Homo sapiens
gaggcaggaggaggtggacgctgactgctaccatcacagatggcaaggttgggcagagaccaaggaagctgcaggcttgggtacggtggtgagggaagcctggtggtgccaggcccaaccgttggcatttacctaccttggcaccagccgtgcctcctctgtcacgttttcgcggtaccgacgctcg

SEQ ID NO: 650188 - DNA, 131 bp, Homo sapiens
gagaagagaagaagggggaggggatgaatggtgttggttccctgctgttgggcaggctctgagatctcagcagaagaaatgaaagctggaaatagggagggaggaatgttcaagcatcggtgaactccatg

SEQ ID NO: 650189 - DNA, 168 bp, Homo sapiens
  misc_feature (30)..(30): n is a, c, g, or t
  misc_feature (73)..(73): n is a, c, g, or t
  misc_feature (120)..(120): n is a, c, g, or t
  misc_feature (154)..(154): n is a, c, g, or t
tggcagccgtgaagctggagtccgagaatnatgagtacgagcgggcccggaggctgctggccaaggcgcgganagtgcccccaccgcccgggtgttcatgaagtctgtgaagctggagtnggtgcaagacaacatcagggcagcccaagatctntgcgaggaggccct

SEQ ID NO: 650190 - DNA, 192 bp, Homo sapiens
tgcgtgtcatccttgagtcgtatacattctctatcatgtgtgcacgggattccagacctgtccacttcttcaaggggtgaggtcctgttaccataaccatcatctctattttattagcatgtttgtcctgtctctggttgtctagtaggacaaaacaacatcatcagtatgtaaagaagacttttccctggg

SEQ ID NO: 650191 - DNA, 391 bp, Homo sapiens
  misc_feature (3)..(3): n is a, c, g, or t
  misc_feature (25)..(26): n is a, c, g, or t
  misc_feature (82)..(82): n is a, c, g, or t
agncgacgcggtcaaaattaaaaanntgtattgagggatactataaagagaacacagaatgggagaaaaatatttgcaaatnatgtatctggataagggattaatggccacaatatatgaagaactcctaaaactcagcaacaaactgattcaaaaatggggaaaggactttaatagacttttctccaaagaggcacaaatgaccaacagacacataaaaagatgctcaacatcacaattactagggaaatgcaaatcaaaaccatagtgagatactacttcacagttactaggatggctgttatttaaaagacaaaaacaaaagcagaaaataacgtgttagctagcaagtggagaaattaaaacctttgaaccggcggtcgcggcgtgc

SEQ ID NO: 650192 - DNA, 611 bp, Homo sapiens
  misc_feature (26)..(26): n is a, c, g, or t
  misc_feature (29)..(29): n is a, c, g, or t
  misc_feature (31)..(31): n is a, c, g, or t
  misc_feature (40)..(40): n is a, c, g, or t
  misc_feature (44)..(44): n is a, c, g, or t
  misc_feature (46)..(46): n is a, c, g, or t
  misc_feature (52)..(52): n is a, c, g, or t
  misc_feature (56)..(56): n is a, c, g, or t
  misc_feature (58)..(59): n is a, c, g, or t
  misc_feature (64)..(64): n is a, c, g, or t
  misc_feature (66)..(67): n is a, c, g, or t
  misc_feature (83)..(83): n is a, c, g, or t
  misc_feature (87)..(90): n is a, c, g, or t
  misc_feature (93)..(93): n is a, c, g, or t
  misc_feature (95)..(95): n is a, c, g, or t
  misc_feature (97)..(98): n is a, c, g, or t
  misc_feature (106)..(106): n is a, c, g, or t
  misc_feature (108)..(108): n is a, c, g, or t
  misc_feature (115)..(115): n is a, c, g, or t
  misc_feature (121)..(121): n is a, c, g, or t
  misc_feature (133)..(133): n is a, c, g, or t
  misc_feature (137)..(137): n is a, c, g, or t
  misc_feature (139)..(139): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (182)..(182): n is a, c, g, or t
  misc_feature (184)..(185): n is a, c, g, or t
  misc_feature (188)..(188): n is a, c, g, or t
  misc_feature (226)..(226): n is a, c, g, or t
  misc_feature (229)..(229): n is a, c, g, or t
  misc_feature (243)..(249): n is a, c, g, or t
  misc_feature (266)..(266): n is a, c, g, or t
  misc_feature (322)..(322): n is a, c, g, or t
  misc_feature (327)..(327): n is a, c, g, or t
  misc_feature (332)..(337): n is a, c, g, or t
aaacagcccgtattggaattttattnaananaaaaaaganaatntntgtcantgcncnnaactntnntaattgatggcacttncagnnnnggngntnnaaagactntntaaacanaatgtncacaagaaactnagtnancactntaaaccctntgattnggngccctccatatggcaagacncnnctnaaatttagacaataaactctctggaaaatttagcttanganaaagaatgatatgnnnnnnngtagataactcaaaaanaacaatttccttcaatatgggattttactattctaaaacaacagtccagtcttcanataanatggnnnnnnttgagaggagaaattcagagaatgaaattttcaatcatatcaccactgtagcatgacgttatttttttcataattttcatgagcagtgggattggagatgtcggaaaacggtgggaaaggaacatactgcatgatttgtggatagtaccaaacagcataggggtaggcagcaagttggttgagctgctggaaagggtgtagcggtggaggattaagagagtcgtcgcagctagcccccccccccaccctaaatattgttgttgaatgttaatat

SEQ ID NO: 650193 - DNA, 501 bp, Homo sapiens
tcattcactcagttcacacaaaaggtgttgggcaatttctacaattttgcttcatcatttgctgtttttcaggcccaggtggccccaagcccatttgaaattttcattccggcaaatgtggttttgaaatggtttgaaaactttcaaaggcggcttgcacagaacccttttttttggaaaacctaatttggataaaataatttttaatgggttttgaaatttgtcatgttttgaaggtaactggctccatttaaaagtttggggtcaaaggatcccgaaacctaagtttaaaaactgctttgggactgaagcttaattaaaaattttttttaaaaatttaaaaccttggaaaatgaaaattttttcctcattaaagacttttttccccttaagcttaaaattcccttcaaaggcaagacattttgttttggctttgattcattttttttacttaaaaataaaaccttttccaaaccgttgtgttcccagttaaaaaaaaaa

SEQ ID NO: 650194 - DNA, 664 bp, Homo sapiens
cgaagaaatatgcagactgtgcatcgttattgaagggggggctaatttcgcccaatcttttttgcaaagcatctaaattttcactactaatgtaatgtgatgctaatccgagcatataagcgtctgctccggtaactatttctcctgtgagacatagatacagagccatctgtgagtttgagttagctactgtcacaattctagggagagcaaaagttgagcctacatctggaaaaaatccaatgtccatctcaggcatggcccatttggtgttttcagtggcaattctaaagggcgtatgaatagacaagccaaccccgcctcccatggtgataccgtccatgaaagtaacaattggtttcaagtaagttgctatttgaaaattcaaagaatattcagcagtaaaaaattcgatagatttgttaaactcttgcttgatattgtgtgttgccacagtagccacgtcaccaccagcacagaacgaacgtggtccattggacgactttaaaataattaagtttgtagtgccactcttggcatactcattcaaggtcttgaacatggattctgacatttcggtattcaaggcattgagcttgttgggcctatttaaagtaataactctagcggtatcctgagctgtaaatagcacaggaggggtgct

SEQ ID NO: 650195 - DNA, 171 bp, Homo sapiens
tactcgatatggagggtaggtcgtgtcaagatagcagcagcaggtagtcagggctcaagacaccaccccctccagcttcttggggcccaggagcctctccactgctacagtggggtgggggtacctagcacaagcaaggtaggtaggaggttaataggtactatgtaaccc

SEQ ID NO: 650196 - DNA, 1444 bp, Homo sapiens
  misc_feature (1367)..(1367): n is a, c, g, or t
  misc_feature (1370)..(1370): n is a, c, g, or t
  misc_feature (1374)..(1374): n is a, c, g, or t
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgttgaaaatcctggggtcgggggtggcactgtgagacctgggctctggtgcgtgcgttcatcatccggcgttcgctgcgaggnggnccgngcgtcccccaggagccggtgccgtggagggggggccgggggagtggtgtgaatcaccaagggaggggtcc

SEQ ID NO: 650197 - DNA, 149 bp, Homo sapiens
aaaactaactcaccgtttacctgcctacatttcctgtacatcgcatggattacaatttcgaaaatacacctaaatactggtgtgctaatgatccagcaatgacacattatttcaccggactctcaaccttatttccagaaggtgaatct

SEQ ID NO: 650198 - DNA, 120 bp, Homo sapiens
gccttactaattttgttttcttttttatagagacagggcctcactacgttgcccagtcagatcttgaacctcctgggcttaagtcatcctcctgtcttgggcctccaaaagtcctgggat

SEQ ID NO: 650199 - DNA, 2787 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650200 - DNA, 1371 bp, Homo sapiens
  misc_feature (1294)..(1294): n is a, c, g, or t
  misc_feature (1297)..(1297): n is a, c, g, or t
  misc_feature (1301)..(1301): n is a, c, g, or t
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagttgaaaatcctggggtcgggggtggcactgtgagacctgggctctggtgcgtgcgttcatcatccggcgttcgctgcgaggnggnccgngcgtcccccaggagccggtgccgtggagggggggccgggggagtggtgtgaatcaccaagggaggggtcc

SEQ ID NO: 650201 - DNA, 155 bp, Homo sapiens
ggtccttatcaagtgtcatatgcaagtggtgctccttaatcttaacatgctgtcgtcatcttcaagttgcaattgtgttggtatagtgaatcgcaatgggtcgactactgacatggcctttgcttaccatgatatcggggtatatgttagctggt

SEQ ID NO: 650202 - DNA, 2433 bp, Homo sapiens
  misc_feature (12)..(12): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (31)..(32): n is a, c, g, or t
  misc_feature (35)..(35): n is a, c, g, or t
tggctaggtacnaggctngtnnnannnnggnnggncgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650203 - DNA, 1296 bp, Homo sapiens
ggcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650204 - DNA, 359 bp, Homo sapiens
tctgacacatagaatggggtctcctcctccgtgggggtcgaagaaggtggtgttgaggttgcggtctgttagtagtatagtgatgccagcagctagtgactgtgagatgatagtgagaaagtaggactagctgtgatttaggacggattcagacgaaagaggggcgttatggtatttgggtttatgtgcaggggggttttatatttgataatttgtttgtgactgaaatttgatgtggccctaaagatatgaggagacaccttgctaggttgtaaaggagacagatgtgttagtgtctactggagtgctccagggcttgggagtagtttccctagctaaggggagtggtagacttgttc

SEQ ID NO: 650205 - DNA, 2672 bp, Homo sapiens
  misc_feature (12)..(12): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (31)..(32): n is a, c, g, or t
  misc_feature (35)..(35): n is a, c, g, or t
tggctaggtacnaggctngtnnnannnnggnnggntgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagataggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650206 - DNA, 619 bp, Homo sapiens
  misc_feature (345)..(345): n is a, c, g, or t
  misc_feature (508)..(508): n is a, c, g, or t
  misc_feature (593)..(593): n is a, c, g, or t
  misc_feature (609)..(609): n is a, c, g, or t
tttgagacagagtttcactctgattgtccaggctggagtgtaatgatgtgctctcggcccaccacaaccttcgcctcccaggttcaagcgattctcctgcctcagcctcccaagtagccgggatcacaggcacccgccaccacgcccagctaattttgtatttttagtagagacagggtttctccacgctggtcaggctggtctccaactcccgacctcaggtgatctgcctgccttggcctcccaaagtgctgggattacaggcataagccactgtgcccagcctgaagtattttaaaaaatatttttaaaatactgttcttttttttctcctcttaaaaaaanaaagaaaataatgggagtattttcctccctaatatggacacatttaatattttatttatttttaggtttataataattcagggaaaaaatctttatcttttttttttttttaagaggtctcactcttgatctcactcttgttgcccggttggagtgcaaggcncaatcatagttcaccatagcctcaaactcctgagctcaagtgatcctccttccttgggcctcccaaagcatggggattacgggtntgagccactgcacccngccttttcca

SEQ ID NO: 650207 - DNA, 2386 bp, Homo sapiens
agcggcttctgccctgtcaggtcaaagcactcagcagggccacctcccgcacccctgctcacatctcctgccaggccccctcactcccggcctccccaaagcccacctctgacatgaagcttccctgagctgagcctgcagattgggtttcttgtgcctgtgggatgtcctgtggtctttcctggacagtaagctctttggtaccatgtcccctcctgtcccctcttgtgtcacccagttgggcctcagcaggcccttgggccccctatggcagtgggtggggggaccgtctgctcccacctgggacctgtgctcagtcccccgcccctccacagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650208 - DNA, 127 bp, Homo sapiens
gaatccggggatgggattggacctacagatataggtggaggaaacctcaagagacagggaggaatggctgagaggatggaggctttcctcgaatgctcctgaggcaacagaggccttaggcgttcag

SEQ ID NO: 650209 - DNA, 556 bp, Homo sapiens
gagcgagctgagtggttgtgtggtcgacgtctcggaacacccggtagcgcttgccagccatgggctgaccaaactgcactgcaagcagccagcattgccgggggattccaaagcacagcctttcttcccaacctatttttgcacaaaaagcatgggtgcatggcacactcatacacaaacaaaggcacattcgcgcgccaactcgtcaccatgccagcatcctatcttgcggcgccaagcacaatccccaaccagcaacagccagcagttcaccaggccaccatcgcgatctcacattgcgacagtcaagcattgggcttgccaatggggcttaacatgggggcaaccaaacattgtggggccaacctttttcccccgcattgggcaatattttcttcctttggcaaccaacaaatggccattggcggacccacaaggcaacccaccacaattggcgacacaaggcaaccaacccgaggaaaccaagggttggccacaagcccaagcacacacattttccagccaggcaaaagccgcatttcccggactgcgctgg

SEQ ID NO: 650210 - DNA, 138 bp, Homo sapiens
aacatgaaccgtcagtacctgaagcctgatgccgtcctgcacctggcatctatggggccaaagctgtgctctctctaccaccatgtgcactctacgtctgaactcccagagttactctgagcaccagcccagttcctg

SEQ ID NO: 650211 - DNA, 1950 bp, Homo sapiens
gaagtccggggatgggatccatttctcccaaatttagcctgttggtggagcaacacctgttttctcatcagtgagatgggatgacaggtttgtccgctggctgtggccggctggcccctttctcttggccgcagcaagcactggggtgaggctgcacctaacggccatgtctcactaacagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650212 - DNA, 1298 bp, Homo sapiens
  misc_feature (1298)..(1298): n is a, c, g, or t
ggaccaagagcaataaggagatcatgtcagtcacatcatgaaaagatcttggggaacgtaatgatgcgaatagccctcagggcaagaggacggaggataaaaagtcagtctttctcaccacagcccaatcttcgtgcccgtcgcaaagctactgcgctgcgcgcgtagatgcatctgctgaagatggtaccgggcaggtgccgctgccccagtcctgggtggccaattacccaaggcaggatgagggggaaggtccaaagccgcgtctgtaaagctcgtatgcccatggaactaagtgcccagcggatcactgctgggactgcgggtgatggtgtctgaccagttgggtgagattggaattggtgacttactttggtcgccacgggaaagccgccatgcgtttctgtccctggaagatctctggataatcctttagcattaaacaggactttacaagcaactctgtgtagagaggatgtgggaagaggcagggtcgtgagagcgtagagctgactatatagatgaatagtcccatgctctgcgtggtccaagataaaacggcgattccttaatagcaagcttgagaggtgtatcgtaggtccgatgtgaagacggaaggcctgtgtatcaagaaaggcttggggctgagacggttacggacaccagactgttgactacctgtattgggacctagcgagccttatatgcgtctccgctggcttcgaatcgacctctgggctcatagtctggagcaacaatacggggctgcatggtggtttgagtatggggcaaagcaaatgatctggtgcgattcggaaggtcgtgataaccgccctccgagtcaggaacctttgagaggcactcttgcagaagctccaagagggcaaaccatcgggcaagtccacacattcttacaggacacatggattaccttgacctgaagtgggggcacattaacaaggagccgaaagatgtaaggtccccccagagggttagaagaccaaagactattaagaaacgtacagtgtaggacgtcaacgcaagagaaacccaatgtccagcccacaggtgtccattacagagcagagttatggacagaggcgaaataataagccacacaaaagacacaagcgaagagcaggaagaaatacaattttcacttaagaacacacagagaggagaacgacaaaggcgcggacgcagacaagaccactaagagagcgaaaaacaggcgagaaagaatagtatagtgcctacgctataggaagacgtacgaatgaatacaagcagaacagagn

SEQ ID NO: 650213 - DNA, 3171 bp, Homo sapiens
agcggcttctgccctgtcaggtcaaagcactcagcagggccacctcccgcacccctgctcacatctcctgccaggccccctcactcccggcctccccaaagcccacctctgacatgaagcttccctgagctgagcctgcagattgggtttcttgtgcctgtgggatgtcctgtggtctttcctggacagtaagctctttggtaccatgtcccctcctgtcccctcttgtgtcacccagttgggcctcagcaggcccttgggccccctatggcagtgggtggggggaccgtctgctcccacctgggacctgtgctcagtcccccgcccctccacagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgccggggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtggaaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650214 - DNA, 273 bp, Homo sapiens
ccaaaacagagatatagatcaatggaacagaacagagccctcagaaacaacgccgcatatccacaactacgtgatctctgacacacctgagagaaacaggcattggggaaggattccctatttaataaatggtgttgggaaaactggctagccatatgtagaagctgaaactggatccttcctacaccttatacaaaattattcagatggataaagacttaacgtagactaaaccataaaacctagagaaactaggcatacattcagacatgg

SEQ ID NO: 650215 - DNA, 314 bp, Homo sapiens
  misc_feature (105)..(105): n is a, c, g, or t
atatatcacatgtgcattacaatttatttcataattacactatgtgcatttgctaattcctccacttaagttatcttacattccaatacattgagagagcaagantttcccttgtggaagctagagtaaattgcaagtttggaattgcaagtttggaatttctgggttaattagatactagtagtgaaaaggagacacaaggcttatcaatgcgctataggaacttcttactttaaaccaatccaatatacagacctttgaaagtaaaagatcaactgcacagatattttttaactaaaaggaatgtgtccagt

SEQ ID NO: 650216 - DNA, 793 bp, Homo sapiens
  misc_feature (225)..(225): n is a, c, g, or t
gacagagtccttgctagggggttcggggagcgcttggaccccggttctgggacgcgtcaggagaagggagcactggtttgtttcatcaggccaaagatgcctttctttgggaatacgtcagtccgaagaagacgacctcctcggaagtcggcatctctctccaacctgcattctttgatcgatcaacccgggagggtggagctggggtggaatacggatccccgnatatgaacctggcagggaaaagcctgaaagtttgaaaaatggccaggtggatagcagagacaggggttcagtgggcggtgtggacctggagggaggtgcagcgccttcgcggggcggaaccagcagttgtggtcgggaggaagaacgaatctctgtgcggttgaaaaggtggacatctaattagaacatggtgtcagagtcccattgttgaatcgcaattaatgggggacaaggaattggttgggaaatgaggatcagccgggacgacgaacaattgaaggacgccgcagaggacatttatggggggcacgaaggaatgggtggcgaagatggcctaacggtcggccagaggacatacacgggactaccaggccccggaagcagcgggcacctccagaaatatgggaggaccccacaagtgcatgggccaccccttgtggttggccaactccacagggtgcccgtggcacggcgagaaaacccatagattccacactggcggattcgtacactcacaagcggctccaagatgcatgccgtggggcgcccgcctgtgaacacaaccggg

SEQ ID NO: 650217 - DNA, 1760 bp, Homo sapiens
ggctcatggtgatcctcatcactgcactctcccgactaccgcggtaccacaggctcgtgccatgatgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagcgttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacgggggggggcggggcctccacctgtgacagtcaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccggagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaa

SEQ ID NO: 650218 - DNA, 561 bp, Homo sapiens
ttaccttttaaacaacagaaatcattcttcacagttctcgaggcgggaagtcagaagcaagacatcagcagatggggggtcgggggagggcccaacggccagcttctaggtcctcacaggagggaggggaccaggaatctctagggggtctcttctaagcacattattccattcacaaggagtccaccctcatgacctaatcccctcccaggggctctaccttctaatacagtgaaaccagggagggggattggagcatatgacttgggcagagcagggaacacaaaagtatccagcccatagcactagggtgcgggggtggtggccctccaagccttccaaggcctccgtccagaactaggtttgccagggtgatgcaggatccggtggcgtggtaatgtcaccaacagtgcagacccgggtagagaaccagggaatagcagggctcatcccaggcctggcattctacctccctaggaccaaaatggccagtagagccccaatcggtatagcagagaatcgccttagatggggaacccttatctaactccagctccaaaa

SEQ ID NO: 650219 - DNA, 237 bp, Homo sapiens
cttccgcggaggctgtatcgccacgaccttgacgcttcttcccttagctacgacggagggggtctccatccctcgcccagctctcgttggtgggcacggtgggtggcttttttcgggtcactggcgcacctctctcattccagcccactgctcgggttcaatcccggctccaggctccccggcaggcggccgggccattcccaatcgtcccacacacctccaggcatagttgcgggg

SEQ ID NO: 650220 - DNA, 164 bp, Homo sapiens
cctacgccggttctcgttggagacctgcctaatcatatgatattggtgaagtatctcctggagcccacttgaatatgatcggtggagccaagtggaacagtggaattcgacgcattgtgtgtgcacatttgccttggtttagctggcaaaacctgctttcatgg

SEQ ID NO: 650221 - DNA, 172 bp, Homo sapiens
tcttaccgaacgaggcagtggtgggcacgacggcttgcgggctggctcacacagaagcacatcgaccgcttggtgggtaaagccacccatgtcagtgtgtctgttgtcatggtggaggtggacggcacctgctactagagccgggccgtctgtccctagcaatgcctcgtgg

SEQ ID NO: 650222 - DNA, 998 bp, Homo sapiens
cgggggggcttgtgtgttcgttggcttgtttgccagtgaacggtagatgtgggtggggagaagacacaaggcagtttgttctggtctagatgagatgggaacccaggaattgtgaggttacgcaggaatatctttagggtgagtgaggttttccttgagttgggcaccctgttgtgagagtttcaggaatctttggccagcaggagaataggtggtatgtggagcagactagtcggcagaatggaaggaggtggaaaaaaaccgacaccgggctgacttccacctcccagtggtgagcagtggggagcccgaagacccagtttccttctacattaacggttgagtttagcccattatcggctctccctatttatcttagtggaaggggagtggggtccaagtgacagctggcatgggagaagccatagtttctcaccagtcagctagagatgtagccatctgggggatctgttgtggcttacagcaaattctctatgtataacaccggagtgaataacttcaggggaagggtggggagtcagccaagtgcctcagtgtgccctgttgaaacttagagtttatccgacgcaatcgtatggatatggtgtccctaggagagactgtgcatatttccgtactggactctgtcgaaaccatccatgatacgacgaaggatgctctattgcattgagctactgagcaggaggctgcaggcaagcttaagaaccgtacccgagtctcattctacgagtacctctattaccataccggtacagccacattataccttgcccgtcgacaggggcggaaggcgggccgacatttgagaacctgccgcacaatgacactaaaactaaccacaatctcacctggccacaacaaaaactgtgcacacacttctgagtcaagtacacgtatacacccacaacagcatacaaacctgcatcgactcccagctggataccagattaaggcgatcaacgtacatgcacttatcc

SEQ ID NO: 650223 - DNA, 107 bp, Homo sapiens
agatgctcagagggagtcaaaaagctagtcagtggcagactgaagacgtgaccaaactctggagtctcccttgagtacccttcctaggaggccggggtgctctaggg

SEQ ID NO: 650224 - DNA, 411 bp, Homo sapiens
gtaacttccaagactgacagctttttatgtatcagggtttgataaacccagtccttaactgaaggtaaaccaaagcatcacgttgacattagaccaaatacttttgattcccaacaactggtttgttctttttccccttttgggctttcccaaagtgagaatttttaaaaagacttcttgcttctctccccacccatccttctttttttggccttttacaggtgaatgttgagcccccaatcaacaggggttttattttttcctctactcaaagttaaaactgcccaaagttacgggctttttactttgctagaacaacaaactattttatgtttacaaactggtttccaatgttatttatgggcaaattgtcaaaatgtaaattaaaaataaatgttcatgctttcccca

SEQ ID NO: 650225 - DNA, 431 bp, Homo sapiens
gcgattgccagaccatgcgtggtgaagtgaacagcaccctggggacagcggcatacatggcacctgaagtcatcactcgtgccaaaggagagggccatgggcgtgcggccgacgtatggtgactcggcgtgtgcatgcacacgccgagtgaccatactgcacacgccgaggatccacaccctcagatcactatgcagatcgggggcaacaacttcgtccattctgacttgcaacaacttcgtccattacgatctgcaacaacttcgtccatcctgacctacttcaagaagtgtgtggttactcggcgtgtgcagcaacaacttcgtccatcatgatctgtcaccgcggtggtatggtctggagactcggcgtgtgcagcaacaacttcgtccctccgacctgcctgaatgtttggtcattcggcgtgtgca

SEQ ID NO: 650226 - DNA, 1263 bp, Homo sapiens
  misc_feature (345)..(345): n is a, c, g, or t
gacgccatttaagccccgcctttgcccatggacctcttcgcgcgtatagcatgatctcgttggtatccctattcctatgccctcgtttcctggcccacttgggtaggaacgcgtaaggtggacaaccttggttacaattgtttgtttgctaacgctcttgtggtgcttatctaccccagctcacctattgctatttcaacacgtggtgtatgtcgtcaatcatctgtcgttataatctgtttttgggggttcccatggggactggcggccaaaatgcaacccgcaaaactatgttatgtgttccccgagtctgttatcctgacgcctaatggttgtaatccaaantgtacatcctgctatggtcggttctgtgttgttttcatggtaatgctttctagagggctcttgaagcctactagagtggaatcgccaacggtaactaccctagccgttacctgcccttttcggtcgtgagcactggcttgtggtagccctttgttgctcaacggacccaaaactcgtccgcgtcgtgttcgaaaaaggtgcttcatgtgtgggtataatgccaaacttggtgcttccgctggagggtgccaaccgcttggagatatgaaagctgtctccaacccgcttgctctcatgaacatccttgggcccctttgggggcgctttcgacctagaaagtctacacggcatagaaatcagaggcttacttcacgtgcttggcgtaatttgtgctctcgatcggaatctgcgctgagaccgctgccctggcccccgccatgccacgcgcctgtgccgatattccaccgtgccagcctccaccgtgccgcccgtgccacagaggggagacggtgagcgcccccgtcaccttcgcactccgccaccttgggggctcgggggggacagtctggaaaggagggaccaccgccaccccagcagctgaaggaggggattctggaacatgaagggcgacttcgggattcatgagtacggcacgggcgtcagcatgcactcacgtgggacgctgggcgtacccgaggacgggatatccaggaattgaggggcacgacaggatttctgagcaccaggggcagaggaggccagagcaacctcagggaggagatgatgacctggcgtcccagtccatacaaagggcatgggcccgactccgagggggcagagagaggagaccgtcccaacccccggcagtccaacctgccccgtcgacttgccatcatgcctcggtataaatcagttaat

SEQ ID NO: 650227 - DNA, 204 bp, Homo sapiens
gagagcagaagcaatatttattgtgaagactgaaagaacaaagctttcacagcacataaaggaaactaagcaggttgtcgctgcaggctggtggggagcctggcggtgccaatttttatccccttttttggacccgtccacttcctgctgactggccctttttacattaccattgattgtgccattctactgaacgctcattag

SEQ ID NO: 650228 - DNA, 140 bp, Homo sapiens
gctgctctggcctccggcgggtgtccagaagccccatcgggggcggcctgggacaggggctctccgcgagtattcgcctgctcccagacagtccaccgacgctgctgatcagaaacgctgcctatacacgcgtcgtggtg

SEQ ID NO: 650229 - DNA, 256 bp, Homo sapiens
ctccaggttgataccaatgctagagtacgatcatgtggattgagacatatttgcactcactatatctaatacccataactgtgatttgctaccccactatggttaaccctaaacctcatcagttaatgctacaggtgtgctcgtgcgcacagtacgctccagagctaagaactactcacatcgaccagtcgatgtgttcatattcctctataggagcgtgttctgtaatcgataaaccccgatcaacctcagcacg

SEQ ID NO: 650230 - DNA, 514 bp, Homo sapiens
agccccggggtccaaccaagcttccttggacaatggccaaaagttgcccccgagcagggcccccctctgcagtgactcaatgatagggggctccatcaggaagtgttatcccgcctacagagctggccacgcccccccgctctttctatagactcccagtgtgtgggagaaaagaacccggtgttcttcccacactcttgttagtgttacaattggcgcccttggaggattcattcattatccaagaagctggtgtaacagacaggtccacacggttctcgtctctaaccgctctcccaatagacaaatgagccaaactatttttttgtagcacacccctctggttgtttttctttttgccgacggggcccgctctcttttgtatcgatgattgttgttaagaaccccacttttgtatacggcgaaccacccgtggccccaccaagtcttccgccacgacatttcgggagaccccccttccaaaaagactaagaacggatcaatagacgaaaaa

SEQ ID NO: 650231 - DNA, 454 bp, Homo sapiens
ccggaccccggaacagtaatggagcagcgtgcggaagcacgggtgggaaggtgggatccaggaagagggcgctggggacaaggagagggccctgctgaacgcttcctgacatggcggagtggcccattcattattcatccaatggtcacagagcaagactcacctcccacacctcccaggggcaactctgccgctgcatcaggcagcgcacacagcagcccggccgtcccccgttcaggtggcacacagcagcccagccatccccaccacagggacctaaggcccaggcactttgtggagcgcccagcctacaagacttcagcgcagacagatcagggccccaccaatgcagtgacagggcagggaagccctccaaagccaggcctggggacaagacactgctctgggcctggcccaggcacagagcactcagtacctaaaacttcgttttctg

SEQ ID NO: 650232 - DNA, 226 bp, Homo sapiens
cgttgattcattggtagattgatttaattcttttgcttgaaatttgggaacttatttgaatagaataggattgggcagggattttttagatacaagtggacccacactagaaagaaatattgtttattgcctaagaagctaaggtacgggctgctcaattgaaactccttgacaggaatatactgttatctgtgcgcaaggaaaaaagaatgtatgtatttggtgc

SEQ ID NO: 650233 - DNA, 1033 bp, Homo sapiens
gcacagcatcgattgctggaggtcaggcactgtacgaggatattgccaaccgcatccgggctgaggctgatagccatgtaccatatcaggtatgatggagcctgcagatcctggctgtgatgcacgggccatgacctgcggacgcacaaaggacttgaggatctctgagatgaacccggaatacatcaagcctggacgtccaggcgtgatcatggagggcctgcaaaagtgcctaacaggggttttgccctgtgagggcggactatagcgagaatgatagatcagccgttgagaagtagcgtgggcacatttgaagtgtatggctaagcgcctgggttgtgcgagcatgtaggccgtgctgtaaggtggcgccaagacgggcactatgggggcggcagacgtgctgttgaagtccccaacgcagctgatgtacttgctcagatgcttggacccttggaacctgtcgtatgaatcgcctagcgcttacagggaaaggctgaccgctaaagtgtcagcaggcgtggtcctggctggaagtcttgtgggatgccgaaaccatggaaatacttcagtacttgagagaaacctacctaacagtgcctattgcgaggtggttcctgcttacttcgagtccctaattgtggggtgccctccactaaggctccggttccgtctacgataacaaggcttggggactcctcgcttcgggtgtccttgaggaactgaggtggtccgacgtgtcctttcaaggcgccacagactcatccaggggccgaggttgtgtaaggagggaatcgcaggacccgcttaattgggaaagctggcgctatgagtccctctgaccgtgcggcccagttgtaccagcttggggggaaaccctccattgctatcccttctttgtaatgtgcccaaactaggcgaggaaagaccgtattgtgggggatgcccttcgcacggtgagacgccccaggggggtatccatactacaggcacgggggatataccccgacccctttcgtgtcctctcaaaaat

SEQ ID NO: 650234 - DNA, 114 bp, Homo sapiens
tatgtcagtacagtgtaaacatctgacgcaggcttatgcggaggagaatgtaaacatgtaacttatactaacattagtacctgccgggtgacacgtctgggtaccgcagctcga

SEQ ID NO: 650235 - DNA, 514 bp, Homo sapiens
cactcgattctcctgactcagcctcctgagcagctgggattataggcatgcgccacacacacggctaatttgtatttttagtagagatggggtttctccatgttggtcaggctggtctcgaactcccgacctcatgtgatccgcccgcctcggcctcccaaagtgccgggattacaggtgtgagccaccgcatccagcctttttttcttttattacaacagtccttatgctgaattcagttatcttgaaatggtgaacaaccacagctgtggacctcaaactatgtacaaactgagcaatttttcttgtaatgttctaacttttctctgcctcttaggggaacttccagcaacactagtggcactagtgggtcccatagtattactcaaggtttactgtattgcactaaacacaatgaaaactatacaagaaccatgagagatcaatttttactgtgatacacaattagctggagagataaacactcacatggtgatgactagcgtcacacaac

SEQ ID NO: 650236 - DNA, 178 bp, Homo sapiens
taggcagggtcttgatctatcaccgaggctgaagtgcagtgcaatggtgcaatcatggcttgctgcagccttgaactgggctcaagcaatcctcttgcctcagtctccaaagtagatggatagctgggactacaggtgtgtgccatcacacttggctaatttttcacttttgtcgacg

SEQ ID NO: 650237 - DNA, 299 bp, Homo sapiens
ctcaaaaaaaaaaaaaaaaccgaaccaaaccaaaaacccccttaacagctttcctaaggaaagctaatgctgggggggcttccatgcagccatttttaattcatggacctccctactctgcccttgttctggaaaagttaacgtgctgggcaggggggacccagacatgggataaccaggttttagccttgttagaaaagggacccaaaataagggaattagaaattgaaaaagggaatggggggagggataacccttgttatttgttgtgccccctgcagaaagggaggaattgaaat

SEQ ID NO: 650238 - DNA, 149 bp, Homo sapiens
tctgcatcttggcaaccaacttcctccctggcctctcgtttccatccccacttttccaggtgtcctcccatcaccatctcatcaaccagtgcatctcccgggcaacactccaagcaagcacacaaccatcacccatcattcatttcaac

SEQ ID NO: 650239 - DNA, 125 bp, Homo sapiens
cacggtgcagggcctggtcatatcacagatgctgcgcaagcgcgtggagacctcgcgactggctcagcactactggagccccggcactgtgcgggccgtcaatgaacgcgagtggtggcaggata

SEQ ID NO: 650240 - DNA, 368 bp, Homo sapiens
tgtaggaattctgcacgaggccgcgtgtatgggactgttgcatacgcgtgtgtgtagactgtggccgctttgtgttctttggcttaataccgggagtgaggggggccgcggcggcgcgacacaccggcttcggaaccactgtgcgacagggcttgacatgagccggaaaaaaagtctggatttctataaggcttgagaagctctgcattgactggggggggtgggattatcatataagccggtgtgttttattccaccacggaagagattaaccactcttaccatggctgtggtggtatataaaccatatgccttcttatgattaatgcgggatcgaatggacgtgccaggtgagaggtacgtgggtg

SEQ ID NO: 650241 - DNA, 171 bp, Homo sapiens
gagaggcgctcacctcttatgacgtccggctagccatgtgattacttcactccataactgctcctcatactaggcctactaaccaagacgactaaccatataccaatgtatggcgcgatgtaacgacgatgaaagctacataccatgtggccatcggggacgggtggtgga

SEQ ID NO: 650242 - DNA, 176 bp, Homo sapiens
tgaatttgacaaagaaccccttccctttccttgccatgtccccctccaaaggaagtcccccctcagcaaggtggtttggcatttggggccaactccattacagctatgagctccctgctgtcagtgacgtttggtgttttttgtactgtgtttcaataaaaactccttcaaggtta

SEQ ID NO: 650243 - DNA, 281 bp, Homo sapiens
tggcgcaaaaaagtaaagaaaaaattatctgagtcatgaacctaactcagttttacataaaacaagggtttttttttgtacttttaatatctactgaattttccagaaggaaagacagttctttttttttttttaaatttggtccagcacttggccaacaggtgtggacaattccagaaagtcatggtatgggcagcagggccaggttcagatggagcccgtgccacccggcctgttccctcggcggggggctttctggcatggagggcattcgtccacct

SEQ ID NO: 650244 - DNA, 248 bp, Homo sapiens
ttaatcgaaaccacgtcggagccggcgttcggcccgctcatggccagggcgccgacatgctcgccgctgatcaattgaggtagatagttgagtttctgcgcgtgattgccgttgcggttgatctggttcacacacaggttggagtgggcgccgtaggacagcgcaaccgacgcggaaccgcggctgatctcttccatggccaccacgtgggccaggtagcccaggcccgcgccgccgtatcttccggc

SEQ ID NO: 650245 - DNA, 888 bp, Homo sapiens
  misc_feature (12)..(12): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (31)..(32): n is a, c, g, or t
  misc_feature (35)..(35): n is a, c, g, or t
  misc_feature (728)..(728): n is a, c, g, or t
  misc_feature (798)..(798): n is a, c, g, or t
  misc_feature (801)..(801): n is a, c, g, or t
tggctaggtacnaggctngtnnnannnnggnnggntgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagataggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctaactggaccccanacacgcagcaggcgtggagccatgatgggctgtcatccggacgaagttcatgcagcaccgcggcgatgantcnggaatgacgcatcgtggtggtttctgaatgagactatgtgggccagtaagtgtttgggtctccttgctggtaactcattggcgagta

SEQ ID NO: 650246 - DNA, 398 bp, Homo sapiens
tccagagtatcccccggcattaccctcactaaagggacgaggcttaaagtaggacaaccatggagcctacctgtggcaggagagacaacaaagcgctataatcctaaggtcatgagaagtgtcagcctcacctgaattttgattaagtaaatagaggggctaccgggagctcggaattccgtcaatccataggttcattagctagtattcctgaagtgaaaacgaacggcaagcgataacaatttctgggtgtaaactacatccagaggaaaagataaggaaaaaaactatacataatgagataaataccataaataaaaggaaagagggagggggaaagagggtaccgagaatcaaattaataaatacatggataataaacaaataaaatgaaatgt

SEQ ID NO: 650247 - DNA, 1630 bp, Homo sapiens
ggaagatggacgcaggtgttattgaatgtgatgcaggatttttctcagccactctggcagccagagacctccggctggcgaggcccctgcccaggccttgcttgggtccaggctcgccgcaggagataccccatctacttggtccaccggtgtggcacctggtttgcactatggcacggataccatgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtcccacgggagcctcggcgagtgtgtcagtcgccccatgccgtgcaggtgctcgtggggcctgtgcgccaagccagatgcacggtggcctcgctctcctatcccggcggtcataccaagagaggagagcccaggctgtctggaggccgcgacttggtatctcacgtcgtgtttgtgtcttggttacaaatcgtttatgaaggccctgctgtgcttaggcgccctcgtgtgggaattctggtgaagttatttgcgtgccttgatgtgcgacagagagatgtagcaaccatctctagctgcaccatctcgagcaaaggcacgtcgtgaaggcagagctcttttcagctttctggaagaaaggtctgctgcaaccctgaaggaacctgggcgtggcaatatttacatctaggaggaaaactgtggctcagttttaacaaatgggctcattgagtgagttccaaattcatgtttcaccttccatgatgtagccaagctgagaactcttaaaaatgcctcaccggctttttcactcagggccacctttttcccaaggaacttctcaaaactccctcaattccaattttattgaagttctacatgtaggctatttgcttgaatccaattttccataagaaagagctcatttaggccgggcgcggtggtcatgcctgtaatcccaggacttgggaggccgaggtgggtggatcaatgaggtccggcgttcacgaccaggcctgggccaacatggtgaaaacccggtctctactaaaaatacagaacttgctgggctgggggcccgcgctattgtccagctaatcggagggtgcgca

SEQ ID NO: 650248 - DNA, 423 bp, Homo sapiens
cctcagatataacaatcactttgtcaaataaaaggatctcaaatgctaacacaggtttgccagagaattggagacacaaacttttttgtcttttacagctggtcccttcccttttctactatgaaatacttctaaactttatctccactacaaagtgcaggaacttactggtacttggctgaatcaaagggaagaaatcgatcttcagaggtcatgtggcccaaccactggccttcaggctaaactgtcttaatcatctgagagaaatgattatctctccactttcaaagacttctagggatgaaacctgaataacctgtcacagtaataccctcgaacaggtctgccagaaagttcttgctttgtgtttaaccttaatctctcatgagacactcagaatcctttttctcttattttattctc

SEQ ID NO: 650249 - DNA, 255 bp, Homo sapiens
cctcctgggtgcaaatgattctcctgtctctgcctcccgagtagctgggaatacaggcgcgtgccaccatgcctggctaattatttgtatttttagtagagatgaggtttcatcgtgttagccaggatgatctcagtcccctgacctcgtgatccaccgtctcggcctcccaaagtgctgggattacaggcgtgagccaccgcgcccagcctaactatgaggtgatttaaggaaagtaatgggaagggtcgacgc

SEQ ID NO: 650250 - DNA, 665 bp, Homo sapiens
  misc_feature (12)..(12): n is a, c, g, or t
  misc_feature (18)..(18): n is a, c, g, or t
  misc_feature (21)..(23): n is a, c, g, or t
  misc_feature (25)..(28): n is a, c, g, or t
  misc_feature (31)..(32): n is a, c, g, or t
  misc_feature (35)..(35): n is a, c, g, or t
  misc_feature (610)..(610): n is a, c, g, or t
  misc_feature (612)..(617): n is a, c, g, or t
  misc_feature (621)..(621): n is a, c, g, or t
  misc_feature (625)..(625): n is a, c, g, or t
tggctaggtacnaggctngtnnnannnnggnnggntgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcacccccgtgtcatcccacatcancnnnnnncacnaggnccaaccctgggccttgcccttcctgctgtccatgcggctt

SEQ ID NO: 650251 - DNA, 136 bp, Homo sapiens
ataaaattcggtaaggagaaatcaggttttaaaatcaataagagcaagataggcttagatagacacagagagctcataagaaggattatatcaaaactgtcccagaagaaacagactaaaatgaattttctcatat

SEQ ID NO: 650252 - DNA, 645 bp, Homo sapiens
ttttaaaaaaggcaaaaaatttgcccagtttaaaaagttttcttgggaccttttttatataaaaaattttgggcttttaaaaaaaaaggcctttgttttttggggggaaaaaattggcgtttttcgtaaaagccccccaggggtttaaggggggggtttaaaactttttttataaaaaaagtcgattttttccgcccccaaaacgggtacccctttataggccttattttaaaaaaaaaaagttttgccttttgtttgttttccctggggtaaataaaaacttcccctccggtcccaagaggataatagtaaacgtttatttcaaaaaaacaaatcccccggtttttttttttttttttactaaattttctttattgaaataggtaacggccgttccttgataccagataggcttcaagtaatcaggaaaaaaaaatcttgtcaaaatgttacccacttgaaatggacagtgcatagagaccccttttaacctttaagtattgtcataaaagaaatatgttaatcaagcaacagccagatctaaaaagttccaagtgtggatttcccattagttcttataaattaaaaaaatccccaatataatcatttgttcactatcttctttcaataagcacatggacaggg

SEQ ID NO: 650253 - DNA, 255 bp, Homo sapiens
aggtttaaaaaaaagggaatgttttttgcggagggtttcctttgtccttggggggctcgagggggacagtagggaacccctgttttcaaggcccagcccaatttttttgggtgggttgggggtttgtttcatccccagctgggggggccttttggtttggaaagttgggttgtttcataaaacccccaggtgggacatttttttgggaattatgaattgcccttgttttacattaaaagagaatgtttttgttca

SEQ ID NO: 650254 - DNA, 141 bp, Homo sapiens
aggatccttagtatatcagattacagaacagcgctctcttgagggatatgaagcaccgccaggtctattgagttataagctgtggctcgtagtgtactaggcgagcagtttagttgatttaactagtagaggtaaagaggc

SEQ ID NO: 650255 - DNA, 932 bp, Homo sapiens
gatttgaagctgcaagaggaagaaggccctctcagctttttggaagaagtcaaagtaagcagagagatggacagggaaacacttatagatgtggccagaacatctcttcgtactaaagttcatgctgaacttgcagagtgtcttaacagaggctgtagctggacctccattgttggccattgaaaaagcaagatgaacctattgatctcttcatgatctgagatcagtggcagatgacaagcagtacacagtctgagacactgtatacaagcttaagtcagcagggcttgttgttggcaccacggatcacggtctatcctgtgatatggaagcacaaagggtggaagggatgcatactatccttcgacttgtaacgtgctcattaggagctatgagaaaacagaaggtgagattctggctgtgtactctgacatagaggtgccagtaagcagggagagaaaacaacttcggtgaaagagctagcacaacgcaagacattcgcatctggcacagcatcacgggttctgaaacacagcatcaactagcaactcgcagacaaacggagaaagtcgtggtagtgcggaatctcccagcatacaccagcgcatagcgtgggtgtcatttaaagtccacagagacgggtgaacattggtacccgcacgtatgtgtaccctttgagtagtggctgctctctccagaaaagcagacgcgcgatgacgttgtggcctccattggcgcggccccggaaggctttaacaaagcggaagagacattcacttggcgaacgaacggcgtagaaccttcatttgcttgtagatcggttcgggggataagccgcttggaaatattcccatcttaggacgaaacccataacgttcccttgaccgtgccttggggacacattgcagcggactatgctaatatgtgacctc

SEQ ID NO: 650256 - DNA, 200 bp, Homo sapiens
ccaactccagagtccttaatactatggctaagcataataaatcactggggaatcttcttctgaacaaagaatgtttttgtaaagcccaaattagtaagttccaatttttttttttcagcgcctcctactataccaggctgatgatatgggctggctaactgtgtgggcccagacagtcatttgcctatattcctagctgg

SEQ ID NO: 650257 - DNA, 1140 bp, Homo sapiens
cgtcagtgtctctcgtgctgtgttgctgttggtctcgctgttgtgggtgtggcgcccggtgcgcgtgtgggtgctaacgtttgtggcctcgttgtgttgaggttgcgtgtggcttgttcgagagacgtggttgtctgtttgtgttgctccgtgtttgtggatgggcgcccggtgcagtgtcgcctgtcgcacaggttctgcttggggtgagccgcgcgctggctcgggtcttgccgtgtgtgcgtgcgatggcctccggggatgtgtttgtagccccccggctttttccggtttgcccgtgtgcctgttatggggttcctggggtacgttggggtttgggcgtcgcagtcgcttcggatgctggagtgagggtgtgagtgtttcgcgggtccccctggtgctccgaccagtaatgagctatttctggcttccaagtgggtaatctgtcccccggcctgaatgtgtgggatgttaaggtaaaattgggggaaggaccatgcagccggagatgccgaagatgggcctcccggactcctggttaattcctggaggacacccctgctaagatttcacgattttagctgggaaacccccatgagcccttgggtcactttgctcacatgttctgaggataacactcactgcagatattggccaatggctggaaatatttgcccatgatgaagagtcccgatgtcccgacatccgaatctggagggacccaggattctttaaccccaagtaccgcagaaatgttttctgttgaatgtaatgctaccatgaatgccttgaatttactccagcgcccaaaaggccttgtatagtatggaaaatgtaagtggggtggcttatggcttcttttatcctctgattcttagcacctttcacaagtgagctgtttgccgtaactgtatcatattgtagctattagggaagagaagaatggttgcttatagaaagaacactcaccccttgattttaaatacccagtagccacgggtattgcccttgattcacactgttttaagtcctcacttttctccaactaagtgcttgctgttccccaatatggccagaataacttttaccctttttccttcccacccttcttgattggctttgccagaaataaagttttta

SEQ ID NO: 650258 - DNA, 618 bp, Homo sapiens
  misc_feature (435)..(435): n is a, c, g, or t
  misc_feature (497)..(497): n is a, c, g, or t
  misc_feature (530)..(530): n is a, c, g, or t
  misc_feature (548)..(548): n is a, c, g, or t
  misc_feature (551)..(552): n is a, c, g, or t
ggtgttattagtgaaaaataactgtgtactcgttgttctcactgacatagcactccaagtagttgttgcgtgatgtgataggaagtggatattgggcaactatgagatagattgatgagaagtgcaaccatgatctctacgacgcgtgatcgccttccttcgatcaatatcaatcttacgtttctttcattacagcaatggcgtactgtaatgcgtggtaagtccgtgcgtatatttgtggcaccgatgactatatagtgctcgctaatattgaaacaatccaagagtatatggtcatgttcaccaacgagagtagcacaaatcttgacttctagtgctcactacttctgctattcacacttgggtgccccatttctcattcagtggatggggcgagtcatcctcaagagacaaagggtaaatacaccctgaaancgttctaattaggtacaccctcgagtaacaataatcaccatatgtctataccttgaccaaancggacagagggacagagatagggtctcgacacngtatctgtgttgccatgnctnnattctcccattctagccctaagtcgaagacatagacatcagagcaaagtggggtacaagctaagtg

SEQ ID NO: 650259 - DNA, 113 bp, Homo sapiens
  misc_feature (100)..(100): n is a, c, g, or t
tctgacacatcgcctcttcgagaacaccacaggtgtggcaaaggaattcacccctacaggccagagcacaattttaaccaccatatcattctgcctctgngtaggtcagtcaa

SEQ ID NO: 650260 - DNA, 410 bp, Homo sapiens
aatgagatactggtatgctacaaaaaaaacatccacgagagcagtataaggtcggagtgggtgcaagccaggtaagacaacgtacacaccgagtgcctccatcacgcaggccagaggaagacaacgccacaccagcgtgcctcctacacgcacaccagtgccatcctcgcgggtttcacggatgtcgctagaggcccgcggtggatgtctccagtacggctctagtgccctgtaggccctgcccacatggggcacactggagtcaaacatcatcccagcgctcgtcactcgcaaacatcaccaggagcctgcctgagggacagtggacgcgccccggacatcctgaactctggtcagggcaaagagggctggacccagggcagaggagcccggtctcgacttcatcccag

SEQ ID NO: 650261 - DNA, 301 bp, Homo sapiens
tatagctgttctagaggatataggaggtcgctttgtcggtacaaaagcttttaagcttaatataataccatctatttctgcttttatagcctgtgctatctaagtatttacctcaaaaaaatctttgcccagaacactgtcctgaagcatttccacaatgtttttgcctagtagtttcacagtttcaggtcttacatttaagtatttaatccacaaaataagaaagagatttgcaaggatacttcagtccaggcatagtggctcacacctataggcctggcactttgggagaccaaggcag

SEQ ID NO: 650262 - DNA, 181 bp, Homo sapiens
  misc_feature (96)..(98): n is a, c, g, or t
acctggagacaaaggtgcaaaaaggatctattggtggaatggtctttcaggaacaacctggagagaaaggtgtgcctggcatccctggcccacaannncaccttgcttaccttgagacaaaggtgcaaaaagagagaaagggcaggcaggccacctggcataggcatcccaaggggtcgcc

SEQ ID NO: 650263 - DNA, 297 bp, Homo sapiens
ggccactttgtcaagctcatttcttggtttgacaacgaatttggctacagcaacagggtggtgggcctcttggcccacttggcctccaaggggtagggcccttgggcccccagcccccgcaggggcccagggggggggggggggccctccctgttggggggtccttgccacactcagtccccccccacattggatttcccctcctcacagtttccatgtgggccccttgaggggggggggggccttgggggccgccccttgtcatgttccctcaataaagtaccctgtgctcaccca

SEQ ID NO: 650264 - DNA, 1260 bp, Homo sapiens
ataggaaatcaaatccagtcaaagagataacttcttaaaagggaaattaggaatggggctagagaaggtgatcttgcaatgatcctctatactgaatataatagcaatttgctaggggctctcaatagattcactagcaatgccatagtacttatcatacagaagttatttcatcgacttaaagtacgtgtagtaggctgttgactccttagatgtcatttagatacgtgcattgcagccttcagtcaatgtaaagatacgagtcctgttaaagctaactcactgaaggaagatacttatactgtaacatcttagccataaatgtaggatgtaacgtctacaaggagcgcaatgagacttaagtactaacaaagtaatttattctaggtgtcaaaagagaggggggtctcatgtgaggcgcgtacacaagtgattacagtatgttatgacacttttggggctttacttcctctaaatatgtaacagaatttcccctactttcaatccctataagtagccaattaatagccatcttttgcaaattccaccgactctaaatgtcacacaccatcaatttttaaaggtccataaaacgcaactcggaattcttcgagagaacggctttagggaacatctcagaaggtgcacaaacaaatgttcagccaagagggaacccatctttttaataactacaccgtaggggcccacacggactaagttttgttccgaagttttggtgccttttggtatttcggacactcttgaaattgggtttccgcggataaaaccgtatacttcaccaagcaagaaagttccctcacattaaagaaggcataggagaccgggggaagttcacacccattttcttgttgaagcggcggacatcccgaagtagtacatggacatctcataattgaaaactctcccttctccataagcggaagggaaaaacacaatcgtgttgcgttcaaaaattctccccaccgcaaaaaaggcaattttataaaccgataggatggatctaattttgaccagaaaaagcgagcctaattgtaacctgaggtcgagcttcgtttgtaaagagttgctaacccgagcttgttgtcccccctaagggtgccgaagggttacaaccctgtatgctcagacatcctaacaggctgagataatgggctatggaacaacgacatcgcacaagggaaccgaaggaccttttggcagcctgttagggaataacgattctggagagcacatacttca

SEQ ID NO: 650265 - DNA, 1222 bp, Homo sapiens
ggacgcgctgggtcgacccacgacgtccggctaagtgcccacgaagtctaagcagatgtactgggtgttcaagcgtaacgaggatgcctgccgctatggcagtgccaatcggagggtgctaggccttccttggcctcaggccgttcgttcgttcggtggtgcgacaagcgtattgacaccaccaagatcgagcaacggccacgtgacctgggaagtaccgtggatcatagggtgacctgtctcgttctcaaagaatgctcctaggacacttcctggtaggttgagtcgggttgtctgcttgccgtcagcacaacacgagtggagcagtacacccaaggacccggaaggcagcgtgctggctgaggggccggagctctagtgcagggcagccgatcacctgtcagctgtgctttataccatacttcgtccatggggtgtgctaggcgctactcctggctctagcagcgactagaaggctggacgtggacgagttcatccagaattacgttgagcccactccggaacccaatagtgcctacgcctcctacccagggtgcatctgtggacaagtaacaagcagccacccttggaccagaacgcggagacgagcgagggcatacagccagtccccttgtggactgagcgggagaacagcggggaagggggacagacgcagggccgcccactgtctggcctgggacgatgcccatgaggcatccgggaactgcccagcacatctctatgcacctgttccagcctgcgcagatgaccacacaagctgaaggagcctcagaagcaaggcgaggggcctgcagaagcaagacccacagtggcctgagcccacgaagcgcgatcaggcacgactgggatacaccctcacggggacactacaggaaaacgagtgtctaaacgaggagtgtaccacggacgtcacgaggagccaaccacgacggaggggagaaaaaagcgcaaggtgtcacgagagcgaggacaaacgaggaccgagaaatccccgagcacaggacaccacgcgacgacccaacaaagcaggcgttcgagaaaaacagcggcggcgaacaaacgcgagaagagacagagcaacaagcgaacaccgagacgcaacagacacagagacgacccacgagctgagcgacacagcgggaggcacgtactcaacgaggaagagaacacaggcgaaaagacgagaaacaagcgcagaaga

SEQ ID NO: 650266 - DNA, 108 bp, Homo sapiens
  misc_feature (37)..(37): n is a, c, g, or t
aaaaatattatgtactatatttttagtctcaaacacnctatatattatatatatttaatttttttatatatataaatataaatgttttaaaaagtaagaaaaaaaaaa

SEQ ID NO: 650267 - DNA, 580 bp, Homo sapiens
  misc_feature (144)..(144): n is a, c, g, or t
  misc_feature (203)..(203): n is a, c, g, or t
  misc_feature (212)..(212): n is a, c, g, or t
  misc_feature (278)..(278): n is a, c, g, or t
  misc_feature (356)..(356): n is a, c, g, or t
  misc_feature (374)..(374): n is a, c, g, or t
  misc_feature (460)..(460): n is a, c, g, or t
gtatcatgggctacataagcatggagcgtgagcgcgccctgttgaaggtccagcaaccggggacctctctgctgcgattcactgagagctcccgggaaggggccatcacattcacatgggtggagcggtcccagaacggaggcnaacctgacttccatgcggttgaaccctacacgaagaaagaactttctgctgttactttncctgacatnattcgcaattacaaagtcatggctgctgagaatattcctgagaatcccctgaagtatctgtatccnaatattgacaaagaccatgcctttggaaagtattactccaggccaaaggaagcaccagagccaatggaacttgatggncctggaactggatatatnaagcatgagttgatttccgtgtctgaagtgtaagtgaactcagaagcagtgacatgcagcacacacctcacagccaacaaaaattnaagtattggcccccgcccaagatgcatgtattttacttttccattgtaattgctatcgccatcacagctgaacttgttgagatcccagtgttactgcctatcagcattttactactttaa

SEQ ID NO: 650268 - DNA, 578 bp, Homo sapiens
  misc_feature (15)..(15): n is a, c, g, or t
  misc_feature (51)..(51): n is a, c, g, or t
tgggtgactctacangatctttcttacgcccaaactctctggcacagaggnatgaaatgggcattcctctgctgtcccatgaactggcaaaggccgtaacccagatgtgccccagccgtacaccgggggtcgatggactcccagtggagttaataaaaaattgggtgaataattggactggacttcttttgcgtgttgcgtgaataccgatgagctgccgtcggtcggctctgactctcctgcctaaaaaaggggacttgtgtgaacttaagaactggaggcctgtggcattgctctgtgcggactacaagatatttgccaaaggcctctctaacagactgaagtcccatctggactctacagtacacggggaccaaacatattgtgtaccgggacgctcaatcaaggacaacttgttcttaatcaggtacatgttggactgttcgagaggttcaaatgtgaactttggactggtctctttagaccaagagaaggcttttgatagagtggaccatgagtatctgtttaatgtgatgtctgttcttgagtttggggcgttaagagggtacccggctcga

SEQ ID NO: 650269 - DNA, 264 bp, Homo sapiens
accaaattttttttttttaattttgagccaggtcccgctttgtttccccggcttgtttttaactcctgggctccagtggtccccccgcttccgcttccccaagtgctggcctttccggggttagcccccccccccgggcttttttttttttttttttcccccattgttttaagccgttagggggaaggggggttttttttttttttttttttggttttttttcctttgaacctcccggggccttattaagtaggtttgccgtta

SEQ ID NO: 650270 - DNA, 288 bp, Homo sapiens
gcacttttgatgtgaaaccctgattaagtgtgatgtgggtagatgtcttcaggatgctatgctgcgttcagaaacagtggtcttgccagcattatccaagcccaggagaagtattctcacctcctggtctggtgcacttttcaacttgcgcaacattgagagcaagcccatcctcccgccgagtccctcctcctcctcctcctcctgctgcctcccccgttaccaggggcaactgctgcggtgccacccccgacgttcctcgcacgcacagctgaggagctgagcagc

SEQ ID NO: 650271 - DNA, 2564 bp, Homo sapiens
  misc_feature (41)..(44): n is a, c, g, or t
  misc_feature (47)..(47): n is a, c, g, or t
  misc_feature (49)..(50): n is a, c, g, or t
acacacacccatccgcacctaatccaactagctgtagccgnnnnatngnnggtggtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttcttttggggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaa

SEQ ID NO: 650272 - DNA, 159 bp, Homo sapiens
tgaagcctcagaattgtttttatcaggtgctataattctataattaattttacaattcatgtagcaaatggaaaatcattcagagaggccaatgtatataaataacagtttatactgaaactgccaatttactaaacagcactgcatggtgtttatatt

SEQ ID NO: 650273 - DNA, 1132 bp, Homo sapiens
gctctttccctatcggtgtgccactagaagatcctggtgtcgccatgggccgccgccccgcccgtatgttaccggtattgtaagaacaagccgtacccaaagtctcgcttctgccgagtgtgtccctgatgccaagattcgcattatttagacctgcaggcggaacaacggcaaaagtggatgagttaccgcttctgtggccacatggtgtacagatgacactatgagcagctgtcctctgaagccctggagcgctgcccgaatttgtgccaataagtacatggtacacacagtacgcgcgccacacgatggcttccatactccgcggctgcggctccacccctttccacgctcatccgcatcaccaacgatgtcgcacctgttgccttgctcgctgtcacagcgctccaacacagcgcactgccgacggtcgccctctgcccacacagcccccagggcccacctgcctgggcccgcggctccacactctggccccaccgtccatcactgtcctctcccgcacccatagccctgccgcacaaccacaggcaccgcactgcttgacattgacgcgcccacttgccgacacgggccccaacgcctcccaacgctcttccctggcaccccgccacgaacggaactcccactctctccgaccaccacagctgagcgcctctccacccaccgcctcccactgcctgcacctgcaactctgccacgacactgctcgctctgcacacaagtcgggctcattcccacgactaggctgtcgcggctccacgctacatcccccgttcctcgcgccctctcgcacccactttgcacagacctcgcacctctcctcaatgggcttccaacactgtgcctcgcctcccctgtccactacccccacccactcaacactcccacctcctgctcacccccccgccgtcctcacccaccacccacctcccgccccctccccctcacaccctacccccccccctcccccctccctctcacccaccctctccacccccccacctcccacccacacccctcctcccccacaccccgcccccctttacatcatcccccacccgcccccaccaccacacccacccacctaccacccccctcacacccacccacc

SEQ ID NO: 650274 - DNA, 1553 bp, Homo sapiens
ggcctagcagaaacgtgatccggcatcacgaaagtcccctggggagaagtgggagtggacaggggcgctgactaagtcagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttcttttggggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaa

SEQ ID NO: 650275 - DNA, 286 bp, Homo sapiens
acttaggtccttctgcgtcgtcttatttggaggagggaggcagcgctcccatcctagggtcttttcagtcagttcatgcaacagcctctactttctcctagcgtactgttccactattccctgttgctgtatttctccaagcggaagattcccaggcagaccaccaccacctccgcaccttgttggggtaacctggtgactcattcattggtcccttctcattctggacccatgtggcggcactgatggcttgctatcatctacagatccctggcgtttttgaaaa

SEQ ID NO: 650276 - DNA, 969 bp, Homo sapiens
taaatttttaattttccgggggcacatagttaattggaaaattttttttttttggaaagggcgggggtctcatttggtcccccaaaacaaaagtggcacggggtctattcccgggccccttcttagcgcacttacaacactttaaactctccgtgggcctcttcaagcaatttctctcacgtgccttacagcctggggaagatagcagtgggaattaacaagtgtgcccgacaacacaccccgtggctcgagacaacatactttctcttactcagctcgtgatcagtgttcaacagtggtcatttatccctcatatacagaagagtttttttctccttctcttcgagagtggggtctaaagactcccaagtgtggcaccatatctacgtgagtacaccaggcttgggagatatagtgagagtgtctccaacagcgtataacaacagagggagtcgccccggagtctcatcaaatattcatcgtgccgcacgagacataattcgcgtgactccaagcctcataaaggcaagatttcttcatcaagtagtatattatacacgtcccaacgtgttgccccactagagagaatgccttgccctagtggggagccaatattacaacctagtggcccccgaggaaacccacacatcatatgtcacagagcacaccaacaggggaaatagagctgtgcgtgtgacgatcgtggagaaaaatcccacagagaaacacaattcgcgcgagaaattgtgtggcgaaacctgaccatggaggtgaatccaaggccccccggggttctcaaagaacatcatgtaataacacagacaatcttgaccgaaaacacccgtgcaggggggatagacaagccccgggaagatgaacaacaccgtggaccatgattgcggacatctaagagactccccacaggtgggttccccacaggagagaggcaccaggtcacaaaacgagtga

SEQ ID NO: 650277 - DNA, 1084 bp, Homo sapiens
  misc_feature (269)..(269): n is a, c, g, or t
tgttcccccgggttaaagggaaccttttaaaaaaaaaaataaccagttttaacaaaacccttttttttaaaaaattttaacaggaccagggagaataccgtcccattaatttggtacctataaccatttccacgcattcggcgctttgagaacaacgacgcgtgacactttacaaaatgaaggatgagactctctaccttcagagttctgcgggagactcacgtggggttcctcacaaaatgtgtacagtatccagcaatctcaaacangctggtagaaacaacaccttgtgcaagaggtggcgtgtggtctgttgtccccagcggctgtttggccagtaggtataaagccacacacgggggtgtagatattccccgcacaatgcggcatgagcacgatgcgtggagggttccttctacagaccgccaggtagaattttatttctccgcgacccacagaaaacgcgtatcgtatgcggataaccaaacaacacacttcccgggatattttatgcaagggataaatacaaagcatgcagtgcatgcgtgtgttgacaacaacgcatttaacaatgaagtgcagacatccgcgtagtggttgagaatgactttttttcatcacgcactttcgatttagggaagacctcgccacatataatgtaaaattcttttttgactcgcagagagagaacgacacagaaggcggcgggcattttacgcacacctctttgggtgcgggggcgacctggcgtcatatttaattattgtatcaacaccgaggtgtattatagtgtggcgccttacagagggggggctttttccacgcgtgcggaagaagattcaccaacagattactctaaaagtggtgcaccaccagacaatttatttttatattcggcagaacattcgtgggccacggggcgttcttcagtgcacactacttgtggggcaggcccatgatcgatccgagaagctcattgcgaggggggacacctctgcgttatctacgaagtgctgttggccaccacagagtgatgtctctgacttactgataaaaaaaacccccacagggggtataataaacc

SEQ ID NO: 650278 - DNA, 367 bp, Homo sapiens
gcatgctgtgactattgtgtcaaaaggagcaggataacatagcgtacaacactcttcagagcctgctgccatttcgcactttctgcctcgtatacagggagtatcatatattgctctgtagtgctatccaaatagccaaatagcatccctcatgtcgctccagctgaatcattcaattatagtactatcaactttaatatatctctgtatttacttcctggaacaatatgctgtaaattttcttgctgatgatatgtagtccgaatgtaatcctatcacagctaggcaagagcctcatttgctccacaacaaattcccactcgctcttccttctccattgacccgtagttaaccacctgtaactcct

SEQ ID NO: 650279 - DNA, 714 bp, Homo sapiens
  misc_feature (41)..(44): n is a, c, g, or t
  misc_feature (47)..(47): n is a, c, g, or t
  misc_feature (49)..(50): n is a, c, g, or t
acacacacccatccgcacctaatccaactagctgtagccgnnnnatngnnggtggtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgccccccccccccccccccccccccacccccccccacccccccccccccccccaccccaccccaccacccccccccccccctcacacccaacacaaccacgccacacgaccaaccacaccaccacacaccccccccccactccaccaccaacactcacccacaacacccacaccaccaaccatacacacaccaccacactcaccccaccctcccaccacacacaacacaccccaccctcacccccaccccccaccacacaccaccaacccctccacctcctcccacaccccccccccccataacccccc

SEQ ID NO: 650280 - DNA, 2524 bp, Homo sapiens
  misc_feature (41)..(44): n is a, c, g, or t
  misc_feature (47)..(47): n is a, c, g, or t
  misc_feature (49)..(50): n is a, c, g, or t
acacacacccatccgcacctaatccaactagctgtagccgnnnnatngnnggtggtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttcttttggggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaa

SEQ ID NO: 650281 - DNA, 258 bp, Homo sapiens
gcaccgcctgcaagcacgcgaaaaccgcacagaaggtagatcggatggtgcatcgatgggcaaggtgggtggccatcgtgacgtagctaggtgcgcttacgcatcgaagacagtgaggctgacccatgcctcgcggctttaggcctaaggagagccccccgtagtggacacagatgcccactggaagatctcctcgtcacctagcccaagcacttgcacagatggaccctagcctcacccctcaacccccgcactggc

SEQ ID NO: 650282 - DNA, 1296 bp, Homo sapiens
ccccgtggagctctcagcccaagggaagcagatgatcgagacgtactttgacttaccggttgtatcgccatgtggaagagccgccagcatctcgaagctgctggactttgacgacgtcctgtgaggggcagaggcctccgacccagtcacgcatcaggccgagtccctctgacaccgggaacctgtgagtgctgtggaccgtctcgatgtctccccggtgactgtgtgtgctccggtctcgtcctggagccacttcagtggcacctcagcacgttgctcaggttccccctgtgggttccggtcctcgctgcagcccgtgtgccgctagaggcttgcagtccctgggggccgggaggaatcccgccctgtggcccgtggatgctcaggggccaggcagtgtcctgccatgcctcgcctggaggctcagctgtgggcagtccctccatggggttcatgggaaattaagtgcactttctatacccccgtaagcaaattcaacaggggtaatgcacgcattcattgttcagactgagtttaagccacgtattgctgcttagtttagcaggtgttaagggcgaccccgggcgcaagtcagacccaggatagatccggcattgtgttccggggaacccttacgtggttcaatcccgctcacactgacgattcgaatttaacaagtcccccaagggattggccccggggttgccgtagggcgccacggcgttgacacggtggttgacccaaggcatggagtcttctggtctgacacatgggcctggagttcgtctgcggatctgtcttgacacatggggccgagatctactaaacaggacatagcagcttagagtttaccaccttcacccttctttggcagatccctcgcgaattacccttggcttaagatgtttagaaccccatcaagcaccggaagcccggaaccccgggctacggcggggcagcgtctcggtgcgccaaccgcagggccacgcccaccaagcgcgagcaacgcgcgtcccaccacactgaatcaaacaagaggcagccgccggtatgtgagacccgagtccacaacgaggcgacctaaaagcaccaccgaccgcaatctcacacgacggaaccagacctagcactctaccgtaacaaccacaccacgagtagaagccacccccaacacaaacacccacggcccaagacggagaccaagacaccgctgccgacgctggtaaagcagcgggacaagatcacgaaagtagaaatggatcgaccagcacgacgaccgacccaaggacacaccgc

SEQ ID NO: 650283 - DNA, 168 bp, Homo sapiens
gtcgacaatttggccatcaggtttaaagcgtgcactagaggtcaggtgcagtggctcatgcgtgtaatcccaacactatcggaggctgaggcaggtggatcacttgaggccaggagttccattccttgcctcctgtaatccagctacttgggaggctgagtgtcgacg

SEQ ID NO: 650284 - DNA, 477 bp, Homo sapiens
  misc_feature (24)..(24): n is a, c, g, or t
  misc_feature (464)..(464): n is a, c, g, or t
tccttctcaggccatatttagttngctttaacatactgttagtaggaatataaattagtatggccactatggaaaacaatatggaggctcctcaaaaaaatgaagagaaaagaaatcactatgtggaagagatgtctgtggaagagatatcccttgtttattgcagcattattcacagtagccaagatatggaatcaacattaagtgtccatcagcagatgaatggataaagaaagtgcagtacttatacacagtgaaatatcattcaggcataaaaagtgatgaaattctgtcatttgcagtagcagcatggatggaactagaagacatgttaagtgaaacaagccagacaccaaaagacaaatatcacatattctcacttatgtagaaactaaaaaagttgatctcatcaaagtagagagtagaatggcagttccagaggctgggaatggacagggcaaganggaatgaagagag

SEQ ID NO: 650285 - DNA, 139 bp, Homo sapiens
cgtcgtttacatgcctgtggtaccagctacattggggggctgagtgggaggatggctatgggtctgggaggtcgaggttgcggtgagccgtgatcacaccactgtactccagcccgggtgacagagtgagaccgtgtcc

SEQ ID NO: 650286 - DNA, 880 bp, Homo sapiens
  misc_feature (588)..(588): n is a, c, g, or t
  misc_feature (600)..(600): n is a, c, g, or t
  misc_feature (611)..(611): n is a, c, g, or t
  misc_feature (684)..(684): n is a, c, g, or t
  misc_feature (827)..(827): n is a, c, g, or t
  misc_feature (829)..(829): n is a, c, g, or t
  misc_feature (839)..(839): n is a, c, g, or t
  misc_feature (841)..(841): n is a, c, g, or t
  misc_feature (855)..(856): n is a, c, g, or t
  misc_feature (858)..(858): n is a, c, g, or t
gagggctggtttgggcatggtgctgggctgcctgtctttgatttcacttatttgtttttttcttaaaacaggtactgaggataaaacaatataaaataatatgagagggtctttctcttccttcattcccccctttggagactctcactttttatagcgggagttctcactcttattttggttacttatgtcttttagtgcaacagatggatagtgatttatatagtacacttgtgctgaagcacttggtgaactaaggtagcgatgaagctttttatcatttgaagaagtacaggtaggaaacaaaggagcgcaaccccatgaggttgataatactatgaccaccaatgccatttcattggtgaggaagttgaagcaaataaagtccaagtaacttgtccaaccccacatcattatgtagtggtttctcagagacttgaatgaagggcatctggatccagagtgccagctcttaaccaccatgttatgctgagtcttctatttgagcaatggaataaactgttctctgcaatgactacactcacatttgttggagctatgtgtgttcattgactggagccaactgtngtgaaatgggtngaattcttganttgattcttggcttgaagtctgcatagccaaagcaagactaagcaaaaagaacaaatctggaggtatcacatnacccaattcaaactactacaaggctgtagctactgaaacaggatggcaaaggcataaaaacagacatgtggacaatggaacagaatccagattcagaataagcaatacttatggcatgatcttgacaagcaacaaacctaagngngaaagacccntntcacagggtgtggnnancacagtccctgagtacagactg

SEQ ID NO: 650287 - DNA, 598 bp, Homo sapiens
  misc_feature (199)..(199): n is a, c, g, or t
tgtgctctgctctatagtactctcttgtacacatgtatggtcgatatcgatcataaaaatgtacttagctctcgatacattgactctgtggaggcactcgatcaaataactctgtttttgtcggttctaaatgatcattctctacagatgctcccttgtctgaatggtcacattagtgaactgtggactctgttgctcngtgggatctatctctaaagtctttagggagaatcctagtataaatttatggaaatgtttttgggggtgaatctctagtaataaatttgagtgttgtgtgacttggtcttcctttgttgtcttggctgtctcaatcttctggcctctatagttttctcctgctctgcctcccaaagtgcctggattttagggttgatccactgtgcttgtgcttagaggtaataaattttaatattctattcagattaagaaaatatagcatattagtatttgtatctttagtaaagttactgccagtttgatttttttttttgcaatttacttagctgaatcatgtaattcacagtaaatatgtttctgtgttttaccattttttattattcctgttttgaaaaaaaaa

SEQ ID NO: 650288 - DNA, 527 bp, Homo sapiens
caactacagcagctattccaagaacagagcctctgtgagcatgtacaccaatggtggctgccttagcagggcatcatgatggcatacttggagcttggggccttctgaatctccaaggaccaggacacttccttccaagaggcagcagcaagcttggtccactgtatactcctccaaatgcatctttgtcaataactgtcaggtatttattcttgtttaggtaaacagcatccagctttgtcccattgaaagcatatccttggactgaagtaaagccattgttgtacagcttcagtgtcaaggtttcattgcatagtccctgaaaagcattcacagggattgacgtcatgtaagggttgtctgtaatttcaagtataaagaatatatcggtggaacaaaactttggtcaggtcagggaacattttaagtccagtgttgaaaatgcccaggaactttaggagggggagctctttgagggcatcagggtctatgtacgttaagttcctggtataccgaagataccgagc

SEQ ID NO: 650289 - DNA, 742 bp, Homo sapiens
  misc_feature (450)..(450): n is a, c, g, or t
  misc_feature (462)..(462): n is a, c, g, or t
  misc_feature (473)..(473): n is a, c, g, or t
  misc_feature (546)..(546): n is a, c, g, or t
  misc_feature (689)..(689): n is a, c, g, or t
  misc_feature (691)..(691): n is a, c, g, or t
  misc_feature (701)..(701): n is a, c, g, or t
  misc_feature (703)..(703): n is a, c, g, or t
  misc_feature (717)..(718): n is a, c, g, or t
  misc_feature (720)..(720): n is a, c, g, or t
gagggctggtttgggcatggtgctgggctgcctgtctttgatttcacttatttgtttttttcttaaaacaggatagtgatttatatagtacacttgtgctgaagcacttggtgaactaaggtagcgatgaagctttttatcatttgaagaagtacaggtaggaaacaaaggagcgcaaccccatgaggttgataatactatgaccaccaatgccatttcattggtgaggaagttgaagcaaataaagtccaagtaacttgtccaaccccacatcattatgtagtggtttctcagagacttgaatgaagggcatctggatccagagtgccagctcttaaccaccatgttatgctgagtcttctatttgagcaatggaataaactgttctctgcaatgactacactcacatttgttggagctatgtgtgttcattgactggagccaactgtngtgaaatgggtngaattcttganttgattcttggcttgaagtctgcatagccaaagcaagactaagcaaaaagaacaaatctggaggtatcacatnacccaattcaaactactacaaggctgtagctactgaaacaggatggcaaaggcataaaaacagacatgtggacaatggaacagaatccagattcagaataagcaatacttatggcatgatcttgacaagcaacaaacctaagngngaaagacccntntcacagggtgtggnnancacagtccctgagtacagactg

SEQ ID NO: 650290 - DNA, 1572 bp, Homo sapiens
ggtgtcgctcagagtcccgcgttcccgggaactagtaagggagcctggggaaggcggggcgcggcccgggcggccggggcggggccggcgggagggcggagggccgggcggacctgtccctgccggtcccggtggaccccgcctgccccggtggcaccggccatgaagctgaagctgaagaacgtgtttcttgcctacttcctggtgtcgatcgccggcctcctctacgctctggtgcagctcggccagccttgcgactgcctccctccgcttcgagctgcagctgagcagcttcggcagaaggacctgaggatatcccagttgcaagctgatctccgtcgcccaccccctgtcccagcccagccccctgaacctgaggccctgcctactatctatgtcattacccccacctacgccaggctggtacaaaaggcagagctggttcggctgtcccagaccctgagcttggtgccccgtctacactggctgctagtggaggacgctgagagccctaccccgctggtctcggggctgttggccgcctctggtctcctctttacacacctggctgtccttacccccaaggctcaacggcttagggaaggtgagccaggctgggtccggccccgaggagtggaacagcgcaataaggccctcgactggctccgaggaaaagggggtgctgttgggggggagaaggatccaccgccaccagggacccaaggagtcgtgtattttgctgacgatgacaacacctacagccgggagctctttaaggagatgcgttggactcgcggtgtctcagtgtggcctgtggggctggtgggtggcctgcgatttgaaggtcctcaggtacaggatggccgcgttgtgggtttccacacagcatgggaacccaacaggccctttcccttggacatggcgggatttgcggttgccctgcccttgctattggctaagcccaatgcccagtttgatgctactgcaccccggggccacctggaaagtagtctcctgagccaccttgtagatcccaaggacctggagccacgggctgccaattgtactcaggtactggtatggcacacccggacagagaaacctaagatgaagcaggaggagcagctacaacggcagggccagggctcagacccagccattgaggtgtgatggcaacctcaccctgacttctaccttattttaggcacataccttgtgggactgggctccaggccagcccaggatgtggtttttttttttaaagacctgacccctgagaaccagaggcagcccctccaaccacagggtgtgtcccagttgcttccctcccttcccccagcctgccatgtggcactgcccacatgttggggacaagcagcttctctagtgagccagatcagccccatctggggcggagcaggacagatggactcagaaaggagggtagctgtgggaaaagggtaacttattggggacaagcatgcagtggggggctagaggagctgggctggaccctccccacctgagcatgcgatccccttcctacctctagaataaagaatctcaacccgg

SEQ ID NO: 650291 - DNA, 311 bp, Homo sapiens
acaaaaaaaattaggtagctggagctgggcatggtggtgagtacctgtagttccagctactcaggaggctgaggtaggaagatcttttgaacgccaggaatatgagaccagcctgggcaatatagcaagaatctctctaaaacaaaacaaaacaaaaagtattaagaagtagtcttggggctgggtgcggcggttcacacctgtaatcccagcactatgggaggccaaggtgggtggatcacttgaggtcaggagtttgagagcagcctgaccaacgtgctgaaaccccgcctctattaaaaatatacagt

SEQ ID NO: 650292 - DNA, 183 bp, Homo sapiens
gttgagacaccacaaggtaagagcgtctcgatgaccacatacgaatacgtgccaggcccacgagcaagtgtaccgtttacttgaacgtgaatgccgatggcatcatctacgggagccgtttcgaaaccggcgatcgcgactcttgcgacatgatgaaggcgcgtatgccgttcttctaagctg

SEQ ID NO: 650293 - DNA, 237 bp, Homo sapiens
cgccaccgcggccatcgccgtggccagcttccagccagggcacagcgccgggtcgggcgcggccacggtgacctcgaacgcggactgctcgcgcccctgcgggcaatagaacagcgagctgccgttgaagaagccgcggcgcgtgtcgagccaggccttgcgcaccgaattgtcgtaggcgtggacctcgtattccagcgtcagcgcgccaccgccggcgacgcggaagctgcgctt

SEQ ID NO: 650294 - DNA, 354 bp, Homo sapiens
  misc_feature (30)..(30): n is a, c, g, or t
  misc_feature (35)..(35): n is a, c, g, or t
  misc_feature (115)..(115): n is a, c, g, or t
  misc_feature (123)..(123): n is a, c, g, or t
  misc_feature (146)..(146): n is a, c, g, or t
  misc_feature (353)..(353): n is a, c, g, or t
cggaggcgccgataagcggatccagtgccnaaggnccggagggatatgaggagatgaggagtctgaggacctgcaccactgctgctggaggtgggagtgatagagggcacctgcntgccgganttggacgtatgttcccctcagcnggggaccccaactgctgctgagtgaagaggaaactgagagttgattgtgccaggcgccagtcttgttatgactgtgtatttttgttgatctataccctgtttccgaattctgccgtgtgtatccccaacccttgacccaatgacaccaaacacagtgtttttgggctcggtattatatatttttttctcattaaaggtttaaaccana

SEQ ID NO: 650295 - DNA, 452 bp, Homo sapiens
  misc_feature (431)..(431): n is a, c, g, or t
aaataatcaaaacccaacataagtgtaagattgcctttaaaaatatgcatcaaatcgtgtctcattacttttctctgagggttgtagtaaacagtaggagttaataaagaagctcattttggtttacacgttagaaagaagagaagcctgacagtggagatatgttaactattgtataatgcggcctggtatacatgacactcttctgaattgactgtatttcagtgagctgcccacaaatcaagtttagagccctcatccatttatgtctcagaccgttattcttagctattcaatggtgagcacgactgaaatctgcctgataggacccgtattgccacagcactaatacaacatatatcgtactgagagcttgttttatcattaccatgatgaaggtacatgaacatcagaatttaaaatcataaatntaatcctttcacctttaccat

SEQ ID NO: 650296 - DNA, 473 bp, Homo sapiens
gttctggtcgtgtcacagactatacattctgtgccgcgtatctattgtacctgagcatggcactatgtttactctttcgctatgtacggtagatccgcctactgcgactaaagagattcagtaccttaacgctaaaggtgctttgacttataccgatattgctggggaccctgttttgtatggcaacttgccgccgcgtgaaatttctatgaaggatgttttccgctctggtgatacggctaagaagtttgaggattgctgagggtcaaggtgggtatacgttatagcgccttcgaatgtatctcctgcttatcaccttcttgaaggcttccccttcattcaggaaccgccttctgggtgatattgcaagaacgcgtacttattcggcaccatgattattgaccagtgtttccacgtccgttcagatgttgccgtggaatagtccaggttaaatttaatgtgaccgcttatcg

SEQ ID NO: 650297 - DNA, 1780 bp, Homo sapiens
gtgccccaacatggagcggcctttaaagggactttcacttttgtataaccacttcatctctgtgagcccattttcccagttctggggaaaactctcccgcgccacaagatctatacaacaagaaaatatgagggctctcacttctcctatacccttattaaagaaacacaaactcctgtggttttccccgagggcttataaagccagtggtgcacccaaacactttagccttacatctcgagagagagcagagaccaaagacacaagtatagacagaacacacacatttgtggggtggctttgtgttgcacactttctgcgtattctcaacacccaatataatccgtgaaatgggctttataactcgagccaagaaaactccaattttatgtgtgcactttataaagagtctagcgatgtgtgacacctattgtgtgtgcacacaccgagggacaccctgtgcagagcccatgtgtgcgtctcccctttcaaattctcctctcgctgtgggtcgccagagttaaagacttcaaaatatcaccttgaggggtgtttaaaatatctccagcgcgagaagagagagacgagttttctctctcttgtgtagatctctctctctacaatatgagtgcgcgtgacgaggcttctcaaacctttctctataatctccacgcgagaaagactatagcgctttctttatcacgcacaatatcgcgcaaagaaagagacatttcaagaggccaaaataatagcagcattgtgcttcactaaataaacgctttctccaggggaaattctccataaacaaataatctctatctaatctccactcatcttttcgaacatcttattaagagaagcgccataacccccttattacatcgacggttatttaattatttatttagtattattgatgctaggaggagaacagacagaggcgaggcagcgctcacacacacataatagtgtgtgcgttgcgccccaaataaaagcagggcgcgaaaactattgacgcaacggaggggcgactcgttgtaacaccacaagagaagcgaggccgacaacaccaccacaacctggggacaaaaaataaaatcaacaaccgagcgtggtatggagacaaacacccacccaaataagtcataacaccaagaaggacgagtgaagtatgggccccgccaccacctcagtcaagagagattcactcacaaacaacaagcggggaggaggggaccccacacacaaaacgcacagcgacactaaacgaaaggacgagagcagaccggctatcaactgttcgtctacacaagaacataaggagggggctacctggtgccatgcatgtagtcaccccccaccgggctggagtggatgcactatcacgcggggtggtgggccacacaaccgaccgaggagcacaaataggcgtccctacgaacacccccccacacagaggacacaaagacggataactccccccacggagcacaccacgcggcgcgcaaagatactctctgtcagacaaacagagccagcagcacccccccgtggttgaccccaaggcgggaaacaaccacaacagatcgacccgcgcgagcaagtaaccttccaaccccgcaaacaagcaacaccatcacacgaacaacatcgacgcgcggcggggtgggccacacaagaacaacacacccaagggacaccgggggctaacatacaacaagacgacaccctcatcagatcaccacccacaaaaagactggtcgctcgacaaccaactatg

SEQ ID NO: 650298 - DNA, 642 bp, Homo sapiens
ggccgctttggtcacagtgaccgccaccgttgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagcgattgtcctgcctcagcctcccgagtagctgggattacagccacatgccacacacccagctaatgtcgtatttttagtagatacggggtttcatcatgttgcccaggatggtcttaatttcctgacctcgtgatccgcccatctcgcgctcccaaaatgctgggattacaggcatgagccaccagaaccggacatgcttgcttaaaagctaaatatttcaggcttgtgtgcattaggctctgttacaacctacttacttctgcttttgtaattctataggcaccattgataatacctaacaatg

SEQ ID NO: 650299 - DNA, 378 bp, Homo sapiens
  misc_feature (200)..(200): n is a, c, g, or t
  misc_feature (218)..(218): n is a, c, g, or t
  misc_feature (309)..(309): n is a, c, g, or t
  misc_feature (324)..(324): n is a, c, g, or t
  misc_feature (369)..(369): n is a, c, g, or t
  misc_feature (372)..(372): n is a, c, g, or t
  misc_feature (375)..(375): n is a, c, g, or t
aatggaatggatttcaaccccgaatggaatggaaaggagtggaatcaacccagagtggcatgtcacggaatggaatggcaaggaatggaatggaatggaatggaatggaatggaatggttcggaatagaagggactggaacgaaatgaaatggaatggaatggaatggaatggaatggaatggaatggaatggaatgganccgaatggaatagaatgnaatggaatggaatcaacccaagtgcaatggaatggaatcgaatggaatggaatggaatggaatggaatggaatggaatggaatggattcancccgaatggaatggncaggaatgaaatcaacccgagtggaatggcatggaatggaatccnaanggnatg

SEQ ID NO: 650300 - DNA, 260 bp, Homo sapiens
agcctggcccggctctagctaagttaatttgtgagctgggcacatggcgtgaccatctctacaaaagatacaaaagttaactggatgtggtggtgcatgcctgtggttcatagctactctggaggctgaggcgggaggatgacctgagtgcgggaggttggggttgcagtgagctgaagttgcgccactgcactccagcctgggtgacagagtgagaccttatcttaatctaaaaaataaaatttctgtgcccatttcaa

SEQ ID NO: 650301 - DNA, 320 bp, Homo sapiens
  misc_feature (7)..(7): n is a, c, g, or t
gctcggnacccatggcttcctggcaaagacggcgcagcttgtcgtcgtcatagccgaatccacggccgagtcaccaaaaacgaccccacctgatggccgaccgcatcaccgagttcatgtctgggcatccataccccgcacccgatcgacccaacgccactcaatccaggaacgcccaacgccaaatcctttttcagtgaccacaatccgcacgcttccagccttgatgaaagccgcgacgaccaccaccacaacgatgacagccacgatgcccccggtagccaggctcgtccatgctccaattgcgacgataagcgaga

SEQ ID NO: 650302 - DNA, 330 bp, Homo sapiens
ctgactacagcagaagctgccctggctgcagggactggaaatgctcgaagagcagcaactggacctccactccgctgtgttctttgcgaaacactaccgacgcctcccgtcccttgacagcctcgaagccagatggactgctactctccagtcaagctgtgaagctgctaccacccagacacccagacagacgtgcgcccagaggtcctggccaaatatggtggcctgcctaagatcggaacagtgctccttatgtaaactgagccctttgtttaaaaaacaattccaaatgtgaaactagaatgagagggaagagataacatggcatgc

SEQ ID NO: 650303 - DNA, 269 bp, Homo sapiens
aaaagggaaatattgaatggcggaccaatcatatcgtgaggaacgttgaaccctttatgtcctaaaatccttggaaccctgtggctaccaaaaatggtgaaccgaaaatgccgtccctattggggatgggagactgtaaattctctaccgcttgtaagagggttaaacagagccccaattatatggttataggcggtgcttgaattattttggtgagcttggttgctattaaactatggtgcgctcaggtcattgatactcctgcatgc

SEQ ID NO: 650304 - DNA, 433 bp, Homo sapiens
taagaggctaggggtatgagcacacgcagatcaaaaaaagaagatggactgcaggatgaggacgacagtgcaacgcaacagccccattacagcattagccccaactgagaaggaagaaggccttagcacccggctcttggctctggtgattttgttctttatcgttggtgtaattatcgggaagattgccttgtagaggtcgcaatgcacaggctggtaaattggattggtgaatccaccatatcatgggatttaaatttatcataaccatgtgtaaacacgaaattcatgtctgatgcacatctcacaggtcttgcctttaaattacccctccctgcacacacatacacagatacacacacacaaatataatgtaacgatcttttagaaagttaaaaatgtatagtaactgatcgagggggaacagaatgat

SEQ ID NO: 650305 - DNA, 443 bp, Homo sapiens
ccaggccatgtttggggctttgctctcctagcattcgtttgacgtgggtcggtaactctccggctgggttttgtttctgttcctccccgagaggccgtgtggccctcaggaaatgtgttgtgcacagttcttcctcggatacctccacgccctttggctttcaagtggagtgtttgtctggtacgcattttgtgcttttaaaaaaaccattgcaggtggcggtgtccgatatgttcctcgtcccagtttgaggtgttcattctggccctctatgtgcttaccaagtagataatgtaagagatgtgaccacatttggaaatgcttgccctccctctcttatccatcacttaggtggtcagttatgagttagagcacagggtgctgtatacgtcagtccggccttattcatgtgcaaaaaatgtgttgtgtactcttttggagtg

SEQ ID NO: 650306 - DNA, 160 bp, Homo sapiens
caagttcccctgttactggttacagagtaacaccactcccaaaaatggaccaggaccaacaaaacctaatactgcaggtccagatcaacagatttgactattgatggcttccagccacagtggagtatgtggttagtgtctatgctcaggatccaggcgg

SEQ ID NO: 650307 - DNA, 97 bp, Homo sapiens
  misc_feature (49)..(49): n is a, c, g, or t
cgattagaggatgacgtctcacccaccccagtaggccactgtcgacttntgtttccagaatatccagaaatccaaaggggctgttgctgaacagtct

SEQ ID NO: 650308 - DNA, 396 bp, Homo sapiens
ggctgttcttcctaggcaatcaggaatgtggttgaggccggcactggcgatgccagagagagagactaaaactcacctccagccataaaatggcaggcagcttcttaggagggcttctgagactcccagcccttggcagcagctgagccatgagcaacagcaatgcattccagatcagggaaccaaaatctgttaccaaaatgctaggggtttggtctaggttctgctgctcaccacccagaaagccaatcactgagacaatatcgccagggaaggaggctttaatcagatggtacagccaaggagagctagagatgaaatctcaaatccatctccttgaccgactaaaattgagtttatgtagtgaggaaggtggacctctcattgtctggatgc

SEQ ID NO: 650309 - DNA, 135 bp, Homo sapiens
gtatccagagaaggcgagtgaactaaagtacagcacatacgtgacagtggcggccaacacacctcgctaaatggcagtttcaactggccacattctcatcaggatagacttcttaatctggggtccaggcctgtt

SEQ ID NO: 650310 - DNA, 810 bp, Homo sapiens
ttgttccccctctgcggcgcaacactggtggtaccatgtgtcgagaacacactgtggtgtattttatcaacgagggcctctcttcctcgcgggtgattctctcgcgttggccgcccgtcgccttttattatgtctgccttgtgattcacaccccgcccgatgtccccccgccgggtggctgtgtggtagaatatgtggcccgccgccccccccttccttctcttcctcccgctgtgggggggtgaccctctcgctcggttgtgttgacccccccgctggttatttactcttcgtcttcttcgttgtgagacaacgaggtgtgtgctgcgactcgatttaatccgctcctctgtctcgcctgctgtttttattgtactagggactctctgcgtggtcgtgttcaccgccactgattttgttcctccctgggcggtgctcctcctgctcggtgtgtcaggaggagggacccccacgtcactttctcctcaggtccggggccatatggaatggtgttttttctcctcccccgcccaggaggaggagtggttagtggtgccgggcgccccttcttttgttgggcccccaccccgctttttttccccccccccgcgggggtggaccgcacaccccttcttttgtgtgggtggccgccgcacccccccccccctccctccgtctggcgaggggggggtgcccccccccccccgatttccttcgtcgtccccctcacacccccccccccccctccccgccgccccccccccccggccgccggccaaccaacgaaaggggggggggggggggaagaga

SEQ ID NO: 650311 - DNA, 1077 bp, Homo sapiens
  misc_feature (715)..(715): n is a, c, g, or t
  misc_feature (718)..(720): n is a, c, g, or t
  misc_feature (724)..(724): n is a, c, g, or t
  misc_feature (726)..(726): n is a, c, g, or t
  misc_feature (733)..(733): n is a, c, g, or t
  misc_feature (743)..(743): n is a, c, g, or t
  misc_feature (747)..(750): n is a, c, g, or t
  misc_feature (762)..(762): n is a, c, g, or t
  misc_feature (764)..(764): n is a, c, g, or t
  misc_feature (767)..(767): n is a, c, g, or t
  misc_feature (775)..(775): n is a, c, g, or t
  misc_feature (786)..(786): n is a, c, g, or t
gcccagacgcacaccgcgcatgctccgagcgcggcgcccccgacgcggcgctcggctcggctcgggcatttccgcctctttgttttaaactccggacgggctttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccggganacnnnacgngngagaccngctcgcacancacnnnnagatcccatcgnanggngacaccangcgacgacagncaacacagaggcgcgagcgaacccgcagcagaacgacaccacgagagaacagacgggtgacaccggcatgcgccgcagccccgcacaggcggggcgaaccggagacgacacgcgggtaggaccagggaacgcgtagccgaacagcgacgcacaaaaaccacgcgcgacgggcgagcaacaccgcggaacggggacacaccagcggcatcgcgacaaagcgctgcaacccgtcaggcacggcagcgcactggcgaaggcggcaaacagtaacaacgacagcggcgaagcacg

SEQ ID NO: 650312 - DNA, 162 bp, Homo sapiens
taatgaaactcgacggacgcgtgactagagaaacgccggtacttatcctacgagaatacatactatggtcgtccacgaggactgttaatagaacagctgaatgttcaagctgatgctagtgcagaccttagacggaactgagacatatgattttgtaaactc

SEQ ID NO: 650313 - DNA, 1177 bp, Homo sapiens
  misc_feature (815)..(815): n is a, c, g, or t
  misc_feature (818)..(820): n is a, c, g, or t
  misc_feature (824)..(824): n is a, c, g, or t
  misc_feature (826)..(826): n is a, c, g, or t
  misc_feature (833)..(833): n is a, c, g, or t
  misc_feature (843)..(843): n is a, c, g, or t
  misc_feature (847)..(850): n is a, c, g, or t
  misc_feature (862)..(862): n is a, c, g, or t
  misc_feature (864)..(864): n is a, c, g, or t
  misc_feature (867)..(867): n is a, c, g, or t
  misc_feature (875)..(875): n is a, c, g, or t
  misc_feature (886)..(886): n is a, c, g, or t
gcccagacgcacaccgcgcatgctccgagcgcggcgcccccgacgcggcgctcggctcggctcgggcatttccgcctctttgttttaaactccggacgggctttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggctcccgtgtcctcagtatgcatcaggtctcccgaacctcacagccccgcagggaggaggagaaggggaggatttgactttggaagtctctgtgaccagaaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccggganacnnnacgngngagaccngctcgcacancacnnnnagatcccatcgnanggngacaccangcgacgacagncaacacagaggcgcgagcgaacccgcagcagaacgacaccacgagagaacagacgggtgacaccggcatgcgccgcagccccgcacaggcggggcgaaccggagacgacacgcgggtaggaccagggaacgcgtagccgaacagcgacgcacaaaaaccacgcgcgacgggcgagcaacaccgcggaacggggacacaccagcggcatcgcgacaaagcgctgcaacccgtcaggcacggcagcgcactggcgaaggcggcaaacagtaacaacgacagcggcgaagcacg

SEQ ID NO: 650314 - DNA, 198 bp, Homo sapiens
tgaggctgaggcaggagaatgatcacttgaacccagtaggtggaggttgaagtgtgccgagatggctccactgcactccagcctgggcgacaaaaagcaaaactctttctcaaaaaccaaaacaaccaaccaaaaacccacccctgtactggcagagtgttggtaagagttagaaaagcattttgaaggtttccttgg

SEQ ID NO: 650315 - DNA, 358 bp, Homo sapiens
  misc_feature (32)..(32): n is a, c, g, or t
  misc_feature (62)..(62): n is a, c, g, or t
  misc_feature (66)..(66): n is a, c, g, or t
  misc_feature (130)..(130): n is a, c, g, or t
  misc_feature (139)..(139): n is a, c, g, or t
  misc_feature (198)..(198): n is a, c, g, or t
  misc_feature (273)..(273): n is a, c, g, or t
  misc_feature (310)..(310): n is a, c, g, or t
tgagagcgcagaggacgcagggccgctggagngcacggtaacgaagctagtgtgcggttggnaccnggctgagctttttccgggacccgtggtgctgaatggagaggacggagacgaagccgagccgcgntcctagcgngcgccgacgctcgagctgtagctgccaggcgaggatgtgtggagcgcaggcgaccgacntgtaaatgagaggtctcgggccccaggacccccggggcccgggattgagttatcgagggcagccgcgggggccanttccgaccgtgacaggccaaggcgacggcgccgcccncccgcccctttccgtgcagaagcaagcttcttccttttccgcgcccgg

SEQ ID NO: 650316 - DNA, 1197 bp, Homo sapiens
gcccagacgcacaccgcgcatgctccgagcgcggcgcccccgacgcggcgctcggctcggctcgggcatttccgcctctttgttttaaactccggacgggctttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacacctgtacgtgccctgcccgcgccacccagggagggcgcgcccttcccagctctgtgctcttcagaaccttggcttttgtgttaccacacgcttttagctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaaaa

SEQ ID NO: 650317 - DNA, 1203 bp, Homo sapiens
gcccagacgcacaccgcgcatgctccgagcgcggcgcccccgacgcggcgctcggctcggctcgggcatttccgcctctttgttttaaactccggacgggctttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggctcccgtgtcctcagtatgcatcaggtctcccgaacctcacagccccgcagggaggaggagaaggggaggatttgactttggaagtctctgtgaccagaaagccaaagatgttgaccaggaagatcaagctgtgggacatcaacgcccacatcacctgccgcctgtgcagcgggtacctcatcgacgccaccacggtgaccgagtgtctgcacacctctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaaaa

SEQ ID NO: 650318 - DNA, 123 bp, Homo sapiens
gacttctcccaggcagcggtgaggtggtcatttgcatgggactcatggggcatggaactgccccagctgggcaagcagagcccatgtagttcagaggggatgggctgactttagaaaagagct

SEQ ID NO: 650319 - DNA, 734 bp, Homo sapiens
gcccagacgcacaccgcgcatgctccgagcgcggcgcccccgacgcggcgctcggctcggctcgggcatttccgcctctttgttttaaactccggacgggctttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggctcccgtgtcctcagtatgcatcaggtctcccgaacctcacagccccgcagggaggaggagaaggggaggatttgactttggaagtctctgtgaccagaaagccaaagatgttgaccaggaagatcaagctgtgggacatcaacgcccacatcacctgccgcctgtgcagcgggtacctcatcgacgccaccacggtgaccgagtgtctgcacacctctcaagcccgacaaaagcaggaaccaggaccaggggcagagacgatcttgaagtgtacgcttataatacaagtgatgcttgtgtatttctcactttaggaaataaaatatttgccaatttgatagaaaa

SEQ ID NO: 650320 - DNA, 273 bp, Homo sapiens
cggggttgacaccagctcggggttgtttgtttgtttttgagacaagatctcactgtgtcacccaggctggaatgcagtgccgcgatcatggctcactcgacctcctgtgctcaagcgatcctcccacctcagcctcccaagtagctgcaactacaggtgcatgccaccacacctggctcatccctgcattttgtttttgtagagacaaggtttcaccatgttgcaaactcctgaactcaagcaattcacccaccttgccctcccaaccccgag

SEQ ID NO: 650321 - DNA, 428 bp, Homo sapiens
tataggtgagttcccgcagtttcaacatagcatagcgacgctagatcatcaggtagacttgctaattcgttgatcaaactttgacgttctttatcaaacgttgcttgatcaaactgatcccccgtcaccaatggttcaaaaatcatatcccgtaaaaaagcaaaagcatccccaaggagatgttctgcatggtcaatataagtgggcgctggcaattgcaaatggtaacgcacatggtgtgtttggcaaaacgtaccacatctgtttggaactgcgcccatacaaatcaattgttttttgcgcaacggcttgctggtcgggatatttttgcgaactgacagcggtcaaataagacaacaatgccgtgccgaaatggtatgcgtcagtaacggggccgaaaatcgcccggaattggtagggtttaaatt

SEQ ID NO: 650322 - DNA, 147 bp, Homo sapiens
tcgcctttcgctctctccctcctgtccctgctgcttcttcgctggcgattgcaatctacagccagtcagcttgtcctccaccagattgtctcacctatctcacagccggccctgctttggttcgtgtactcttcgtgttcctcgcta

SEQ ID NO: 650323 - DNA, 623 bp, Homo sapiens
  misc_feature (394)..(394): n is a, c, g, or t
tttttttttttggtttttggtatttcgcatttgagatgctttttataataaagttatgccaaaaatacagcaacaaatacagaaaaagtattaacaaacggagaagccccagatacacgtacagtaacaatacaaaaatgtgactggtcaaacagctcaagttcacatttaacactttcaattatttttaattacactatttctgttcaaaagaatgttttccttacatacaaccatgatcagtctttagtctcaatcgtaccaaaataaagctatatataagcactctgactaggtaaagtgtgaagtaccccgtgaagtggtctggggcttgaaatgggacacatggtctcaaatggactttaagcatgccttggcttaagaaagaaaagtnatggtgatgggttaaaaaggtaatactttttgaaacaacagattgaatatggttactttcaggctttatttaagaacattgcaagagacaaacagtttttaaggaaggaacctttaattggggtttatgtaaaaacctgtggaaattgaccaaggcttatatttaaaaagggaaatttggttttgggaaaaagcgggtctttttttttttttgtgggggcccccccccc

SEQ ID NO: 650324 - DNA, 1405 bp, Homo sapiens
  misc_feature (599)..(599): n is a, c, g, or t
gatcccaggtttaactttactttggtcgtccagattccggattcactacgatcatgacgcagtctgcaccactgggcgtcgacagcttcgattcccacagagaggagtcgacccgtcagatagtaaccattgaaggtgctaaccggagggctgacaggtccgggttggcggccagccttcctagacactgtgaggcctcgccgcacacggattcagtgggccgccctggcgtcgttagtcatacccacaaattaccaagttccgggtagagtgtaaccattgctcgaattggcacactgggatgaactgtgagatgactctgcagcgattcatcatgatgcatataccgaggacactaatttcagtagacacgtagcagtgccacgcagcactttgaggcgtaggttagccatatgctgcaactcctgaactcgtgaagtctagactagtgagccttaactggggcgagacattgcacacagtgagtcccaaggtcccctcgggcacggctatcgtgtctacatatacttatcgtgacttctgcgcttgaagaacgggacttctctccacaaagttcaccgtggttgacgcccttccgnaggtgtgaccttggggactgaccctgcctggtatcacaacgactgttggcaagtacatgcgtacggcggcagccaagatgagaccgtactgcaggcacgagcgaaacacaatcgtggaagttcagcctgtccacacgagtccttacttcggtacaggtcataccgtggccgcgtcgccagatgggggcccgacctttggagtccactcttgtaaacagcatccacggcagcgaaattcccagggatacttacccagcccacggggagactggaacgcacccaaggaattctttgcactacttctcggcgcactcctttgaacgcacgacaaggccgctggccttgcattgccctattcgcctaactttgggccctggcaacctgccgtgttcagctccgctacggcgatcggttattcgccccttctagagccgttaccctcggttggcctcctcggtgcctatccccgcgtaccatcattcattccctcccgttcactcgccgggcataatttatttgaaccgcgaacacggtctcaggcgaacacacaaccttccaccccaatttcacagcggccgaacatgtcccccatagtggtcgcctgctgcgcgtagcgacagacacagtggaaacaacgcttaaccactaccttaacgacccgccccccccgcgtcagatatgccacggccatacgatgggaaccgtaactcagcgcggtcgccacccgaccctcgtctggacccagttcacgagaacactcacaacccaccgcctccttttcgtcgcgtcacgccatgccaacggcc

SEQ ID NO: 650325 - DNA, 150 bp, Homo sapiens
tgctggctccgtgcctggtgtcatggggtaaatgtcttccgggtaggaatctgactacagggggaggagcagaagaggggacacatggggggcttgctgggaaagcccctaatcttcagtcagactcttcttactgatctccaatcaccc

SEQ ID NO: 650326 - DNA, 557 bp, Homo sapiens
ggtatgaaaagcacttctgtcgggtgtcgtcgacatgatgagcaaatagagttgactcagattaaatcagagcactagtacagtgtgcactgtagagaagaaaggcactccattgtgtgtacgatggagaagagctgacttgaatcaagcaatggggaacaaaaagaacataaagtggtcagcctgagcgggcgagatggaatcacatggcttccaaagccggaaaggaggctctgaaagccacacactggtgatctccagtggtgatacccaataacaatcagcatgaatctctcagacacattgtgttgtgaggcctgtaggcggattcaaatacagaggttgatggccacagcagcttggtgaggtccagctcaatttcaaactggttggttcaccagcatgctaacaggcttaggacttgctgacatttgcctcagatactctctggaggctgcagtacgttgaagcctaaggctgctcttccaggcagctgttgtgagtgggatgtggttgggtgaacatctgtgtagacatgggtattgctaaaatcatgg

SEQ ID NO: 650327 - DNA, 427 bp, Homo sapiens
ggcgggagacgcttaatttcccaaggcttccagaaaagaatttggtgaaaaaaaggtgaggagcgagtcccggcaggcaattgggatgggcttcgggcggcggtgaagttcgggtgacccatttccccagcggtgtcgtctccaggaccacccgttggaaataccaggcgggcttcacgggtgcggctctgtcggccaatgcccggttggttctgcagggaccgggactgtcccagggcttgtgagcacgggagcgcttggttgcctgcaagggaagtgcattggcttaaaaccagaaagaccacggcctgggagccattcttcaggaagggattcccaagggttattatttttctattaattgcggttgcaacttcgtgtgcttttatttaattaggcgctgtaggtaaggggctgtaggtaaggg

SEQ ID NO: 650328 - DNA, 1507 bp, Homo sapiens
  misc_feature (417)..(417): n is a, c, g, or t
  misc_feature (471)..(471): n is a, c, g, or t
  misc_feature (834)..(834): n is a, c, g, or t
  misc_feature (1244)..(1244): n is a, c, g, or t
tggaaaaaaaacccgccagttatttttttcctcttggaaaaacaaaacaaccccaaaattgggattccgggaaataaaatacagtatgagaatagggagaaaacgggctggttggtctatgaggaactctcattttcaaatcaccatttttattatgggaaggtaacttaacgggggggggcaaacaagagggccatggctgggagtctctaactttgggagaaattgggaagatatcaaaattttggctattcaacaaacaaaacaagggggggaggaaccccttgtggtaaaacgctctaacaaacccttaattttataccttttatattttgcacccaatataacaagagattacgctagggtgtacagaaaacacccagatgagtggcgtctaaagaacccgggtgtcgccanaaccccaatagtgttagaaaagcgcttgggggtgcgccttttctttcataagantctccccataatccgcgtgtgtgcctctttataaagaaaaacccaacccaggtttcttctcataacagagaaaagtgattacactctcgcgagaaaattcaccccacaggggggttctctaattacaccccacaaattttacattccctctcccttttttacacaacaccgcacaaagagaaacatccagaaaagggggggccaatgagtaagtcttctatcgaggtcttctgcgggccccccctactcttgtgggcggacagaggcgagcgacgtggggggccccaaccagggggcgctgttggggcgaaaaagagaggtcctacaccgcttgcgtcgtgccctcatacaattctgtggaanaggagggcgacaaggcaaggtgttgggccgccaacaacccaaatgtctattgggatacatatgtcatctatcacgacgcggcccatactatcaacagaggcagcaaaagccaaaaacatatcacagatgtggcggcacacaggtactaatacaaaagggtgtatcaacaactagcggggttgtgaccacgacaacgcctttactactttcggaggagagaaatttaaaatcccacccccgttttttatagtggaactcacaaatactaagcagcgaaaacagtttaagacctccagagcagctgtcttgtgtatacaacaacagcagaaattaaggcggcgggctcaccgcacataattgtttgtcgcccccaagacgattgtggtgtctgctggacacaccttcttgtngtcctacacaaagaggagagttggtgcccccccctttgatgtgtcctaccccccaagaaggggtccccagtgatgatagacacagggggtcgtcgaagcagcccaaccgacaaacgctatatgagcccgattatataaccagacaacttgtgtgtgaagaacaaaaacagtgttcgctgtgaaacgaacaaacaggatggctgcacagcactatcgaggtctccagaacatatagactagtctgcgccgcgtgtataacaact

SEQ ID NO: 650329 - DNA, 884 bp, Homo sapiens
  misc_feature (254)..(254): n is a, c, g, or t
ggcagacactgaccttcagcgcctcggtccagcgccatggcgccctccaggaagttcttcgtgggggaaactgagatgaacgggcggaagcagagtctgggggagctcatcggcactctgaacgcggccaaggtgcggcgacaccgaggtgtttgtgctccccctatgcctatatcgatttcgccgggaagaagctagatcccaagatgtgctgtggttgcgcagaatgttacaaagtgactaatggggctttnactggggagatcagccctggcatgatcaaagactgcggacgccaacgtggttggtcctggggcactcagagagaagggcatgtctgggggagtcagatgagcgtgatgtgggcagaaaggtgcccagtgctctggaaggaggggactcggagtaatcgcctgatggggggagaagctagatgaagggaagtggcaatcactgagagggtgtgttcgagcagacaagggtcatcgagataaggtgaaggacttgtagcagtgtcgtctgcttatgagcgtgtgtgggccatgggatatgcaagactggaaacaccccaaaaggcccaggaagtaaacgagaagctcccgagaatggtgaagtcaaccggcctctgatgcggggggtcacagaggcaccgtatcattaatgagggctcgggatgggaaactgaaggaagtggcaaccagcggggggggaggctacctggggggggctccccaagccgaatggacatcatatggcaaaagggcccattcattcctacctttgcaggccggaaaagggcaaacagaaagcccgaagaggggaggccccggcacaaggctctgaattccgggggagcccccaatggacacagcgggggggcgagc

SEQ ID NO: 650330 - DNA, 962 bp, Homo sapiens
cccgccgccgccgccgacatcatgaggtgaaatcgtgtcacttgcaagccgggcagtgcgagaaccaaatcggcgccaagtttgggaggtgatcagcgatgagcacggcatcgatcccaggggcacctaccaggtgggacagacgatctgcagctggaactgctatcacctgtgtgctacaatgtatgggccaccggcgggtacagtacagtgccctcgcgtcgcgtgctcgttggatctagttggatgcccggccgtccatggacgtccgtgctgctcggtggcccttcgggcagatcttcctggccggacaacttcgttttcggtcagagtgggtggctgggaacaactgtgccagggtgcgctacacagaaggcgcaggagctggtgtgacttcgtgtgctaggcatgtttgtcgaagacaaggggagcgctgacgcaccgctcgttgactgcctgacaggcgtttccatggtgatcgccactccctggagttgatcgtggagctggagtcttgggattgggtaaccacgtcacatcatcgaagcaacgatccgggaaggaagtacccaaaacagggatcagtgaagcacgtttaagatgttgtattgccttatgacccaaaagatgtcattaaaacaattggtggagcccttactaagcccaccctactcagtccacctggctcgtaagaaacaccaggacgagagctactgcattgctagaccaaagcttctctagacattttgtcagaacctaaaagctgagcagcccacctatggtgacatgaacacctggggtctgctccatgaatgggtcaccacctgcctggcgttccaagccatcaaatgcggactggccactcgctgtaatgactgatacccggttagttaaagcacgttccatgacacggggctgtaccacaacggcaatactcgaattgtacaaacaggtgtgcacct

SEQ ID NO: 650331 - DNA, 526 bp, Homo sapiens
  misc_feature (49)..(49): n is a, c, g, or t
  misc_feature (84)..(84): n is a, c, g, or t
  misc_feature (92)..(99): n is a, c, g, or t
  misc_feature (104)..(104): n is a, c, g, or t
  misc_feature (108)..(108): n is a, c, g, or t
  misc_feature (156)..(156): n is a, c, g, or t
  misc_feature (175)..(175): n is a, c, g, or t
  misc_feature (177)..(177): n is a, c, g, or t
  misc_feature (189)..(189): n is a, c, g, or t
  misc_feature (219)..(219): n is a, c, g, or t
  misc_feature (224)..(225): n is a, c, g, or t
  misc_feature (255)..(255): n is a, c, g, or t
  misc_feature (268)..(268): n is a, c, g, or t
  misc_feature (278)..(278): n is a, c, g, or t
  misc_feature (294)..(294): n is a, c, g, or t
  misc_feature (303)..(303): n is a, c, g, or t
  misc_feature (305)..(305): n is a, c, g, or t
  misc_feature (316)..(316): n is a, c, g, or t
  misc_feature (319)..(319): n is a, c, g, or t
  misc_feature (337)..(339): n is a, c, g, or t
  misc_feature (354)..(354): n is a, c, g, or t
  misc_feature (356)..(356): n is a, c, g, or t
  misc_feature (362)..(362): n is a, c, g, or t
  misc_feature (368)..(368): n is a, c, g, or t
  misc_feature (370)..(370): n is a, c, g, or t
  misc_feature (379)..(379): n is a, c, g, or t
  misc_feature (389)..(389): n is a, c, g, or t
  misc_feature (396)..(396): n is a, c, g, or t
  misc_feature (398)..(398): n is a, c, g, or t
  misc_feature (403)..(403): n is a, c, g, or t
  misc_feature (405)..(405): n is a, c, g, or t
  misc_feature (417)..(417): n is a, c, g, or t
  misc_feature (419)..(419): n is a, c, g, or t
  misc_feature (453)..(453): n is a, c, g, or t
  misc_feature (509)..(509): n is a, c, g, or t
aaaaccttgagcacacagttatgaccaggacagactcatctctataggnaaatagctgctggcaaactggcattacctggtttnttgggatnnnnnnnnaagtntgtngcctctcggcctggttagcaagaagcattcagggtaggcctaggttantcgtgttatttcttccctntnctgagcagaganttccagaagcaccataaacggagccagatnaaagnnccccaacacctccccccgccaacctttganagaatataggggnatcttcagcntggacacgcatgcatntcccctctnanaccctcagcanttnttccattcccatcaagannnccctcacggtccctntnaaactntgtcantncccctaganacccctcctnttttttncnctctntnctgtgccctctntnttcagcccctgttggttctaggttgagatgcgtncccacctgattaggtccaaatctgggctcttcgttagcactggggcctggcctctnccccctccaggacaggg

SEQ ID NO: 650332 - DNA, 180 bp, Homo sapiens
gggcacagtgggggttggacccggccccccaatttttttgcctgttgcctgtgcccttaaagaacaaaattgatttttgcccctttccctgtgtgaggttggccccgctttttgccccaggcccctggtggggggtttccccccccccccctcgttttgaataaagcatttgggccccca

SEQ ID NO: 650333 - DNA, 980 bp, Homo sapiens
  misc_feature (179)..(179): n is a, c, g, or t
  misc_feature (213)..(213): n is a, c, g, or t
  misc_feature (258)..(258): n is a, c, g, or t
aggaggccagcagccacagacaaggccttgtccagaggaagccaggcatgtagcaccaccagcctggtgtgctgcattctcgcgccccaaggtggggagtagggttatttagccctaggagaggagagaaagttggttttagcttaagacaatcaggaccattcaaggattttgaccanatggggttcccagtaggagaatttggagccaccnagcggggacccttttgagacctcactgttggtgcctgtagctctngtgtcccagaggtgttgttttgagcattcttacacccccagcctcccatgggctcatccccgcagagccccctggtaggctccctggagtgcttgcccggggtgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctgaaccatggcctatctcctgtggcctctgcctctggtgggaaatagcgcatacaggatattctggagcggtggttaaagaagagagtcacgtcaccataaac

SEQ ID NO: 650334 - DNA, 947 bp, Homo sapiens
aaacactgtgatagttaattattataagtccacactactctcctacgacactttcgatataccgtgacatttcgatacacttttcatacacaacgtgtctacttctatacgtttgccacaaaagccttccatccgacacaattatctccttcttataagccttttaacccattgtagattcgccctaccacgccaggacattcgacacaattctaaggtctgcctaaaacctggtatatattttccccacgcccctggacaattccgaacttacgaggccaccccaaactcttaaacctccgcccttataaacgtaccataattcgtgggtaacccctcatgcccccacttttcagacatgttccccttttgtaagaagctggcccccccccttttttggtcaaaaacccccccgtgtgtccacgcctcttgtaacaacccgccgacacattgccccaataatgttctatttaacaggaacaccatcttcgaggaacaatattgtaatggatgtcttggaatctacgtaaaacacttcggggatttctttcacccccccttttacattgtctctcaaagaattctcattgcccattattagcggtaaaacaatttctcaatcagttcagtcttcctcttaagtcttaaccgtgcgcaacatcacccttctgaatggacaccgggtagttaaaacccctgcggcgaacccaccaactgttgctcaaaacgccgagattatgtaatcatgtcacttgtgtgcacactaacacgagccccctgtaccttttattgttcaccccccgcagcatgtaccccactctctgtagtgcaccacgaaacacaacaatcttgggtattattctgaccccttactcttaccccactgcaccctgttcaccggattttcgactattcttttcaaaaagccctaaaaccccaaaaagaca

SEQ ID NO: 650335 - DNA, 944 bp, Homo sapiens
  misc_feature (179)..(179): n is a, c, g, or t
  misc_feature (213)..(213): n is a, c, g, or t
  misc_feature (258)..(258): n is a, c, g, or t
  misc_feature (908)..(908): n is a, c, g, or t
  misc_feature (913)..(915): n is a, c, g, or t
  misc_feature (917)..(917): n is a, c, g, or t
aggaggccagcagccacagacaaggccttgtccagaggaagccaggcatgtagcaccaccagcctggtgtgctgcattctcgcgccccaaggtggggagtagggttatttagccctaggagaggagagaaagttggttttagcttaagacaatcaggaccattcaaggattttgaccanatggggttcccagtaggagaatttggagccaccnagcggggacccttttgagacctcactgttggtgcctgtagctctngtgtcccagaggtgttgttttgagcattcttacacccccagcctcccatgggctcatccccgcagagccccctggtaggctccctggagtgcttgcccggggtgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggncagcnnncnttctctacagacccatgcccgggtacc

SEQ ID NO: 650336 - DNA, 128 bp, Homo sapiens
  misc_feature (49)..(49): n is a, c, g, or t
tgatcagctcggtacctatagccgcatccaggatttttgtggaagaatnattatgatgagtttgaagaaaagagtgcttggctataaaacactggccctggtggtagaataccccatggtgtgcaggt

SEQ ID NO: 650337 - DNA, 816 bp, Homo sapiens
  misc_feature (49)..(49): n is a, c, g, or t
  misc_feature (94)..(94): n is a, c, g, or t
  misc_feature (112)..(112): n is a, c, g, or t
  misc_feature (156)..(157): n is a, c, g, or t
  misc_feature (162)..(163): n is a, c, g, or t
  misc_feature (172)..(172): n is a, c, g, or t
  misc_feature (176)..(176): n is a, c, g, or t
  misc_feature (198)..(198): n is a, c, g, or t
  misc_feature (200)..(201): n is a, c, g, or t
  misc_feature (203)..(203): n is a, c, g, or t
  misc_feature (205)..(207): n is a, c, g, or t
  misc_feature (236)..(236): n is a, c, g, or t
  misc_feature (242)..(242): n is a, c, g, or t
  misc_feature (250)..(250): n is a, c, g, or t
  misc_feature (282)..(282): n is a, c, g, or t
  misc_feature (288)..(288): n is a, c, g, or t
  misc_feature (300)..(301): n is a, c, g, or t
  misc_feature (309)..(309): n is a, c, g, or t
  misc_feature (324)..(324): n is a, c, g, or t
  misc_feature (350)..(350): n is a, c, g, or t
  misc_feature (358)..(358): n is a, c, g, or t
  misc_feature (372)..(373): n is a, c, g, or t
  misc_feature (375)..(375): n is a, c, g, or t
  misc_feature (390)..(390): n is a, c, g, or t
  misc_feature (405)..(405): n is a, c, g, or t
  misc_feature (436)..(436): n is a, c, g, or t
  misc_feature (477)..(477): n is a, c, g, or t
  misc_feature (489)..(489): n is a, c, g, or t
  misc_feature (507)..(507): n is a, c, g, or t
  misc_feature (536)..(536): n is a, c, g, or t
  misc_feature (649)..(649): n is a, c, g, or t
  misc_feature (733)..(733): n is a, c, g, or t
  misc_feature (808)..(808): n is a, c, g, or t
ctgtgtgaacatgaaggactgaaaagcgtgggaatccacactgattgtnatcctacagattgtcatgagctgcacgtgtgccaatcagaaaggnatgggagtctcagaagancagcgtggcttacagacccttggctttagtgaattcaggaaagnnggaannatagtctcncctngtagtaaaactcaagacaaaanannancnnnttggacagccttctacattgtccaatgcngggcanggggccgngggggggccttttgttcggggtggcgccattnctcggntggttgtgtttnnggcttttnccttcctgttgggtntgttgttggggctttgggtggggctngtgctgcnttggtgggggttgnngngctggctgggcgcantgtgttgctaaactntctacaaagtgtggcagcatcaacccggganatggcacatttgaaccaggatcgccctgacatgggcttgcntttttgtatgtnttttccccaccccctganctagctggtatcttgtggatgtttctgtnacagtggtaaaagtaaataaattgcatttaaggggtaagcaggtgtttaaaaacaaaacaaaacaaaacaaaatgaaagaatgtggtcgcagctaaggaggttttcacatgtngtttaactccagtaaagtctgatccagcatctgatgcatactaaggttttcttctttggcatgagcaactttctcttctaagtnatcaatgcttttctccaatttagttactgacctctccgcaaactcagcccgagtatcagcctccttcagcatgtnggaaaggg

SEQ ID NO: 650338 - DNA, 126 bp, Homo sapiens
agcgggtctgggtcaggacccacatagaggaggtagataacgcgacttaccaagattgctgtaatgttttggagctacaagacttggcgttatcctagtatttacagcttggcacttactccgagt

SEQ ID NO: 650339 - DNA, 220 bp, Homo sapiens
cttacgccctcatacatcaaacattcatctctcagaccaaatcatttcagttccagaaagaaggccatattcacaaactcattacaagcctgatcatcttaatatattgtacggaactgtcattgtagctgaaatggcattttttctctcccctgatgttcttgcaaatggattcgtttggaggtagaataagaagtttgggtgacggaatataaacaca

SEQ ID NO: 650340 - DNA, 279 bp, Homo sapiens
ttttttaaaaaaggtttttttttttgggccccccgccaatcatgggggggagcccatgggacaacgggggacctttggtagtttttcaaaatgccccccttttacccgggtccaaaagaaacccaatgggccgggggtggtttttgccccccggttttttctccccccaggggaaaaggtttggggaaacccgccttttctgtttttttaaaaatacagctttcccccggccagtttaccaaggaagcccgggcccaaaaaagggttttccccctttta

SEQ ID NO: 650341 - DNA, 492 bp, Homo sapiens
acattgttcccatcctcagagaagtttcagtttgtacaaaagaaatacacacaattgcctattatttatattttagcacaagggaaaataatctcatttttaaaaattcttgacacagggaaatagatggaaaataaattttgaaaacttatttttaaaccatgtaggagtacttaatttgcagtgatcaatgactcaaagctcagcatgtcttaaatattccatattgctaagcagctgataatacaaatccatccttcattccgctgcttttctcttgatgtatctagcataattggtgttttcctatgtgtgtatctgaattgcatatttcacagttactgtagaaacctattactccttggcatttagcatggatgataatgttgctccttcagtaattttagcctagaccaaacatttttgaaatggtgttgtacattagggccatcttgcttatagattaataaaatcactaacctttacactaaa

SEQ ID NO: 650342 - DNA, 254 bp, Homo sapiens
  misc_feature (77)..(77): n is a, c, g, or t
  misc_feature (166)..(166): n is a, c, g, or t
ctccgtcgggggtatgtttctgtttgttacgttcaggactgagacatcttgtgtaactgtacccctggggcgtctgnacccggggtgaggcctcctgcctgcctggtgccctgtcccagccccaggtcttgtgcagggcacctgcgtggctgacagccaggctgtntctccagccggggctgccagcgcatctagccagcccagccctgtgaaggaatggagctgacttgcgtgcaggggacctgatttatagg

SEQ ID NO: 650343 - DNA, 102 bp, Homo sapiens
acgtaccatggcttcgtactcacacaggttcaaggaggtgccatcatctagtgggtaagctagagctcacccagtgtactgctttgtaaatagtcaaagact

SEQ ID NO: 650344 - DNA, 229 bp, Homo sapiens
ggtttttaaagggggaaaaaaaaaaaaaaaaggaaccctttggctttcccggggccctttccagacattcccctcccagattttagggtttggattcccgggttggggttttcccatgtttatggtaaccgaactgggcccccccccttaagaagaaaggaattattattcctcttggtgggcccccccggcgccttttatttttctttttttggggggatttttttta

SEQ ID NO: 650345 - DNA, 413 bp, Homo sapiens
tcgtgccgaattcggcacgagcctggccggggaatttaaataaaataaaataaaataataaaagaagagaaggaaggagagaaagaaggaaggaaataggtttacatgtcttaagactggatatttcagtggtagaagaagagggccaatgatacggagggatgttaaccaattctctacacttaataaatttaaaattaatattctgacttttaaaggcaaccctttggtcctccaaaagattaaccataattcataatgctagatgagcatcttggagcaagtacttctctttcactctcataacattcaacatactccggcctggacaacattaaggtgaccctgtttcttattaaaagcaagagggtaggggaatttttttaattttatttatttatttatttatttat

SEQ ID NO: 650346 - DNA, 523 bp, Homo sapiens
gccggtaccgacggtgtctggctgactctagaatctacttctaccaaccggatagatgtgattttctgagatcctgagagtttcctctcctaacatctcaggcagaaaactccagcaggaagtagaatcctggtgtttaatgatttcttctctgtcttactcattctgacagtaaagcaggtggaaataaaaatatgcattattggctgagtcgagtggctcacacctgtaatcccagcactttgggaggccgaggtgggcagatcacttgaggtcaggagttcaagaccagcctggacaacatgatgaaatcccatctctatcaaaaaaaagaaaaaaaaaaaaaatttagctgggcttggtggctcaccattgtagtcctagctactcagtttgagccaaggaggcggaggtggcagtgagccaagatcatgccactgcactccagcacaggtgacagggtgagactctgtctcaaaaaacccaacaaaaaaaagaatttctaacagaacaccgtcgaggg

SEQ ID NO: 650347 - DNA, 113 bp, Homo sapiens
  misc_feature (42)..(42): n is a, c, g, or t
  misc_feature (73)..(73): n is a, c, g, or t
  misc_feature (87)..(87): n is a, c, g, or t
ttcgaccgatcggaagtgggggcgggacggcagcgagggtgngggctcagatcgccaggcagccgtgggtctncagggtccggtcgngacccttcccttcccgggcgggattt

SEQ ID NO: 650348 - DNA, 268 bp, Homo sapiens
ccacgccggggcccgcgaaggcggccactttcatgtggctgtcgtgtcggatcgctttaccggtttgcaaagattggcccgtcaccgcctcgtttatcattgcctgtccgacctgatgcagcgcggcatccacgcgctggccatcgaagcccgcgccccgggtgaaccctgagacaggtcgagcatgattgaaccgcgcgcccagcaaagggcgcgatttttttagcctgactcacaccaccccatgaagaagcttgcgctcgccgcc

SEQ ID NO: 650349 - DNA, 187 bp, Homo sapiens
  misc_feature (1)..(3): n is a, c, g, or t
nnntcagcgatgactatcgagcataagcctggaggcaaagatggagagatacgacgatagaactgatggatcgataatgggacgaggaggcaccccggacaatggcatcctgagcatccatcggatacccaaatcctgcttgcagccggaggttgaagcccggatagagcgagccccaggccttgca

SEQ ID NO: 650350 - DNA, 766 bp, Homo sapiens
  misc_feature (31)..(31): n is a, c, g, or t
  misc_feature (63)..(63): n is a, c, g, or t
  misc_feature (72)..(72): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (141)..(141): n is a, c, g, or t
  misc_feature (158)..(158): n is a, c, g, or t
  misc_feature (164)..(164): n is a, c, g, or t
  misc_feature (169)..(169): n is a, c, g, or t
  misc_feature (189)..(189): n is a, c, g, or t
  misc_feature (205)..(205): n is a, c, g, or t
  misc_feature (214)..(214): n is a, c, g, or t
  misc_feature (233)..(234): n is a, c, g, or t
  misc_feature (248)..(248): n is a, c, g, or t
  misc_feature (283)..(283): n is a, c, g, or t
  misc_feature (398)..(398): n is a, c, g, or t
  misc_feature (757)..(757): n is a, c, g, or t
ctttttgagttattctctcactcccccggcnctctctgccggtttttgtttagccaggctctngtctgggtntttcgtggtcactgcttttcgactgtttggcgcaattcctctttttctcacctcttgatncgnantttnctcggttctcatgtccnactgcnatatngtgcccggttcagtgtggcngtcttctggtttcaanatgtggttntacttgggctttgaaaaannctccttacctgctnaagatctaggggcaaaggtcaaagcgactgttganagtcattgcacacatcttgggcttcaaaacacacacgtgggaccgcggtgagtgctctcccttctgtgtctccagggtgctaagccactatctggggccctggggccccagggcngccctcaggcctccacaggccctgggtgcctccgcgcgtctgagaagagcccggactctacccaggcatccagagacttcctgagcctgacctggaggcattaaggagcctgccagtcactgggcgcttccctgtgaggtctcattcatgggatctgagcacacggaaaccaacgctcacccctcataacccagaggacaaggggagttgcagcgtgtcttgcctagttttagaatgtatttgatttcaaaatcttttgtggatcttctattaacagtaaatgaacgcggtattcctgctgtaggttactctataataaacgaaaggaactagaagggctgaggtggcctgagtgagtntgagtttca

SEQ ID NO: 650351 - DNA, 176 bp, Homo sapiens
cagatgggggtaacattagactagcgcccccaggatgtccagacatgaacatgcgtgcctgcagggaacggtatgggtatgcattctgatgttcgcagagctagctgtgggctttgctgaagctcggaagctcccctgatgacctgatctctgctattgaaacttctaaaactagg

SEQ ID NO: 650352 - DNA, 392 bp, Homo sapiens
ctcaagggatatttaaagggttcggtggccaagtttagagttcacttaagattctatctgggtcaaacagcgtcccacgtcgcgataggttcagcccctcttcatataattcttccaggtatttgttccacattggcctgcaaacgtacagctgttcctaggtagctcctggcctccgggtgtcaatgcttcggctatcctcctaagttagttaatcagatcctctactctatgtctacagaggttcctctcgcggtgtccaatgcttgcacaaacaccgatattcccctggaattatcccaatgcgcatgtcactctccctgtaactgatccgagatctggctagatagctcatataaccctgtgcaattgtactcctcagtatatttgcg

SEQ ID NO: 650353 - DNA, 144 bp, Homo sapiens
  misc_feature (60)..(60): n is a, c, g, or t
taccgtatctctaacattacgagtcacaactaaaaaaaaaaaccccataccacactgaantgtaaattttaattataaaacaagaatatgaacaaaacattttaaaataatctcaattattgggcaactcatcacatcatggca

SEQ ID NO: 650354 - DNA, 372 bp, Homo sapiens
  misc_feature (197)..(197): n is a, c, g, or t
ttacccttaccatttactcccaaaaagctttttatttttatttttttgaagggagtttttcgggggggactctggaacaagatttggctttcaaatcattgtggggccccccaccaaaaacccttttatttttgggggtcggggcctttttagtagggcaagggggggttaaaaccccaaaatctttcccccttccngggggggtttgcccccaggtttttaattccccccccttactttaacccctgacagggcggtccccagtcagggccgggcccggggtggggccctttggggagatgctgccccccccccaaaggggtgagccccgcttcccgggcccggttcccttggaaaaaaaagatttttcta

SEQ ID NO: 650355 - DNA, 175 bp, Homo sapiens
ctacgaggctcccccctgtcaggggtggctgttaattcttcagtccatggcattcgcagtgcccagtgatggccttactctgcactatagccatttgcccaacttaagtttagcacttacacgtttcagtaatagctgaacctgttcaacatgttaataaaggtttcgtggcatg

SEQ ID NO: 650356 - DNA, 588 bp, Homo sapiens
gctatgggtgcagaaatatggtttaagcacggtggctcatgatcatgttcccgaaagaactgccgttgccacatccaggacggatacaagctaagcactgaaaacccacaagatggagactcagtttagagtcatggtctatctagtgagcgccgcaagttcacctatgttccaactaccatacgggcgcgttggaacatggatgaggagcagatggcgttcttcgaatcatggtttgcccggacacttgtcgacggcactctgtggtttgaggcaacgcttaaaacgcctgttggcttcaaggattagatctgcaaaatcaaagggatgtatgacggaccagagcttgtccaggtgaaccgatacgagatgtcgggcacgtttcttctgcgcgataggcctttgatagagccaggatgggaaaactttcctgagctctggttcggcaagaacatcatcgacttagcaatcaacagggattggccagaagcatgagcccactcgacgtttgctatgcatcgccaggcagcgaagtgctcatcccggcatttgagctgtttagcgattcctggagaacgaccaccgagg

SEQ ID NO: 650357 - DNA, 518 bp, Homo sapiens
attctagagtatcccctcttggttctataccctgaaaactgcatcactttcatggtggagcattgttttgtttccatactgcatttcgtgcttggcgtagctgtgcgattttaccagtgtggtactgcttgtgcagggtctctttagtcagatcttccacgtccgagtcttccatccagttgacgctgtaccagtcccccaggtacgtggacctcttctcatcatagtaacaggcgtaggacgactctctggggttggcagcagtagttgcatagacattgatgttatccggcaggtggttcatcatggacccagactcacaggcttcaatgtagaacaccatctttcggtacattttgtgtttgtacatgtaatggatggtctcattcaggtcctttacatgaagatcttcattgggaaaaaccagtattccagtagatccatggtcagtgaagtaaatgaacacgtgatcctgggggccactcttcaggactatgccggatcctatgcccttcact

SEQ ID NO: 650358 - DNA, 573 bp, Homo sapiens
  misc_feature (525)..(525): n is a, c, g, or t
tccacaaatagcccttttaattggcccctatttgaagtctgaacttataaacaaatcctgggccggggggtctcatatccatcagctcgtccaatttatagccccccgtttgctcgtccccagggggttttcccagagaactacgtggcgcttcaccattagaagcgcctccattagacgcttctcccaattctcaaacttgggcgcttctctcagcatttttatactttctctaacagaaagactctcatgggaaagggataaactaagattgggaacgcccttttctctatgtgttctttttccccaagtgggtctggtctccgggatactccactattcttatgtgagaccccactctttctctgtatcacaagtgtctcattgtgtgggtctgtgacaccctctctctgcgggggtctccaaagtgatttctcacactctcatctcttctcttctccgagatatgtgtggggagcccccgtgtgtgtgggtgcttagagcgcaaataaaagagggggtccntctccggaatctcgagatgtgggtggcggtttttaaggtaaaaacccc

SEQ ID NO: 650359 - DNA, 942 bp, Homo sapiens
ttcctgcatctaaccggtccctcgccagcacccggggtgactgccctgtcccaccaggagagagggcgaagggatgagcctgggtttggactctaaaatctcagcattgccccatgtgtcctagacttcccaagggcaagagtgaagaccctgccattccacatcccctatcctctgaccaggtgcttgggtctctgaaagcaaacaggaaaactagagaccaaaaaggggacacaaggagaagggctgagccacaccttcttgctcttacccttggtgcctaaatgctgtgatgatgcacctgcagggtgtgtgctagcccttcctgtgccccgttccttgtgccagaggtcaaaggtgggggcaggctgggacctgcatttcatggggcaggaacagagggtgaaagggacagatagattgcaggtccagttctgcatctcttggctcgagggtggcagaagttcacgcctgtgcacgtcccgttataaagtccctcactaccaagggctgtacatgtggcttggggttctactgccgtccatctcaagccattgtgagcatgtgaaacctcctaaacgtatagaaggggctaggggatccctctttccctattgcttcactctttaatacccaagagaagttgggccaagaggggagatgtgtaggttaatcccgggctgtcagaaggaagctctgcatatttattagctttgttaaccgtgggaatgggccctttccaagggtctggtgggggccccggccgaaccccatttttccaaccattggtttggcaaaaaaccctggcgccgttagaggggggggagcccggtgaaacaccacaggaaatgatttagaagcgggcacaaaaacacaaaagaacacttctgtccctctctttttttttcctcattcttactatattccgcttccgggggggga

SEQ ID NO: 650360 - DNA, 1815 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggcatcatcgccactcctggtcgcagctgaagcccctgttcgtggccccagcttgtaagaatgagatcatcgtgtgtactgtgctgctatccgtgtgggagtgacctcgtcagtcaccctaatcgcagagtgtcccacgcgtcgtcgagaactgaacctgatgagacatccaacatgatcacacatgaacaaagacacactatcgatcacggaaccacatcacacacacaaaacacctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 650361 - DNA, 709 bp, Homo sapiens
gcggccgctccaacatcagaatgtgcccagtcagcagctctgccaccatcctgctgggaactggggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 650362 - DNA, 346 bp, Homo sapiens
tctggagaacagaatctggcggtggtcacccaagctagagtgcaggggcgccatctcggctcactcccgggttcaagcgattctccggcctcagctggggaaatagagatggcagtgagccaagatggtgccacggcactccagccggactaattttggtattttaagtaggcacagggttttcaccatgtgggccaggccggtcgtggaactccgtgacttcgagtgatccacgtgcctcggcctcccaaaatgcggggataaaagacgtgagccaccatgccgggccccacggttacttttattactacctagaactacactggttgaaatggtcgccaatccg

SEQ ID NO: 650363 - DNA, 1016 bp, Homo sapiens
cgtgcttgcgcgtgggactgggcgatgtgtccgttggcctttgttcgtgggtgatgcggggcgccgtaggtccttggttccaatagtgtatcgggtgaagcttttgcgtgtaacctatctctgtagtgtgtgatccgagggtgttttctgtccgggccctttcggggttccttgcccgcgctccagtggattgcgccgatacgcgagctgagctgtctgctgtttcaggttccaggagtgagtaaggcttgagtaggtcatactgggtaacagtcctagtgtcaaagtaggatgtgggccagcggctattactttggttttgctttgacgcgtaggactttccaatagggtgtatgaatattagactatctacagatgcgtagtgttgttcgctgctctgtggcatcgcataaggctgaacctgatgcatggtgtggaacctggataatggatttggcttataagtctagttacgtacctccgaacacagagtctagagtgggtagctaattattattgtgctggttaatagccctatgctggaaggcaaagtacgaagctgagactctaacttcaggactacatcatgctacccgctcaggccttgcctatgttccgtgagcccgcgcctaactggagtacaaggaatactagctggatgataggtacatgtactggtatcccctgatagtcgcataaacctgaacctcctgtagcaggcccaggtcgtggtggccgagattggaacccacgggggcactctctcttcctatattgtgatagaacattgcattatggatcaagactgatgacgagtaaatcctcagggaagccattagtgcgtgcatgcacatagcagacagaagacagcccatattgggtttctccagcatattccaagaactcagccctaaaaccatgtttgccacaagttgaatctgatagatgaggaagcagagaatgagccagaatggaaaaaaacgtaaaaatttgaagagaatctattcttgaagaga

SEQ ID NO: 650364 - DNA, 174 bp, Homo sapiens
caccgagggtccagatgttcaactgcgggcagataaaggtggagaagtttatttatgagaacacctgatgttttctctgacaggtccatggatcacttccagaagttctttcaacagtgggggggagctgagcacacatggtccgggatactcataacaggaagagcaacggga

SEQ ID NO: 650365 - DNA, 337 bp, Homo sapiens
tcagctcgtcagggatcgctatctgtggttcagttttttgggttcatatgattttagaatagattttcctaattctgtgaagaatatcattggtagtttgatagaaatagcattgaatctgtaaattgctttgggcagtacggccattttaacaacactgattcttcttatccatgatcatggaatgtttttctgtttgtatcatctcagatttatttcagcaatgttttgtaattctcactgtagagctctttcgcttccttggttagctgtattcctaggtattttattctttaggtggctactgtaaatgagattctgtgcagaggcattttga

SEQ ID NO: 650366 - DNA, 273 bp, Homo sapiens
cccgcgggagtaaaaaaaaaagggggtgggaggaaaatgacgagatataaatagagacaataggggataagtagaatggaaagatttttttaaaaagaaaggccttacatatttataactgaatccagacaaccaacgtgttcataacctctctctctctctctctctctctctctctctctctctctctctctctctctctctctctctctctctctctctctctctctctctctctctctctctctctctctctctctctctctctctctc

SEQ ID NO: 650367 - DNA, 439 bp, Homo sapiens
cccgttttggtaaacagccgagggacggggctggagaattgtaacctctctcaaatgcatagctagagctatggatgcaaagactgccaatccatgatatcaacattctagttttaaccatgttgaggctatttgttcacatttacattgtttacaaacggagtaaaacaagcttatattttgaattaagctcatgagccatttataagttccattcttcaagaatcaatgggccagttgctaagtccaaaaatggacgtagcaacggctgattgaccctttaaggttatgatttggtgaggggaagctgagtctagctctgtaccgagggaaacttcaccccagagtccagaagccaaccagcgtcatcggaactgttagaactcataggaactcttagaaccgtcgacgcggccgcgaatttagtagtagtaggcgg

SEQ ID NO: 650368 - DNA, 322 bp, Homo sapiens
  misc_feature (272)..(272): n is a, c, g, or t
agctgagcagcgagtagagtccgtcgagaggatggagctgtgcccggagaggctgacttgctgctcttccaggcctaattccaggccgactagaggacgacccgtgcctgcacaggccgccgggaggccggagctggccctggagaggccgacttcgggacgttttgggcctgcagaggccgccgggaggcccaagctgggcctagaggagcccaccgaccggaggccatttggggcctgcagatgccatcggagggcaggagctgagccgngagaggccaccgtgaggcctgagcctggcctggggagcttggctccagga

SEQ ID NO: 650369 - DNA, 283 bp, Homo sapiens
ctcaatggaatcctagaaaaagacaccacaaattaactagtaatccacagaaaagactcagcctgaagaggaactggagggatctgagccgcctcaaccaggtggcaaagagactgccccagcagcagaagaaaagaagaaagatgcaggtgtagagacagagatcgagtctatacaagggcatgccgaagctcaacctataagactagaggccacaggcaggcatcagtcaatcatggtaccacggacctctctacacgcagtacgggtgcagcggctgaaa

SEQ ID NO: 650370 - DNA, 220 bp, Homo sapiens
gcacaagctagatacactgtcagatcctctggcattctgaggaaattgaaaggtttcttgtcccttacagttctggggggcacaggacggaggaatttttggagagggtcttaaggtgcgcggggtattgtttaggaaaacacacttctcagatactctgagactctgtgtgttttgggtccacggacacatctgctgctctggtatcacatatatcccc

SEQ ID NO: 650371 - DNA, 225 bp, Homo sapiens
  misc_feature (35)..(35): n is a, c, g, or t
  misc_feature (59)..(59): n is a, c, g, or t
  misc_feature (61)..(61): n is a, c, g, or t
  misc_feature (104)..(104): n is a, c, g, or t
  misc_feature (145)..(145): n is a, c, g, or t
  misc_feature (150)..(150): n is a, c, g, or t
  misc_feature (181)..(181): n is a, c, g, or t
ttagagatcccgctattacctcccaggtttgctgngctcaggaactcactctgctgggngnctgggcctgtcacgatcccatatcaaggcaggtacctgacgcnagccccagcccccagcacgagtgagtccctgagcccagcanaccancagccagttcaacctccctacggagtaccangcatagtgccaccagctgtttcattagcacctggaaggccctca

SEQ ID NO: 650372 - DNA, 152 bp, Homo sapiens
cagatatagccaaggatgcatagtactctcatttcagcatttcctccaaagctgggcagttgttagcgagaatgaccaatttcgcttcgccttgtcgagatcatcttcagcagtgtgatgagaagaccctatactcagaggcaatccagctt

SEQ ID NO: 650373 - DNA, 447 bp, Homo sapiens
aagaagaccacggcctttccaaggcacattttacaacgctgctagtccctctaaaatcagtaggatctgaaaacagcttcaacacaagcatacacacacacaaacacttagacatagaggttccatatcgtaaccttgtgcttctctagtgagaatggtaagctcagggcatcatccacatgcaactcaacaaaatggtgtcatcaatttctgtcatgcaacaatcatccgaatccatggttgggcacagcagcagaaaggtgttctgaaatgcagcagccagatctatgatctgtcagtaaaaacaatcaacgtcagcacttccatgtgataataaatttgcaagtagaatttcgatacaggtcatgtatacaaggtccatattaaaaataatatccaaggaaagaatgaagagaaatttggttccagatcataattgaattccat

SEQ ID NO: 650374 - DNA, 100 bp, Homo sapiens
aaacaccgcaatctgtaggagcataacttgagccaggagtccaagatcagtctgggcacatatgcatgacacccatctctaagaaaaaaaaagaaaagag

SEQ ID NO: 650375 - DNA, 442 bp, Homo sapiens
  misc_feature (40)..(40): n is a, c, g, or t
  misc_feature (51)..(51): n is a, c, g, or t
  misc_feature (435)..(435): n is a, c, g, or t
ttccctcttgcttcaagacacttaccccttttccccaccntattgcctgcntacttgaatgaaacaatcgctgggaaagcattaagagaattaaggctgggcactgtggctcatgccctgtaatccccagcactttgtgaggctgaggcaggcagataacttgagccccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggcggaggctgcagggagccaagactgagccattgccccagcctgggtgacagagcaagaccctgtctctaaaaatgaatgaaaggaaggaagaaagagagagaaagagagagaggaaagaaggatgnagtaaag

SEQ ID NO: 650376 - DNA, 262 bp, Homo sapiens
  misc_feature (103)..(103): n is a, c, g, or t
gaccctatcacttcagttctgggactgaaaatagttcatgctttctctgtctgtccacagcttacagtcacaacatgtgtgcatagcctcagtaggtcagatntgactggatattgtgagcatatattggaacaaattattttaaaaaggacacttctatatgaagaatatatagtaccttactaaagagtttttctacactttcctcataaatgacctatttagcactagtctaaacactgcagaaagacaaatcttagat

SEQ ID NO: 650377 - DNA, 788 bp, Homo sapiens
agcgggggaggcggctggcgcagacaaaggcacgggcggcgtggagtggcggcgcggactgaggtgggccgggtggaggcaggtggtggacgtcagtgctgtgtcgagctgagtgaagctgagttgaaaggtggcttgacgcggcctggctcgagtttggttcgacgttgtagcggggtggttggttggttgcgtatggaacgatattcgaggagccgagtggattgcgtggccgatggctggacgaggggtagtagggggggtacagttcggtgcctgtacatgggagtaggaggggatcctcgaacggtgtatcccccatggtgatgcgcgcctgggctcggggcgtggcgcgtggcgtgtggcgctcccaggtgtcgcgcctcatggctgtgttcgaggaagtcgtttaggacggagcttttgaggggacgtcgttctcagatgcggtgctaacgaaattgttcgtagaaatctccccagaattaccatctgattaacgcttttgcataacaaagcagttagaaaaaaacgtacataccaaagacagtctgcgcatcccggggtcggatatcacggggcctatgaatcgcgtttcgaaagcgcgttgcgcccacggggggacgcgacgcggtgttagcttaccccttttttggttcgcaacgtggttagaatgcgcggagccattgggcggatgacatcgagtgggtcaatcagctgggtcactcagtgttggtgcaccattggttttatccctgcggccactaactgcccaaacaaaacctaga

SEQ ID NO: 650378 - DNA, 123 bp, Homo sapiens
caggtcggtacctgtggtccttcccctactcatcgactaatttacactcacagagacctgaggctcataaacattctactactcagtctcactgcccaggacctcatgtggagcctcatgtgt

SEQ ID NO: 650379 - DNA, 212 bp, Homo sapiens
  misc_feature (73)..(75): n is a, c, g, or t
gagtcccgagcctgagccgcaatcgctgcggtactctgctccggattcgtgtgcacgggatgccgaagcttannncaggaggcttcgttttgccctggttgcaagcagcggctggggagcagcggtccctggggaatatgcggcgcgcgtggatcctcctcaccttgggcttggtggcctccgtgtcggcgggagtcgagagcagactgaca

SEQ ID NO: 650380 - DNA, 226 bp, Homo sapiens
tgaagcaattaaaacagcatggtactggcaaaaaaaaaaaatagatatattaaccaattgaacaaaatagagaccccagaaataaacccatgtatgtacagtcaattaatttttaacaaagatgccaagaatatgcaaagggaaaaagacagtctcttcaataaatggtcttgggaacactaaatatccacatgcaggagaataaaattggatcctcatctcacac

SEQ ID NO: 650381 - DNA, 328 bp, Homo sapiens
attctgaatcacattggacagccccatgcctgctacacacacacacacacacacagacgcacgcagaagcacatgcatatgcacacacgcacaaagcgtagtgaaggaaaagaaggcagtgattctgtcccctaaagaaaaccgtgatacttatgagaccacttccatctgacttccattccgggtgtcactaaatagctttgaggactggggcatggaatagaatgcagaggccttctttaaagtgcgctacattgactgtagcatacccctcatatagaagagaggtaagagggctttccagaatgaacatggaaatgttccaaag

SEQ ID NO: 650382 - DNA, 492 bp, Homo sapiens
caaaacatctaagagatattatcttttgtcctacaggccactttatgggagaatttagcttaagaaagagggtttctgtgtgaaagtgcctgaccaccactgcccagttcaggtgagggacctgagtccttttccttttttcagtctttcagtggccgtttcctagtagcttcttggtaattgagggaaactggccgggaccactctctactgttacctgaaggccaaggagtgaacctgggatagctcccctgcccagaaggcggaaggactcttttgtatctttttgagttatagtccctgatccctacctgtgatgcaattggcagcagaagctcgtccagggtgaactcacacacatttcaggcgacttaaaccctctttcttaagctaaattctcccataaagttggcctgtaaggacaaaagataatatctcttagatatgttgacctcccttctcctactgaatcgcttgcctgttcatggggac

SEQ ID NO: 650383 - DNA, 507 bp, Homo sapiens
  misc_feature (237)..(237): n is a, c, g, or t
  misc_feature (239)..(240): n is a, c, g, or t
  misc_feature (260)..(260): n is a, c, g, or t
  misc_feature (262)..(263): n is a, c, g, or t
  misc_feature (356)..(356): n is a, c, g, or t
  misc_feature (381)..(381): n is a, c, g, or t
  misc_feature (426)..(426): n is a, c, g, or t
  misc_feature (487)..(487): n is a, c, g, or t
  misc_feature (490)..(490): n is a, c, g, or t
cactaaagttccaaaagggctgcttctttcacctgctctgtctcagcacactaccgaaacacagaatataagcattacttgggctggtttttgtaatgctggacaagttttggcaacgttcccttcatttcaggggagaaatccaatattctcacttccaggcagacccctagtgatcctgatcagatgaacgaggacaagcccttcacagggcacattcaccatagctacgcaagnannggactccaggcgtgcccaananngggcagtggttgtgaataccaagatgacggaataacatgccaaacctacgatgaatgagagatatgtgaagggacctccccggatgtaaacanatctgcaaggccaactgcaaggaancaagctcggctgggataggcggggatgtcttattcccacacaggngcccacgttgaacaccccgcctgagcatagctgacggcgcctctcgacgagacgacaccanacncccgcaccacacgccac

SEQ ID NO: 650384 - DNA, 187 bp, Homo sapiens
  misc_feature (87)..(87): n is a, c, g, or t
tctgagatcccacgaagctctcatcatagagcactgctctggtccttagtgctctatgttttcataaaaaatcaaaacagtatattnactttttttggatagagttcatctgttccaggctgagtgcagtgcgtgtctcagctcatgcaacttcgcctcccagtccagctcagttctaggtaccgag

SEQ ID NO: 650385 - DNA, 130 bp, Homo sapiens
tgctgggattacagacgtgagccgttgcgcccggccagtaaaaggcaatattctatcacattatgctggtcacccaaagctagaaacatacatcaactatttctctagggataatctctgatcggccact

SEQ ID NO: 650386 - DNA, 696 bp, Homo sapiens
aatataaaagggagttggagacaaaaaaaaaaaaaaaaaaaaaaaaaaaaaaaagaaaaaaaaaaaaaacacaaaaaaaataaagacaccaaaaaaaaaataaaaccaacacataaaaagaaaaaaaaaataaacccggtcgttgtccgcccgggccctaaaacttttttttctgggggggggctagggccgcccccccaatttcgccgccggccccccttttcccctttggggggcccttttccttttgccggggggggtttttccccggggggccgggggaaaccccgggcggtccccatgttaaatggggtggcggaccgccctttttcggcgggtcggttttgtgcgctgtgttttttacccttttttttttgtgggaaaccccggtcttctttttggttcttctcccgcttttgttacaccacccgccctttcggggaattccctttgttattcaagtgtttccccctcttttggttccgtcttccccctttgaacccgcgcccctttttgaggggggggccccccccccttaggcgccaaatccctcttctgggcgggccccttttggggcccttccgctctgggggttggggggggggagggcctttggcttcctccggggccttcgtgggccccctttctggggcttggcgcccagcccctccccttccccaaggtggtttcacccta

SEQ ID NO: 650387 - DNA, 1010 bp, Homo sapiens
  misc_feature (497)..(497): n is a, c, g, or t
ccccagccgggctctgctggtagcgtaaagccatgatccgatctctctcccgggggagcaaaatggacgaaaggcgaccccccaggcagggagccgcctgggtgccttgggaatccggaggaatcccttctctttgccagtcttgaggagactagactgagagcctgaaggagtgagtcaggagatgggccgagcgctgccccccgggggtcctcgcgcgccgggcgcaacttaggagcgcagcgcagctaggctccattcccggccgccgacgctcagcccattacgcaaacactgggcgggtccaaggcgaaccaccggctcgtgtccgcacgcctggctgggaagcccatgagagggcgctgcgttgcaggagcgttccggcggcacctacagacggagggcttggaaaattacccatagctacttgtgcgccgttcggcctagaagcctctcgtctcaggcgcccaacgcctgggctttcctgccctttcganatgcatgcgctagtcttgtctcccccagtaacttttgagtgcggctggcgtgggcgcaggggcgcaagggggggcctgcatgcgccttgcgtcgccgccccctcccgcccgttcttcttgtgggcctcgccacggacggtttgcggatatggcaagggcacggcggtggattgggccccgcagaatttcgaacagcccgcgggtggcaaacatggcccgtgcaccgggtgtgccaaaaaagcgcccttcccaaggcggccaaatggggccctccacaaggcccaagcgaagccaacggattccagccgcgacccgcaggaaggaaatccatggcacgataaccacggcggcgagccaggccatgggggggtacgcgagcaaggccatacctgggtgcacaaacagccccgaaggaacacccgtgcgaccccctgaagaacaaccgcagagcccagatcgtcccgaacaagccctggcttggggaaccactactcgttgagaactccagccgga

SEQ ID NO: 650388 - DNA, 198 bp, Homo sapiens
gctcaagatctacagcagcacagcttccagagagcagacttgtgtgccccacctatccctctaacacattctccactgatgatgcactaacacttgcctcccactgcagcctgcggtctagccagcttccttagcaccaggcataggactagcctctcggtgggggctgctcgccaccaactcatgtgtgctcttgct

SEQ ID NO: 650389 - DNA, 369 bp, Homo sapiens
  misc_feature (92)..(92): n is a, c, g, or t
  misc_feature (322)..(322): n is a, c, g, or t
ttcaaaaattagctgtttttgaggaaagctcagtgaaactcaaaaagaacacaaaaggaattcagaatcctaccagataaacttaacaagancgggcacgattgctcacgccggtaatcccagcactttgggaggtgaggtgggcaaatcatgaggtcaggcgatcaagaccatcctggctaacatggtgaaaccccatctctaccaaaaatacaaaaaattagccgggcatggtggcacatgcctgtagtcccagctactcaggaggctgaggaaggagaatcacttgaacccaggaggtagaggttgcggtgagccgagntcatgccactgcactccagcctggacaacagagtgagactctgtctc

SEQ ID NO: 650390 - DNA, 234 bp, Homo sapiens
agtacccgatggtcgatcactgtctcagcctgatcaacagagcgagactccgtctcacaaaaaaaaagaaaaagaaaaacgttgtgaccacggtgtaactaccacaactaaaatactgattggtaatggccctatcatctataaggacttttagtactcctgccattttccatttaaaataccatttccatttggtggacaggtgaagaaaaaccagtacagtgatcgaccaag

SEQ ID NO: 650391 - DNA, 442 bp, Homo sapiens
  misc_feature (394)..(394): n is a, c, g, or t
cgcgtcgactctcttttggaagtggctgttttgtttaaagggcctgtggatttgtccagcgggcagtgggaagcatagctctaaagagtggcattgagcttaaggccagggatacagatttcacagtaacaagcagagaatagatggactgggagcagatgagaccacagtggaatggccactctctgggactggatgaggactgtactgagttgaagagtcccctcccttcaccgccccgggatttcatgtctacccagaacctaagattcttaccttatttgggattgtttggaggttctagcaggggagtgcagctacttgtatatccttgaccaaagactggtcctcctctatccagatggtcaccttcttcccccgagtgcgcagcttntggagggatgcacatggagcagtgaggtcgacgcggccgcgaatttag

SEQ ID NO: 650392 - DNA, 540 bp, Homo sapiens
  misc_feature (229)..(229): n is a, c, g, or t
  misc_feature (395)..(395): n is a, c, g, or t
  misc_feature (397)..(397): n is a, c, g, or t
  misc_feature (408)..(408): n is a, c, g, or t
  misc_feature (440)..(440): n is a, c, g, or t
  misc_feature (536)..(536): n is a, c, g, or t
gagctcggtacccattctacgctgcacctgtctgtgggtcatctattaaagtattttgaacccagtcaagatttacttcctcctggagattctgcttctgtgggtctggagtgaggctgtctggttttgcacctactggttaaatgacctcctccagttctcacagtctgtctcaggagtaggtggggttttgataatgttcatgtctgaagcatagagaactgtattncctggtagaaaggaaacaggaaagaagggctttaaagcctttgcaggaatgatgggctgggttatttttgtcaccaattcccaccccaccttcctcagtcaagggacaaagcactttttcgtgctttgtttttaccagcctcaggttagaggataagctagaatcntngtcacctattntcagtccaggcaggaggtgccagcagttcagnggttcctgtctcaaaattgggagggaaacgaggcacccaacttcagtcatccccctttccagtatggagtggaaaagtgcacgggacttgtggctnaaga

SEQ ID NO: 650393 - DNA, 980 bp, Homo sapiens
  misc_feature (26)..(26): n is a, c, g, or t
  misc_feature (67)..(67): n is a, c, g, or t
  misc_feature (104)..(104): n is a, c, g, or t
  misc_feature (130)..(130): n is a, c, g, or t
  misc_feature (151)..(151): n is a, c, g, or t
  misc_feature (163)..(163): n is a, c, g, or t
  misc_feature (175)..(175): n is a, c, g, or t
  misc_feature (899)..(899): n is a, c, g, or t
  misc_feature (918)..(918): n is a, c, g, or t
  misc_feature (939)..(939): n is a, c, g, or t
ggctgctatccccacccgggctccgngctgcccccgcaggcgctgttcatgggcgagggaacttgtnagaagcgccgggacgccgagtatggcgccagcccggngcaggtcgcagacaatggcgatgacnactcagaaggaggcctggtgnaaaaccacgtgnacagcaccatgnacatgttgggcgggggaggcagagctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggggctggggnacaggtttggggagggggnagagaaatttttatttttgancccctgttcccttttgcctaagattaaaggaaggaaaagta

SEQ ID NO: 650394 - DNA, 225 bp, Homo sapiens
  misc_feature (171)..(171): n is a, c, g, or t
ggggctgaggatcctagacagcggacccaattctaagtcgcacccacgagttcccagcagatctgggccctgacaacagaatcagcaccaagaggacttaagtctggaacctgctcaggcatcgatccggcaagtgtgtgcatcaaccttcgctagatccaaatgccaatnaaagaagagaaagccagggattaaacacgggggggggtccggctgtctagaggc

SEQ ID NO: 650395 - DNA, 145 bp, Homo sapiens
agacatgggaccattagcctcacatggatctaggactagcgaataggaaccaccacaaggaggaggtggtggtgcaacctcagtggctgtcaccatagctctccaccacagataccgctgctgatgccgaagctcgacctgagtt

SEQ ID NO: 650396 - DNA, 234 bp, Homo sapiens
gctgcgctatttgctggtgccagtggtgtcggcgtggcttatgtgcctgggtggaggaagcagctactcctatagcagtggtctatggcgttggatggtggcttcagtaccagcagtggcaggagccattgaggggtggcctcagctctattggaggcggcagtaccaccatcaagtacacaaccacctcctcctccagcaggaagagctataagcactaaagtgcgtctgcta

SEQ ID NO: 650397 - DNA, 987 bp, Homo sapiens
  misc_feature (383)..(383): n is a, c, g, or t
ggctgaaggctggtttgcgtcgacaggtggcggttaccctgagtctcttgtctggtgacgggcgtcgattatgcagtccgggctggtcactcagctgtagggttcagcgaccgcgggggggtggcgtggttccaaggccgctattatgggcgcgggagtccggagcgctcgcatttccggactggatgagccgtgagcgaagcggtgagtctgtcacggagggtgtgaggaggtagccggcattctcccctggcgccctctacgcttgaatgcagggctctcgggtgccccgggcgctccaagtgcgcgccgcacgccgcgtatggagacgccggtggtagtctctggccgtgctgcgtatgcggccagttgtgcgccattgntgtgtacgtattctttaacacccgttgcgttcagcggtgcgccacgcgtcagacgtgtggtatcagcgtccccttgggaagccagcgtgggtccccgttcagtataggtgagcggtaattatacaatgcattgagctgttagcagacgtttcgcgcagttgcttacaggacacgctttacttgatatcttagcgactgttaggctattgctggggtgctacggggaagccaaggcatcctacagggcccggcacaacacattggaaccccgagtgtaggcacgcgatgtcgatgtaccatttgggacgacactgagggggctggggggtcgacttccatgtggaagctattgtaagggcgcctgaaggggcctttctttcaaaaaaccgaattccaatttccttggacgttattcccagccgtcaatttgggcacttcacttggcccgagatttgaggtatcgtccgttacacatgcacaagcaaagcccctttgaacataccagaacaagaaaaaccaaaggcaaaactccccgaagttccccaggacccgactttctgggaaagggcaaaaacttgggaggggcagcccttgggtggccccc

SEQ ID NO: 650398 - DNA, 589 bp, Homo sapiens
tgaacgcacacctattaaatagggaatcctttccccattgcttgtttttctcaggtttgtcgaagatcagatagttgtagatatgcggcattatttctgagggctctgttctgttccattgatcaatatctctgttttggtaccagtaccatgctgttttggttactgtagccttgtagtatagtttgaagtcaggtagcgtgatgcctccagctttgttcttttggcttaggattgacttggcgacagtcattcatttgataaatgtttgttgcatgtgtattccttcagtaggcagtgaggataccataatgctgtgtattatgtactatggctttttttttttggagttatgaaatatccctgtgaggccttttacaactatttcttgatggtgattctgcatctcaattcgtaccttttcagactttggtttatctagcaaatatgggttctgatcagaaccagtccttattgaatgcttggtgccaggtactgtagtaagcgctttgcatggattcttttcatcccaactaacaaccttatgacgtaagtactcttattcttctcattttatggatgtagcagt

SEQ ID NO: 650399 - DNA, 273 bp, Homo sapiens
tccgttacacctaaggattcctacatgcagagcggaaaccaaaagcaagaagtaatagctgtcttacatcagataaaacagactttaaagaaacaacagtttaagaaagacaagagtcattatacaatgataaaaggatcaatttaacaagattagacaatcttaaacatatatgtacctaattctggagcatctagattcatagaacaattactactagacctaagaaaagacagagacagcaacacaataataatgggggacttcaacact

SEQ ID NO: 650400 - DNA, 387 bp, Homo sapiens
aacactacattgaggaaaaatctaggacattaactacttacaatgactgaagtggacagactaggaataggcaaggatgatggaagaaacactcagctatctactaggaagaaagcaaaggccaattcatctaaattaagatgtacaaagacaggagccatctttcacaccagatactggcacaccagtcgtacgaggtctgacatacagagaaggtctctacatcacaagaagaacatctaccagacacgaggctactctcaggattagatatcatggaagtgtagaggattacagattataacagatattgcgatatttgcacatacataataagatatcttgggaccgatgcggtggtttatgcctgtaatcccagcactttgg

SEQ ID NO: 650401 - DNA, 1429 bp, Homo sapiens
  misc_feature (439)..(439): n is a, c, g, or t
  misc_feature (799)..(799): n is a, c, g, or t
ggtttgtggtacatcaacgtgagccagtgtggctcgctggtgtaacatcgaggccacaggaatctgaatcggtactggttagagacggaaaccatacgccatagatgatgccattcaggtagctcaatagggccgctgtaattaccgtagttctcgagggtgggtccaccgcgcttggattcactttcatacttggcagttgattgtagacaatgggatattaggtcctgaccaaataggacctcgctcataggtctgtggttgaagtgcaacgcatgaggttcagaatcgatttctttagcatgtcctagtcagtctgtcacatggtacgtgacagacagagtcggatggcttaggcgaacgcgtgaggtgtctggtattccacgtagacttgatggacgtgtgaatagtggagacagcctcctgaggtacgcggtantgccgccgagcgcgtcaacgaaacttgataggaaagtagtgcacagaaatttggcatttggacgttgccacttggaacagctcgtaggggtaccagcaaatgtgggggacacaacttgtttagttccaaaggaccactccctttgccagcgtgggtgccttgcccaagaagcgaataacacattagtctacgaggattagctcgcgtagccaaagggcaattcggggcaacttaggacgaaagggagggggtactccagtccttgaggaaaaagaggtcaccagatggtatcaacccctcactttagggttccgacttaggggcgagagaagcggttggcgcgaaccagagcccctgcgntagagtgcccacacttcaatagcgatcacatttgggagtcgatgcaagacgaatcgagcttgtttcgcaccagtgagggaagctaagcttggcttgaacgaatttttcgagagaggctccattggccgatgggagcgggcgtatcgcaatgctattggtccattttagcttctcacacgcgctagggtttaggaggcggcgatagggggaacggggggtgacccgcctcaaagttgggtaaacagtctcacaggttgagcgaaaaggcctaactcagaatggagggacagtgcggtcggaatggcaaggaaggtagttgccacccaacaatccgcatgaaatcaccagggtccgtataagaaagtgtggagcgtgtaaaggggacaagacgggtatcattacatgaaatgccgcccagtggttatcggcaagttgtacgacggcacaatcgcgccctattggaggcgtgtgcaatcacaacaaacgcccagatgttagcgtctcacccagggacgaacagtttaaccgcgacattaatacgaggccatgagagagtgcgaaatagcggacaagcccactcgcttaggacgaatttccctgtgtgcgtccaacactgacacggtatcgtac

SEQ ID NO: 650402 - DNA, 240 bp, Homo sapiens
tatttcagtaaatcagaaaagttctatagagaaataaggagagtaagggccatagagtgcaagaaaaagggctacgtaagggtcttgttaggcactgaatgcaatttaatagggcatccaaatcataatgaatagtagataaacgggatattatacaacatgtaaaaataagcatatataattaatcaggagacgggatctacactggacactccaggtctaggagagcaagggcgcgat

SEQ ID NO: 650403 - DNA, 157 bp, Homo sapiens
ggtcgacggagtcagatggaggggaatgcagtggaatggaatgaaacggagtgggttggaatggagtccagtgaaatggaatggagtagaatggaatggaaaggaatggaacggaatgaaacggatggaacggagtggagtggtgtggaggtcgacg

SEQ ID NO: 650404 - DNA, 516 bp, Homo sapiens
tgccccactgtggagtgctgtttatttctattccgttgcattaccttcactttgccttgtgccatggtttgtatgcatgtcccctctcaccaactgaaatccacaagattcaattttcctggaggacatgttcattagagcatcccccatgggggcacgtacacagtagtcactggataagtatcactgtttaaaaacctgtaccaggtcgaagttcaccagggaggcttcaactttccatctttctcccttgagtatttaaactcagctaagttcctcaaatatttttgagcaagtctggagatgagtatcatgagatgggtttgggttgggatcaaggttgtctccatgtggaaattttggctaaacccttcttcctgctgtgaaatgcaagcttcctcatgagctgccaactcaggcaaacatctttgattgtggggaagtgggcatttgaggtttgtaataatttggatatggctggggggatgttagcctttgttgaaccaaccctttctt

SEQ ID NO: 650405 - DNA, 897 bp, Homo sapiens
  misc_feature (115)..(115): n is a, c, g, or t
agcggagtgagccgagatcgcgccactacactccagactgggcgacagagccagactccgtctcaaaaaaaaaaaaaaaaaaaaaaaaaagcacctttaggaattcattcgtgcnctcacacggaattatttctcagggccaagggcttggtgacgagcctttcattattattttaaaggagggacaaagagccccttcagacctcatgtggacgctgaacgggagtccacacagggcagactttgacctttgaccagaatagtctctcaagatgccaaactggggcggaggcgcaaatttgttggagccttgttgaaaagaccgttctaccagtgcaggaaaaaattccaggtgcaatgtggacatggattttcccacaagacgttgtttcccacgtgctattggccttgcaggaaggctcttgacagcacgacagtcgcggcctcatgagtcggaggatctactgcaaggtgttgctattgggcgcaaaattttggccccaaggggatcgggttattggacaaggcgctggcttgtctcagcacagacacgggcgagcattctcggcctgcagttcccaacagtccccaaagccggcacgctcagtatacccaccagacaaccctttccaaatttcactgcaacatttgggagagttccgaaaagtgccctcgattgtggcaagtcagtcctatgctgctgacacggtcactggcaagttggcaagcccttgggaacaagacctgttccgttgtgccatcttgtgggaagagtcggagtccacaaatgtctgtgacaaagatggggcacctttctggcaacggttgttatgccaacaatttgggccccacggatatgggtttgggagggccttacccacacagtgtaaacgacga

SEQ ID NO: 650406 - DNA, 312 bp, Homo sapiens
tgagtactctagagatccggctgactacggggaaggggcggtcaggttcgttctccaggaagcgtagtgtggactcatagccgtgcgctgcagttcgcggagctgctgctctccaggtcagcatggggtcacctccaccacgccatggctgatagccccgtagggcttcttcctgcgcaggagcaagatggagaggacgatgagggagcctccgccccggtccatgatcagcagacccgacacaggctcacggggaacacccctgtcccagctgatgccagctcatccctctgaatctccgatgagtgggaa

SEQ ID NO: 650407 - DNA, 376 bp, Homo sapiens
  misc_feature (373)..(373): n is a, c, g, or t
cggcacgaggaaagaataaaatgctgccaggcacagtggctcatccttaaatccccagctcacagctcaaggtctgggacacagttgatgcccaataaatgtttgctgcctacctacagctgcctgaggctgaacgttatgacccttccagaagcacagtgggtctctctcttgtccaggtgctggtgagaaagtcaagtacagtacctatcatggaaaaaccctatgtctgggggaatgggtgtgagaagggggtgggcttccccaggaggagaaaaggcagatgctccctactcccttgagcctatcgggagcttctaagaagttggttaacctcgaccaataaactaaatctattacaagagactcaaancca

SEQ ID NO: 650408 - DNA, 437 bp, Homo sapiens
  misc_feature (9)..(9): n is a, c, g, or t
  misc_feature (39)..(39): n is a, c, g, or t
  misc_feature (64)..(64): n is a, c, g, or t
  misc_feature (157)..(157): n is a, c, g, or t
  misc_feature (433)..(433): n is a, c, g, or t
atgaaaccnatagggtggttaaaagtaccttgctgggtnaacttgataattcctggagggtcangggaagcgctatgtgaatccccacttctgatatttgtaaagattctctcccagggcctgaaagcttaaggggttgagcaactcctcccttctnaggcccaagcccccaggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcactttggggacgccgttttagcctcagcccgccagcacccaggctctcattaaaacagcatgtaccnccaa

SEQ ID NO: 650409 - DNA, 277 bp, Homo sapiens
gaggccgatcgtgtggatgcccattgtgacctgagataggcattctctagtggcatatcggcaatgcttctgctggtcatagtgcgaaagcgtgagtttgagatcggtgaactgcgtgccgcttaataggcttggcgtgtatcgtcgcttaatggacatattgtagcgattagtggtgctgttcaagtctgttatctggtactttcgcagtgttgtatacggcgttagttacatcgcctacataggtccatcggcagagcaccgcgttgcgtttgac

SEQ ID NO: 650410 - DNA, 796 bp, Homo sapiens
  misc_feature (238)..(238): n is a, c, g, or t
atcgtctctcagacaccaagctggagatccaggcttatctgggaaagtgaggccaccatggtctgctggagaagtctcttgtccggcatccttgctgcttgttcttgatactgcgtgggtgcgtgcggcatgggtccaggctcttctcgcttggaaactagagggaatcccggaggcaagaaaattcacaagcggcgagacaatatggactcagactagtgcccccccgagcagcagngtccaccttactgtaaatcaatatgatgatggcgcaggaatattgacgacagggggcggtgtcaccatcgcaggtgatacatcttatgtgcacggagtcccttatggttaggatgttcagaaatgtcttgttgccacggaaaaggtcagcctgcaagaacgggcagggtcaactgataactaatgagcagattccagcatgcgacatcacagagtgcgtctgacaaagggtccggtaccccaactgtgcataccggaccagccgaggagagaccgtcattgtggcctgtgaagggagcccagaattgttggcaagtacagtttggatggctgcttgtgggaggaatctatctaaggtcaaaaggagtgaggataaacctaactcccttaatgtatctcttcaaagttgcttttcgttgttccttcatgttgtgaaagaagtaatggaaggtagggtctatgacagaagaatgtacctttggtgaacaatctggtgatgggggtgagaggaatgaaggtggccgagaacctgaattgttaaaaaggtgaataaaagaag

SEQ ID NO: 650411 - DNA, 359 bp, Homo sapiens
taacctccttttccttttaaggtactgggcccatgtgttgcttgactactgggaatgacaagtcatactttatgaacagggattaagctatattaaatcacaggtaatagggtggaggggcagagtatgttacttcaaagtctgtgtaacttgaattaaaactctggatattttcagatgtagccagcaattgtcttctttcttaacatgctaacagtgcattaacttataggcctagaagccagaattcattgctttataactctttattagtcagcaaggtatactcccaacatatgtgcagtacatatcacttagttatttaaaattgagctgacgacacaacagaaagatcctgt

SEQ ID NO: 650412 - DNA, 212 bp, Homo sapiens
aggataccctacgtcgcatatttatagagtatactgtgatgttctgatagacgtatacttgtgtaatgatgaatcaaaataattagcatatcctatctcaaacacttgtcatttctttgtggtgagaacagtcaaaatcctctctaaagtatattttattttaattaattcattttttttttcagagggcgggatggatattcgacagtagt

SEQ ID NO: 650413 - DNA, 775 bp, Homo sapiens
catactgtttaaaaggcataactgaattatatgtgttattctttatatagacacgtattctataggttattctcacccgaagtattcacacaatctctttttaaaataactctcggaaatggcattttgcattgcacacagaggctaggatgagccatatatataagtgaaatgtcactatctctgcaaacaatataaaccgcgattatctgccatcattagtacctctcaacttacttttgtagaggactaacgaaacaatctgtaggattcggtttccatacagggaagttctccgtcctatgcaatgtttctcaattaattctgcttaattctgagccattaatcctgctacactttgtaatgatacagttaattcagactaatctttgggggcttatagggtagttaagttagaactcttcaagggagacatgtatcaacaactattagttgttgttactaaatttataaacatattgattagttacacttgtgtaacgaatataaggtttacgacgctatgagaatttggtgtctatcaccagttagctatttgctgtaatgtcaagaacaatcgttcaccagtatgcaagaatcgtaccttttcttgaatagaaagccaaatgtactttagacatgaatggcaactatataaagaatagacttcatcaatgttattcctacatgtcataagattctacttaaacttgtcttctttcaaatgtttgagaagatgctgacccactgaacagtctactgctgacataaatag

SEQ ID NO: 650414 - DNA, 1327 bp, Homo sapiens
gaccagtctgcgatgtacgctgaccattggccgagtatggagctcttcgaacgccttctctggtgcagtcggacaactcctacactgccatctctcagcatgcgtatcacatcagcttctccactaaatccctgactcaggaactactggtttgtgtgtgcatcgagagtaaggtgcccgagcctcctgtgcagtacgaaacggtctggccagaccaagtgcttagacatgccagtgtccctggatgtgagagtaccaatcgacaatccatccgcaggagggtggtacaatagcgaagctgggtaggactagtgtggagttgaccaggttgctccttccgtgcagacttcctgcgcagtggctatgtggactagtcctgttgcaggaacactgttggaaggaagccaggcggagaggtgtccgcatagttattcaattggagactttaacatcctaaacaagcgcaaagggagcatggttgcacgaaaatggcatcgcacctgggcacatgttgcgcgaacggtagggcatgggcaccgaatggtcaagcccgcaactcttcgcgaatttcagggagggcgacatagacgggatctgcatcgggaccgaaagggcttatccctgtccgtccaatgccagccttcacccaatcgcgagaagttgtcagtctgggcatgaaccatatcccctcatccgcgattacatgccccccggggcggcgacactgccattgattccacacttcacaagtgctggagaacctgtgcaaggtgcttccattgcagaggcttgcacgtaacacctttgcgtgaactttagagcaacgaaagtttaggcgacagcgctccaacgatgggggaacaaccccgcgttagccccttggttggagggccttcaaagaaccgttgaaggggagggcacgttgaatagcattggcgtgggttatctgcacctgctgtgagtcccctgagggtgctaaagagagtccatcccgcgatggagagagagaacttcgtattcgggccccagagggagttgaatccggttgattcccgcaccaaaaaggtgcatatacacaagagagcaggacctggggccccagacatttgcaggtgctgcaccacagggaaacgggacctttgggaggacacccgagccagtatgggctgtaggggaacatgtcattcgggtcttggggaggacccttgacttaacagtgtgaggagctagtgagcttccttcccttgtggcaaaccgttggctctggccgttcggacagatcagggctagggtcatgcacaacacgtttacatggacagaggttaac

SEQ ID NO: 650415 - DNA, 121 bp, Homo sapiens
gcgtgggtccttgcagagggcagggcggtggagagactggtgcgtgggggtcaatgcaccaggactgtggatgtgcgagtggggtgagcgaaggtgcatcgtgcaggagagtgactagagt

SEQ ID NO: 650416 - DNA, 236 bp, Homo sapiens
  misc_feature (6)..(6): n is a, c, g, or t
ttatgntgctacctccacaaacagctgggatgttaggcgtgagccaccgcgcctggcctagtgctcttattttgtcatgttggcttttgttttaatgttgagactttagtctggctttgtacagaggagtcgagttgtggcataaaccagtagacttcttatgttctcaggcataatggtgggtcattccaatgcttctagtaagtacttcgcaaaggagtattgtttgcgctatt

SEQ ID NO: 650417 - DNA, 103 bp, Homo sapiens
atgcctacttgtaatttgataaatccttatgtttgaagagaaacttccggtgtgagatatacaaatatattgaattgtgtcatagtaaacttctgatttgcca

SEQ ID NO: 650418 - DNA, 338 bp, Homo sapiens
  misc_feature (338)..(338): n is a, c, g, or t
cccaggacagtggagtcagcagtaagccctgggacaggtggcaagggtgggtcccttgactttgcacgctcctcaggaacccctttcccgggtgagccctctctgaagagactgtccttgggcctcctctggaagcagcaccccagaggacagggctcctcctgcttgccttaggcttcccttacttgaattgcgttggaccttggggattacttggtagatatattgctcttggctcgcctggtggtagttttccaccatgccagggtttgctccactggggcaaagtggcctcgtggatgaccctgagctttcatccacgtgccttttgattaccn

SEQ ID NO: 650419 - DNA, 492 bp, Homo sapiens
ccagtcgagcaacatggtggaccctctctctacaaaaaattagctagacatggtggcactcacctgtagtcccaggtactcgggaggctgcagtgagccatgattgtgtcattgtactccagcctggaagacagagtgagaccctgtctcaaaaaaaaaaaaaaaaaaggggtgggggggcgtatagaagggtgaatgatggagtcattggagtaggtattaaactcccctttaatgcttttctagcatattgggggtatcacatggttttagaaaggaagcattctgccttaactgtaggtacccagtgctagcaaggggtgtgctgaagtgggtggatgggactgtatcagaaccagggtactttcagctgcagacggaccatacccctgtccacctggggttgctggatagaggtaagagggcggagagctgttcacaggctacacagggtctgtctcaagccgggttacgtgggcattaacattgctc

SEQ ID NO: 650420 - DNA, 950 bp, Homo sapiens
atggcacatgcagcgcaagtaggtctagaagacgctatttcccctatcagtagaagaggcttatcaccctttgtcatgatcacgcccgtcatagtcattgaccttatgtgattcgctagtcctggtatgcccattgtatcctaacacgtcacaagcaagaactaaggtaagtacgtaacatcgtcagtacgctcagggagaataggaaaccggtctgaatctaatccctgcccgcacgaatcagtcctagttcctgcagtcgcgcctcaccatcacctagcgcgatcctttacattataccagatcgtagggtcaaggaatgtcccatcaccttaccagtcaaagtcaattggcacagcgcaatgtgtactgaatcactatcgggagatagcaccgagtctacggccgagtagtaactcttgcaacgtcactacgtacatatccacacattatatcctagaaaccaaggacgatctgtagacatccttgcacaggtggaacaaatacgaggtaggtagttgcccccgagttgtaaggccgcccaatgtcgtaataaataattagcatcaccaaggaacgtcttatgctacatcatgaagcatgtccccgcacaattcagtgcttaataaagctgatgcgattccgcggactgtcgtaaatacagaaacaaattttcgagcgataagacgaacggggggtaatacctacgggtgcaaatgctctgagatcgtgtggaagcaaagaccacgagttgctagtgccacaatcgggtcctaagaaataagatttcccccttaaaaagtcttcgtggacagttaggggccgggaattgtaacccctattcggcagcccacctcgtaacccgctctaagaatgcgcacagaaaatgaatagaaagcgcataaagaaagactcatccgggggaacggtggggacaggaacagggttta

SEQ ID NO: 650421 - DNA, 170 bp, Homo sapiens
gacttagaggatccccccttgcacggtgctgacagagtagagaggcggtctcaaaacacttaaaacatttggattacttagaaagaccactatggggcacgggtagataggatgtgctgtctggaaacaaggccagttaagtgtgtccaccttttgacggaccaatgcga

SEQ ID NO: 650422 - DNA, 247 bp, Homo sapiens
gagagtccacaaatgctatggggtgaatgtcccacccaatactcaatgttgaaagttaattgccatggtaatggcgtgaaaggttgagacccttaaaatggccatgaaggggctggtcgtggtggctcacacctgtaatctcagcactctgggaggccgaggcgggtggatcacctgaggtcacgagttcaataccagcctggccaacatggcaaaaccccggctctactaaaattacaaaaattag

SEQ ID NO: 650423 - DNA, 105 bp, Homo sapiens
agacgattgtggtaattggggaggagttgctgcgagtggtcattgctgggatagatccgtgtcattggttggggtgggtggagagcgggtcgccagactgagtgg

SEQ ID NO: 650424 - DNA, 418 bp, Homo sapiens
ctctgcctcctgggttcaagccgttctcctgcctcagcctcccaagtagctgggactacaggtgcacaccaccatgcccggctaatttttgtatttttaatataggcggtgtttcgccacattggtcaggctggtcttgaactcctgaccttgtgatacgcctgcctcagcctcccaaagtgctgagaatacaggtgtgagccatcacgcccggccgatgcaagcttttatatgttcttgagaaaattattacagggtgttttttctcatattctttaatatttttcagaacaaatgctcatttgctttttatttatttaaatttgagcaccatgcaatttttactaagctgaatagctaggctaactactatgatctttttaattaaagaaaagaaaaacagggtcacaggttatgc

SEQ ID NO: 650425 - DNA, 244 bp, Homo sapiens
tagcatgacccagtgtggcatacagcaaatggggtttaattgagaggaagaaaacctataaaggattaagggccaggcacggtggctctcgcctggaatcacaccactttgggaggccaaggtaggtgaatcatctgaggtcaagaattcgagaccagcctggacaacatggcgaaactgcatctctactataaatacaaaaaaattagccgggcattgcgaatcatgcccagctacttgaaag

SEQ ID NO: 650426 - DNA, 129 bp, Homo sapiens
  misc_feature (129)..(129): n is a, c, g, or t
tcttaccattgttctatatgtgccattttaggttatatgtgtattaaggataaggcttaaatctcaaagggatgtgttaaaaatagggagttgggaaatccggccctttgtgtgaagtgccctttgggn

SEQ ID NO: 650427 - DNA, 545 bp, Homo sapiens
  misc_feature (161)..(161): n is a, c, g, or t
  misc_feature (274)..(274): n is a, c, g, or t
  misc_feature (294)..(294): n is a, c, g, or t
  misc_feature (350)..(350): n is a, c, g, or t
  misc_feature (370)..(370): n is a, c, g, or t
  misc_feature (433)..(433): n is a, c, g, or t
  misc_feature (443)..(443): n is a, c, g, or t
  misc_feature (495)..(495): n is a, c, g, or t
aggtactttgtaacccccttcgaaattcttttatctttttatcctttttctgatttattgggctaagacttccatcactattctcaagtggtaaaagcatgcaccctgtcttctttccattttcacaggttaagttttcaatatatattatcatttagttnatggttgctaaaaaaattgttgcagcttttccttacaagaataaaggaaggtccactactttctcttcactaatttggaaattgtacagtttctattccttttttttcttttnttttttttttgagacggagntcgcttctgtcacccgggctggagtgcagtggtgtgatctcagcacactgccaagntccgcctcccgggttcacgncattctcctgtctcagcctcctgagtagctgggactacgggagcccgccaccgtgcccggctnaattttttcntatttttagtagagacggggtttcaccgtggtttgcaatctcctgatctcgngatctgcccgccctcggcctcccaaagtgttcgcagtcacaggcaagagc

SEQ ID NO: 650428 - DNA, 981 bp, Homo sapiens
cccaccgagggtttcccaatggaacagcttgtgcgtgtgccagggcccccgaagttttgctgggtggcagagtgtccgggggagagaggacccgatttcgttctcccttttgaccgagggcccctttgggcaaagggagccttttgacctatggtcccacgagacgtttgtgatgtcccacaccttcaggatgtgagacccacgaggggccaaggggttctatccccagaaatttctacttgggtctcttcatagcccttctccacactgtgaacgcccacctgtttggagattgtggacactttcttcgggccactgatttatcgcattggagggcccaaccgcaaggaggatttcttgggacagacagatgtttaagtgtaaaatattattttcacactggcgctttggatataaaagaataccagatgcttgccgcagaaagagggaagcaaattttgtcgaccatccccacccgcagaagtaggctgaggagagacaagattgttgcaaccccccctatcacttcgatccgcagagctgttaacaccgacagtgccaccgacagccataccccagctaggggaattcctggggggtttcctggtggtggggtgctctctcccctctgtgtgtgtgtgttctctcatgggcgcccccccattgtgagaaggtttgagtttagccgccccgccagtgtaggatgatagcgaaggtgttccccacacaccgtgtctagagacaccatcttgtcgaggacaccttaacttcgttgagcggaatttcttgtgcgccgacgttttttataaaatggttataggactgcttttctatgaaggtttctgggccttttccaaaactggaatatgggacaaaatcccacacgggaaggaaataaaccctctccccttttttccaccctgttttttaagtgggaaaatccatttttttaattaaaatattttaaattggcccccacta

SEQ ID NO: 650429 - DNA, 100 bp, Homo sapiens
gcgtacgcagagaggggccctcgtccctctatcacggctcactggcaaggcattaacgcggcgcccgcccagcctagacacggtcaattttgctaagcat

SEQ ID NO: 650430 - DNA, 85 bp, Homo sapiens
gatatcgtaccggttgacgtggctacagtgagcatgattgcgcctctgcgctccaacccaggtgacagagcaagactctatctac

SEQ ID NO: 650431 - DNA, 443 bp, Homo sapiens
  misc_feature (4)..(4): n is a, c, g, or t
acgnacacccgctcctacacgccacatcgatgaccttcagtcctttatgttcgtctaccagcatcggaatggcctcgtccggggctgttccatggcccagccggccgacgctcccgcggccccaggtgtacagctccccctcggcagtgatggccgcactgtaagtgctcccgcaagcgatgtgcaccacgtgcttcccggcctgctttccagagaaggcggagatcaccttaggctcctccaaaggcacagagtccccatggcccagccgtccgccgtccccacagccccaggagtacacctctccagtagcagccaaggctaggtagtgctgaccatcagaatgggcagcaatttttacaatgtttctggaggcaaggccttggaccagctgtggggccagcgtgtcactattataggcctgtgtggacacgcggccattg

SEQ ID NO: 650432 - DNA, 157 bp, Homo sapiens
  misc_feature (65)..(65): n is a, c, g, or t
  misc_feature (108)..(108): n is a, c, g, or t
  misc_feature (111)..(111): n is a, c, g, or t
atccgccaccatgcccagctaatttttgtatttttagtagagacggggttttcaccatattgggncaggctgggctcaactcctgacctcaggtgatctacccacctnagnatcccgtgctgggattacgggtgagccacttgtgcctggtcttttt

SEQ ID NO: 650433 - DNA, 318 bp, Homo sapiens
tttctttgagatggaatcttgctgtgatgcccaggctagagtgcaatggcatgagctcagctcactgaaacctctgctttgttcccccggttcaagagatttttctgcctcagcctctcaagtagctgggactacaggtatgcaccgccatgcccagttaatctttgtatttcgtgtgtgtgtgtgttttggaatcattgttttagaaaaacagattaaatattagattaaaaaataggttaaaacccccaaaacttaaatctaatcttagtgatgtttacatttatggccatctgcctcagtttcatgacgtcgacg

SEQ ID NO: 650434 - DNA, 132 bp, Homo sapiens
ccgcggctaattcatggacaggaactaccccagcgccggcttcgggcacccgctcggcgccggggctcggatggagttaccagaggtcagcgaaagctagcttggtttattgcagctcctggatcctcgcac

SEQ ID NO: 650435 - DNA, 247 bp, Homo sapiens
acacggattaacacttacactacctttatcctcctaacgtatttcgtaaccacactctcaacattacaataagttttagaacttggaggcacttaagaacataattacatttactaatatattagttatcaagttatgatatagtgtccacttacctatcctattatattatggataagagaacagtagtctacactaatagtatagacccagagacctggtactatagaaacacaaccaaggacct

SEQ ID NO: 650436 - DNA, 1651 bp, Homo sapiens
  misc_feature (510)..(510): n is a, c, g, or t
taacctttttatccacctttttttttccgctttaagtggggcccccaaaaaattaaaacacttataagccgaggagttttaaatagcaattttgtgtggtaagcaaagtttacttctccatctctctcttaagtctcaaatgtgtggtctcaaagcttctctctccagttattttcacaaaacatggatatatagaacaaaagtgcttaccacaaaaccgtgtgtgcctctctgtgaaagatatttttttctctctttatttctctctcaagagacaccacacgtggaacaaaaaacacctatttatctgtgcgtgtgtactctccaaaacacatctcacccacagagttcattatacacgagaatacacccttatctctccacttgtgtctctaacagcgtgtgtcgggtgtgcgagtctctatacacacagtgtgtgtgtgtgttctatacaaagagagttctacacacagagagtgagagcgtgcgcagtgttatctacacacaaanagagtggcgcgacacgggtgtgggaacacagtgtgtgcgcaacaccctttacatgtgtgtgcgcttctctgtggagatattctctagagacatctgtgtgtgtgtgtttattatactccaccacacgattatgttctctccacgagtgtatataaaaaacaccaccccgctgcgcgcgggtgtacactctcccactatatattatcaccccctctttatatattataagaggcgggcgtcatatataacccccgacgccacatatatacaccaatatagaagccgcgctatatatttccacccctgtgtgggtaggctctccactacttatatatctccaccggtgagcaggggggggtacacaggcgcttaaacccatgtggaagaatatacgagcgtggaaaacaggttccccctaagtgggggtttacaacatgttggaacctccccataaaagcacctcatctgacccccgggtctctttattacttcctcctaaacaaactctccggggggaacaacgaggcgagggacttcacccaccttaatagtaaccaccctcattcaccccttctatttaaaacctcccagacaaaacgtcggggcgcggtgggtttggtggaaaaaacacgcgttggcgtccctccaccaaaaatcaacaccttgctggtgtgcccatcaaccacctcattctcttttttctaacaacaaacagcacaacaaacacagaggaggggggggggggcggctcctctaatagaaatatatcacccccccaaggagggggggccacacaactttacatcgcctacaccccactttttctttttgtccgacacaaagggggccccccaaacaagaagggacgccgcatataataaaagcgacgacacgcgccggccgcgctgttaaaacaagcgcgtgggcggcgggagaaacaactagcctctcggagaccctcccatggcgagagcagacaccaaccaccactctgcggggggtgacgaacatgccgcggccaaccaccacaagataaaaaacacgccgcggcagtagaaacacaccagccgcacgtgtcgacagccctatctcgtgcgggagagttagttataacccacagacgatactaccagacaagcaa

SEQ ID NO: 650437 - DNA, 404 bp, Homo sapiens
tatgtatacacctgaagccccagtgggcgtgtgttccaggtgctcttttagtttgccgtctataggcagcttgtgctacacagctcaattagaccctctacttgtcgcaaggacagagggctattttgtatcccgggttcttgcactttggtgtaccggcagagtcggatcacacctgggcttggagaatgagtgtaaagttctattgagtggaagcagctctcagccaatgggggagccagaaaggagatggtcttcctctggagttgggctgcttggtggccccagctctcctccgactgccctggccaaactccaccttgtccagccagtcgatggcctgccagagtgctggcatctgttggtgtgttcttccactggcgtgttcccctcgagagggtacc

SEQ ID NO: 650438 - DNA, 314 bp, Homo sapiens
tttgattctaaaacatctcttataccataccttctgtataaagtcagaaagtcatcttcaggggccccaaatggaaatactaattattgggaattggttaaatacattaagtgcattaatacaataaaatacaataagccattatataagcactctcctccagggtcacttgtcacatgtcatgttgtaggttaatatctgatgatgtagtatatagtaaaaaaaaaaggttgattatacatgtaacttagtgtgtgacatgtagatacatttactggttagagtgggtagataaataaatatgaaaacatgaa

SEQ ID NO: 650439 - DNA, 211 bp, Homo sapiens
cgtgtgcagtgtgtagacgagagaaacgcagattcaactgaataaatgaagtgaggtcaaaacaagagaggcactcaaaaacaccaggaacctatcttctttttttttattataatggttctttttttcttttttttatttttttttttctttctcatggcaaccgggggacccctctaaagcccccctgaagtcttgcaagctttggaaa

SEQ ID NO: 650440 - DNA, 667 bp, Homo sapiens
  misc_feature (607)..(607): n is a, c, g, or t
  misc_feature (647)..(647): n is a, c, g, or t
  misc_feature (660)..(660): n is a, c, g, or t
gttttttgttttttgattttacatttagtctatcatctatttaagtttttgtttatggttttaggtatgaattgaggtttttgctgtatatgaatattaaattattcaagcatcgtttattgaagaacctgtcctttttccattgaattgcctttgcacttttgtcaaaaatcaatagaccatgaatgtatgagtctacttctgtgctctgcattctgctttattgatctattttctaaatttatgtcaataacacactgtgtgtagtatgccttaagatcacatagtgcaacctctccaactttgatctctctccttttctttttggctaatctaggtactttgaatttgtatatgaatattagaatcagattgtcaattcctattaaaaatcctgctagaattttgtttgatatagaattgaatctcagataaatctgagtaatactgataacatattagttttctaatacatgaaaaaggcctatcattccatttatttatgtcttgcttggttactttcagcaatgttttgatttttcaatgtatagttcttgcatatctattaacaaatgtacccttatgaacttcatatattgatgctatngtaaaggctatttttttaaactccttgttcattatcagtntagatttactttnggtattt

SEQ ID NO: 650441 - DNA, 93 bp, Homo sapiens
actgaagacagtgccacttactactgtgcctttaaagttttggcatataaagtcctacatttggggtggcggtggtgcattgataaactcact

SEQ ID NO: 650442 - DNA, 155 bp, Homo sapiens
  misc_feature (3)..(3): n is a, c, g, or t
  misc_feature (18)..(18): n is a, c, g, or t
  misc_feature (65)..(65): n is a, c, g, or t
  misc_feature (142)..(142): n is a, c, g, or t
ggntacttggcgcgatgnacctccggttctgtggtgatctggactgtcccgactgagccactggnagaaatcagcacgctggccaagatgtcctctgtgcaagttacgactgctctgcaccaggctactaaaggtgctgctnggacaggggattg

SEQ ID NO: 650443 - DNA, 421 bp, Homo sapiens
  misc_feature (2)..(2): n is a, c, g, or t
  misc_feature (257)..(257): n is a, c, g, or t
  misc_feature (271)..(271): n is a, c, g, or t
anttgcaccctttaaccaaaggagccatttcccgtttttgttaccaaaccgttccaaagaaagctcttttacatactgatggcctacattaatgaacatggtaaaataaaatttaaagagattaggtgtctggttaaattatctgtctcaatttgagttattaaatttcgaaaaggatgatatagacgttgagtggttcaacaaccaattagagaatatttctttggagggtgaaaggaaaagacagagggttggtnaaaaattactggtnaaacaacagaagaaattaattggaagtataaaaccatggttgatggagcaattacaggaaaaattatcgcctgatttaccagatgaagaaattccaactttagagttacctaaggacttagacatgaaagatcatttagaatttttaaaa

SEQ ID NO: 650444 - DNA, 189 bp, Homo sapiens
  misc_feature (135)..(135): n is a, c, g, or t
agcttagagcggaacgggttccacgtgcggtactcctgcttcacgccgccctcggtcaccgtgacgcgcctctcgccgtacacagactggcccggcaccatgttagcgtgaccagcgcgtcctccgccccgcgtnagatgaagaggccctcgtgccggtgcgctccaccgacaccaccatggccccttc

SEQ ID NO: 650445 - DNA, 169 bp, Homo sapiens
cctgaaatcaaggatagtagtgaacactatatacactgtttgttatgcatccttccatatctacgataaagtttaattcataaactaggcacaggaagagattaataacagctaataataaaatagaacagtcgtaacaatatactgtaataaaagtcatgtgaaagtg

SEQ ID NO: 650446 - DNA, 360 bp, Homo sapiens
  misc_feature (354)..(354): n is a, c, g, or t
acaggtccagcgacactccataaatgtgtagatacccatggccatcttagacaagccagctcccatagttctagcctttcagggccttgagcttggccaacaccccttccgctgtctgctcacccatcaactgctcacgcaccttgcccttgtcgtcgatgatgaaggtcaccggcaaggcctcactgcgcggaatctcgaagatcccgtccgggttctgggccagtaccgtgaacttgatccccagcttgtcgctggcggccttcagttcctcaccctgcacattgtcgaagttgacgccgaacaccccgacattctggcctttcaactgttctgccagggcattgagctcgntgattt

SEQ ID NO: 650447 - DNA, 315 bp, Homo sapiens
gcgaggggggagagcaggtgttcatcattcagtatgatgatcttcgaattcattcagagaggtattttccagtggtggggtgatggggataggcgtggtggaatcaacactgtcagattgctcatgtgcgatgtccgagacagctaatggtgcggatgcttgtatccttgtcagatgcacggagactatgatggtgcatttttctttaattacttcgaaaattttttaagtgttacgttcacatgcctttatttaaatcaggaaaatccttgtggcttctgtggcagtgtgtgagtttgagctcaagccatgcca

SEQ ID NO: 650448 - DNA, 121 bp, Homo sapiens
gggtgactaaccttagtctgtcgcctgtggcatccatgggcgtgatttctaacctaccatgtttacatggtcctgcagaccccgcgtaacaccatcacgctcctaccaagccatagaaata

SEQ ID NO: 650449 - DNA, 347 bp, Homo sapiens
gttccgcctgttacctttgccggtctcggacccgcatgccagtgctctggcgctgctcaggtgccgggctggtctggggcgggcatgcaccgcccgtctcagggcgccgcttcttggctctgctgctgttgctgctgtcgctgtcattggcagctctgaacagcccctgggcaggtgccctgtgggatacgatctcggaccccgcctcagcggactgaggggtgctgagcggtcattggtgctggtgggacgaagcttgacacgtggcacacggatttgtgcccctcggaaagagctcctgtaggagggtactgctctgaggacctcagttcctcatccttgggacg

SEQ ID NO: 650450 - DNA, 175 bp, Homo sapiens
caacaccaacttcatcggtggcgaaatcgaagccgatgacgttcagatcaagggcggccaactgaacctgtcgaaccttcacaccgacctgaccggcaacctgagcatcgcctccggagcagctctgcaggtccgcctgagcgacagcaccaacgtgaacactccggtggtcggc

SEQ ID NO: 650451 - DNA, 229 bp, Homo sapiens
cggtcattttctacatatctaagttgcacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggc

SEQ ID NO: 650452 - DNA, 1052 bp, Homo sapiens
caacttgcgggaatttcgcaggttggtgtcactgtaggtgttgactggggatttctagttgtgggggggtttaacgcgcagagacttgtgggagtgccggatcatggtccgtccctccacccgtccacctccaggtctacgggaagctgatgacccttgggtaagagggactagtgtggtcctaggagaagaacaggggagacctgtggctagtttataaacataatcatcctctgtctatctaaggactgctttccggaccccctagcctcctcccgaaccccggctcagatcttaccagataggtttggagagataatctgtcttgctcactctcttgtctgatgggcaatacaatcgacactgcactctgcaatgcactgttggagagggggtgaactatgggcaaacaccatggggggaaacttgtccaatatccggaagtcgcctgaccggagcgcagcagctcactgtgtgtcaaggtctcctgggcagctgggatcaggcaccaggaatcgcgcgtctgacctaagccgccaaaggtaccgcatgaacagccatcccaggctaaagtgtagtcagtgtggcacgtggaaacacctagttaccaagaagacgcacagagatgtgaagcacatcgtcagtgagctaggggaaagtgtaagcagacaatgggtagggtgtccaggtgatgtgggcatacttgattcgcgttccctttgctggagggcttaccaaatcagtcaagcgaaccgcccctgcgaatacgtggagtactacatatacggaattactcaacatgggttcagcccaaactcggggtaaagcaaacagcgatggtagccaggatgcgacttggcgaggacttggtcacaacgcagttcggatttggcaatacctatgggataacaattattcgtccatacgtgataggtccatagagacatgtacattggttctgggaccctgggattgtagatggatacacccattccaggaactgtctgaaactcgtgtagagaaaaagggagaggacaccctcgataccccag

SEQ ID NO: 650453 - DNA, 103 bp, Homo sapiens
  misc_feature (59)..(59): n is a, c, g, or t
tctagccgaccggcgtgtcagtgtctgctgtctatgacaatgagacacccgagcgcagnctcacacaagctgtctgttctcagtgggcagagtgttcttacat

SEQ ID NO: 650454 - DNA, 235 bp, Homo sapiens
ggatccctcgttatcatcggcacccagctaccctctcttgatggagacttgagaggagcagatgtttagctcgaagggcccgcatgtttctctcccggggccacggagtcgacttgaccttcacgtgaacctcttctatgccaacaagtctctggcacctgcaccgttgactctgaacttacaataggaccacgatttgccacgggagacctaggatggcatctcgttacccagc

SEQ ID NO: 650455 - DNA, 537 bp, Homo sapiens
agctgactctagagtatcccccctgtcaaccttccagtacccgtacgctgtaccttcagatcgatgtcactttggacattgatgcccatggtactactcaatgtctctgctgctggaccagagtacgggaaatgagaacaagatcactattactaatgacaagggccgtatgagccaggaacacattgtgcgtatggtccaggaagctcgagaagtcacgaagctgaagattaaaagcagagggacaggctgtcgccaagaattcacttgagtcctagtgcctcgacatgaaagcaacagtctgtagagatgagaaacttcaaggcttgattaccgatgaggactaacagaagattctggacaagtgtattgaaattatcaactggcttgataagaatcacactgctgagaaggaagaatttgaccatcaacagaaagagctggagaaagtttgcaagcccatcatcaccaagctgcaccccgaggtgttcctcagattgaagtcacttttgacattgatgcccatggtacactcta

SEQ ID NO: 650456 - DNA, 326 bp, Homo sapiens
agagggcctatcccggatctgggtagctgggagcggtttatcacaccacgccagctaattttgtatttttagtagagatggggtaatccttgtcggtcaggttggtctagaactcccgacatcaggtgatccacccaccccggccttccaatgtgctgggattacaggcgtgagccaccgtgcacggcctagctgtaccattttacattcccatcagcagtgtataaaggttctaatttctccaaatccccatacatacacacatacatcttttttttttttggagacagtttttttttctgtcccccaggaaccgggaatggtac

SEQ ID NO: 650457 - DNA, 118 bp, Homo sapiens
tatttaatgtcaaaacaattaatgcttcattattcatagattctctgaggttccgtagaaccacaccaccttcgtgtatggcacgtttgtagctcgttatatcaagagagaggctgca

SEQ ID NO: 650458 - DNA, 448 bp, Homo sapiens
tgtatgttgtgtgttgtgtgtagtgtggattgtgatatttgtagtgtgtgtagtgtattgtgtggattgtgtggttagttactgcgacttgtgttgggactgctgataggaagctgtctacaggaaatgctaacattgggcaccctgactgcaagttcaaagacacagcagttatgccagatggtcagtttaaagatatcagcctgtctgactacacaggaaaatatgttgtgttcttcttttaccctcttgacttcacctttgtgtgccccacggagatcattgcttacagtgatagggcagaagcatttaagaaactcaactgccaagtgattggtgcttctgtggattctcacttctgtcatctagcatgggtcaatacacctaagaaacaaggaggactgggacccatgaacattcctttggtctcagacccgaagcgcaccat

SEQ ID NO: 650459 - DNA, 454 bp, Homo sapiens
tcctattgctcgctatggagtgccatggcctgctcttggctcgctctaacctctgcctcccagggactggcaatgcttctgcctcactctccacagcaactggaactacaggcctgtgccagcatgacccagtacttcttgcgtcaatgagtagagatgggttttcaccgtgtcgactaggctgggctcaatctcctagtagctcgtaggttcgaccgcctcgggctcccaaagtgctgggatatgcaggcttgggccaccgcacccggcctgaagtgtatatgtttgttcttgaaaagaccagtgtaagtagaagtgtattttgactatacaattagttgaaattggtgtataagttaaccagatagtactctgaatcacagagatggttgaatactgacacactgtacctgggataattcctactggcctcatgtggaagggtggtgcctat

SEQ ID NO: 650460 - DNA, 662 bp, Homo sapiens
gttaatcaggttgttttaacctgatatgtttcatggtctctgtacctcattcactttggcaataatttcagagatagcaggcattcccatgggtaaagagggaaaaggaggaaaggaaaaaagccagaaattttacacctgagcctaacttcttttctaatttatttgtttgcttaggtacttggtgagagacctctagttttgtaaatactggctgaacaaaatgaggataagaaagaattaaaaaactaaacctttatttttgaaaacactgctataacatctagcataacctagcatatagcctctgaagcaacagaaaaggaaatatgcttgatattttcaactagtatgcctggacattttaaagttgattgaaaaggcctggcatggcggcttatgcctgtaatcccagcactttgggaggccaaggcaggtggatcacctgaggtcaggagttcaagaccagcctgtccaacatgatgaaccttgtctctactaaaactacaaaaatcagccaggtgtggtggtaggagtctgtaatcccagctactccgtaggctgaggcaggagaatagcttgaacctgggaggcagaggttgcggtgagctgagatggcgccactgcactccagcctgggcgacagggtgagactctgtctc

SEQ ID NO: 650461 - DNA, 141 bp, Homo sapiens
cacgagggggctttttttctaaaaaattttaggcttttcccttttttaggtttttaaaaaggatttttacaccaaatggccccaaggggaatccccccgggtttaccccaggtgagagagagttttcgaacgcgcgtttac

SEQ ID NO: 650462 - DNA, 151 bp, Homo sapiens
aatgtccatcaatacagtccttacaaggttactcatgaaaaataagtggctgggcacagtggactccatgccttataatctcaacactttgggatgccgaggtttcgagaccagcctagagcaacactagtagagaccctgatctcttgca

SEQ ID NO: 650463 - DNA, 427 bp, Homo sapiens
gactctacacggataccctgctgcttctcctcctcgcggggcaggtaatgacgaaaaataacaatacaggactctttctgaggcccatgttaactccgaatgattccactttaaatctctttaatgagcatccattggagggcaatgtctaggtgccaccagccgcgcgtaattccagcctccaatagcgtatattatacgttgctgcattcttacaagctcgtactttgatcttgggagcgggcggtcggtccgccgcgaggcgagccaccgtccgctccccgcccccttgtccttctctggtgccccctcgatcctcttagctcagtgtccagcggggcccgaatcgtttaatttgtaacaattagagtgttccaagctcggcccgagcctgctggatcccgcttcttggaattatgcactatga

SEQ ID NO: 650464 - DNA, 675 bp, Homo sapiens
atgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttcttttttttttttttttttttccctatttgggccaaactctgggaaactcttaaaatctttgttgggggcccgccccaccagggaccaaaacaaagcttttgaaaaaccttttaccatgtgaaaaaacgcacgtgacatttttttttaatttaaaatatacgccggggactttaacctgtgggttagtgcccatgtgctcttcagaattggctcttacataggcgtgactatattgttattcaccctttcttctcagctgtgggatctccaatgtgggtggattttctttctaccaaaacatctcaaaatgtgccctctcaaggccaatctccttttggggctgatattgttttggcagccatactggtttcgtttaatatacgcaacaggattagtgtggcggggaacacaccggacgattcaggggggggagggctaattaaagaaaacctg

SEQ ID NO: 650465 - DNA, 198 bp, Homo sapiens
gtgacatccactgggggaaagaatatcagagtctccatgcacacagcacgagcaggtaaaaaaccaagaagtgctagactatatactacttcaaaatcgtattttcatttagaaataaacatgtgtaacagtactgtgtcacttttacacgacacccgtcatcacttttcaattgactactttgcagctaacatggcc

SEQ ID NO: 650466 - DNA, 318 bp, Homo sapiens
  misc_feature (28)..(28): n is a, c, g, or t
  misc_feature (78)..(78): n is a, c, g, or t
  misc_feature (81)..(81): n is a, c, g, or t
  misc_feature (86)..(86): n is a, c, g, or t
  misc_feature (90)..(90): n is a, c, g, or t
  misc_feature (93)..(94): n is a, c, g, or t
  misc_feature (110)..(110): n is a, c, g, or t
  misc_feature (113)..(113): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (147)..(147): n is a, c, g, or t
  misc_feature (154)..(154): n is a, c, g, or t
  misc_feature (177)..(177): n is a, c, g, or t
  misc_feature (193)..(194): n is a, c, g, or t
  misc_feature (312)..(312): n is a, c, g, or t
  misc_feature (318)..(318): n is a, c, g, or t
cccttgaaagaggaaggtggtcatggcnttgcgcaggtgtatggcgagctggcggatgtagaggaaggcgtgctggtnggncacanccgnctnnagggccagcagctccntcnagntncanctgcatgaatctgatgaatgggaggncaccagngcgagctgaacttgcagttcctnacattactgtgatgtnnacatttgcttgaggacgtgtggccaaggaaatgtgtcctctcttgttgccggcatgactctgcttgaggaccagtgaaagccagcaccctgcagagactccttccccatgtgctccantacgan

SEQ ID NO: 650467 - DNA, 131 bp, Homo sapiens
agtcattccacgaataaccatagaaatgaaagcagaggcagaaaagaaaaataaaaagaaaattaagaatgaaaatactgaagggaggcccctcaaggaagattggtcttggaactaggaagggccttaaa

SEQ ID NO: 650468 - DNA, 275 bp, Homo sapiens
  misc_feature (28)..(28): n is a, c, g, or t
  misc_feature (78)..(78): n is a, c, g, or t
  misc_feature (81)..(81): n is a, c, g, or t
  misc_feature (86)..(86): n is a, c, g, or t
  misc_feature (90)..(90): n is a, c, g, or t
  misc_feature (93)..(94): n is a, c, g, or t
  misc_feature (110)..(110): n is a, c, g, or t
  misc_feature (113)..(113): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (147)..(147): n is a, c, g, or t
  misc_feature (154)..(154): n is a, c, g, or t
  misc_feature (177)..(177): n is a, c, g, or t
cccttgaaagaggaaggtggtcatggcnttgcgcaggtgtatggcgagctggcggatgtagaggaaggcgtgctggtnggncacanccgnctnnagggccagcagctccntcnagntncanctgcatgaatctgatgaatgggaggncaccagngcgagctgaacttgcagttcctnacatagcgtattgacatctgcatcgacggtatcgtgtacatggagaacgtgtccttcatagaccggcaaattgatgagaccatggtagccagcacatg

SEQ ID NO: 650469 - DNA, 129 bp, Homo sapiens
  misc_feature (101)..(101): n is a, c, g, or t
taaaatgtggactcagcgaaagatccaagggccgacttctccccaacgtgcgtgcacgctgatgtgaggtctgggcatgggaaagttcctgggcgaagcgntgggacacagacctgagtctcaagtggc

SEQ ID NO: 650470 - DNA, 704 bp, Homo sapiens
ggagaaccatcccggtaacccgatcaccgctgtcaccatgaaccacattgtgcaaacccttctctcctgtcaacagcggcagcctcccaatacgagatgctcaaggaggagcaggaagtggctatgctgggggtgccccaaaaccctgtcccccgatgtccaccgtgatccacatccgcaggagacctccgtgcctgaccatgtggtctggcccctgttcaagcacctcttcatgaacacctgctgcctgggccttcatagcattcggtactccgtgaagtctagggacaggaagatggtctccgacgtgaccggggcccaggcctatgcctccaccgccaagtgcctgaacatctgggcccttgatttcgggcatcttccatgacccattctgctcatcatcatcccagtgtaggtccgtccagggcccaaagcgatagcatcaggaaggcatcactttggagggccaaggggacgcttcctggcccggtgcaccgtggtatccccaacggtacttcctagtctgtgccatttcccttcgcgcccattggccccccaatgagggccaaggagagcttctggccactttggaccctgggtaattccccaacgtttaactctccgaagcgccttttcccaagttgccctttcagcccccctggtgcctccaccaataggcaccgaagtccctgtgcaatccaacg

SEQ ID NO: 650471 - DNA, 401 bp, Homo sapiens
tccgtgtgtagcagcagagacacaagcatcatcaccagatcctgtcctcctccctctgccatactatcgctaaaatacccctcttcaaataaaacacacagcccaattgaaaaaacacccctcccccagagagaatagttactgtgacattagactggagagtcagccaggtgtgatctgccactaatgaccactacagcaaagagacagagagagagggggagaaagagagagaaaaaagaggcagagagagagagaggcagagagagagagagaggcagagacacagaaaggaggaaatatgaggagaagtgatatatggagctagagaaggaagaggtctgttgagatgtaaaagtaagcgtcgacgcggccgcgaatttagtagtagtaggggccgc

SEQ ID NO: 650472 - DNA, 570 bp, Homo sapiens
  misc_feature (560)..(560): n is a, c, g, or t
  misc_feature (563)..(563): n is a, c, g, or t
gaaaataggtaacaacataaagacaatatgcaaatatctttgagctgcattctttacttcctttttattcctagcaaatcagtaacaatgaatgccttatctcctctacatgcaatatggatatcttccaagagagtcttgttttacaaagacaatatttaatttttatatgctttccagatatcagcttcaaatataatataacttgagtagcattctaagccttttttttttttgagacagcctcgctctgttgcccaggctggagtgcagtggcacagtctcagctcactgcaacctccgcctccctggtttaagcaattctcctgcctcagcctccctagtagctgggattacaggcgtgagccaccacgcctggctaaattttgtatttttagtagagacagggtttcaccgtgttagccagggtgatctcgaactcctgacctcaagtaatcctcctgtctcagcctcccaaagtgctgggattacaggcatgacccaccacgcccggctgcattctaagctttttaaaagaaaatagatggcaaaaatagagnggnggatcaa

SEQ ID NO: 650473 - DNA, 268 bp, Homo sapiens
  misc_feature (88)..(88): n is a, c, g, or t
  misc_feature (116)..(116): n is a, c, g, or t
  misc_feature (181)..(181): n is a, c, g, or t
  misc_feature (213)..(213): n is a, c, g, or t
ccgggccgggattgaggccagtcttagatgtgcagtaccgtgactgacgtgctggtgccaacatcgtccaccgtgggtcgtacagtancccgtggccgggcagtgagggacaggancccttcctgcaagtggctcatgctgctcagtaatgagtcagccctgccacatgtgcatacttgtnagctatggagatgatgaggctccctcagcagngcgtacaatccagcgggtcaacactgagctcatgaaggctgccgttcgggggtct

SEQ ID NO: 650474 - DNA, 338 bp, Homo sapiens
ttttttttgagacggatcgtctctgtcgcccaggctggagtgcagtggccaagtctcggctcactgcaagccctgcctcctgggttcacgccattatcctgcctcagcctcccgagtagctgggactacaggcgcccgcagccacgcctggctaatttttaaaaaaattttttattttgaatagagacggggtttcacatgttagccaggatggtctccatctcctgacctcttgatcctcccacctcggcctcccaaagtgctgggattacaggcgtgcagccgcgcccggccagatactccatttcttaaatccttcaatggcttccagtgcactt

SEQ ID NO: 650475 - DNA, 505 bp, Homo sapiens
ggcgggcgcggtggctcacgcctgtaatcccagctctcagggaggctaagaggcgggaggatagcttgagcccaggagttcgagacctgcctgggcaatatagcgagaccccgttctccagaaaaggaaacaaaaaaaaccaaaggacaaaaaaaaaaaaaaaaaaaaaaaaaaaaaattgtgtggggggcgccccggcccccgaaaaaaaggtttcaagaacacattgcgggtggcggcggcgggcacccagagcagggtacgtggacactgggcccaaaagcgggtctacacagagagaaaccgggcacagaggaaccagggtgtggggctttcccacaaaatataaaaaaggcgcgcggggggaacaccggaggcggtctgaggacgcaaactaccaagaggggagatccggggagggacaacagggcgcgttcaaaccaacagggcgggtccaaggcggagggcggataattaaaaataagcccgcggccgggatagaatc

SEQ ID NO: 650476 - DNA, 912 bp, Homo sapiens
gattatattttcaattgactacctttcatacttgggatgccctcagaggaacataacagttctcgtgaccaaagcttttcgatacttctattaagaagaatccatcgtgcagggcgcgagtggacctcatgtctgtagtcccagtcacttggagatgctgagagcgggcggatcacgaggtcgggaggtggagactcatcactggccaacgacaggtgaaacccctatcatcatacataagaatcgtaaaaggtatagccagtggcgtggtgcgtgggtgccttgtagtccgcagcatattcaggcgcaggctcgatggcaggatgaatgggtattaacctggaatggcggagattgcagagagccgaggatcggcagccacttgccatctctcaagacactggggcgttgacaagagtcggatggacttccgtgcttccgttgactagtaatagatgctttaagagcttaagtcaaaacattctcgtaggtggatgccaaaatattttctgaatgcgccgaaacttggttctagacatgaccattgtcatttccagaaaaggctcgaatctctaaatagcgcaccgtttgagccgtccgataggagggccacgggcatgaggctcggcgcacgagtttgcacatttgtctcgctaagctctgagacgtctattcttagcatacccttctcgtgccgtgagcgggatgtcccttgagcacatgggggattcaaccctagcgggcaggagtggggattagcgaattgcacaaatcacactttcgggctggacaccgaatttgtcctgctttctgcacccctggtcgctcaaccgcggaaagggactcctcaccagagtttgctgggcacaatgggcggcactgaagaacactgcaacctgtcacgacaagatt

SEQ ID NO: 650477 - DNA, 897 bp, Homo sapiens
  misc_feature (44)..(44): n is a, c, g, or t
  misc_feature (79)..(79): n is a, c, g, or t
  misc_feature (87)..(87): n is a, c, g, or t
  misc_feature (123)..(123): n is a, c, g, or t
  misc_feature (160)..(160): n is a, c, g, or t
  misc_feature (167)..(169): n is a, c, g, or t
  misc_feature (184)..(184): n is a, c, g, or t
  misc_feature (210)..(210): n is a, c, g, or t
  misc_feature (218)..(218): n is a, c, g, or t
  misc_feature (228)..(228): n is a, c, g, or t
gtgtctgtacagcatggatgtggacagggaaaacagcaagtgcncgcggtgggacatgccacaggtcaggctgggtgtnaataaagngttcacactgcttccctgctttccccagtgactganggctctaggccacctcctcctcagcctcctcctcganctcgccnnncgtcgctcggctgtngcatcctggtactgctggtactcggncaccaggncattcatgtngctctcggcctcggtgaactccatctcgtccatgccctcgcccgtgtaccagtgcaggaaggccttgcgccggaacatggccgtgaactgctcggagatgcgcttgaacagctcctggatggccgtgctgttgccaatgaaggtggcggacatttttagcccccgaggtgggatgtcacagacagccgttttcacattgttggggatccactcaacaaaatagctgctgtttttgttttggacattaagcatttgctcatccacctccttcatggacatgcggcccctgaacacggcggcaaccgtcagtagcggccatggcgggggtcgcaggcagccatcatgttcttggcatcaaacatctgctgggtgagctcgggcacggtcagcgcccggtactgctggctgccccggctggtcagtggggcaaagcgggcatgaagaagtgcagccggggaaacgggaccatgttcacagccagcttccgcagtccagcattgagctggcctgggaagcgcaggcaggtggtgaccccactcatggtagcagacaccaggtggttcaggtcaccataggtgggcgtggtcagctttagggttctgaagcaaatgtcgtagagagcttcgttatcaatgcagtaggtctcgtctgtgttttctacgagctggt

SEQ ID NO: 650478 - DNA, 261 bp, Homo sapiens
gtcgatgcctcactttgagaggcactgatgggtcggttcacctgacggttggggagtacacgaccagcctggccaacatggcgaaaccccgtctctactaaaaatacaaaattagccaagcatggtggtacatgcctgtaatcccagctactcgggaggctgaggcaggagaattgcttgaacctgggaggcagaggttgcggtgagccgagatcgcgccattgcactccagcctgggcaacaagagcgaaactccatctc

SEQ ID NO: 650479 - DNA, 244 bp, Homo sapiens
gatgacaccaagacccccatttgaggacatctatcgtatactgatgatgctgagtcacaaatagaatttataaagattcttcgctataaaacttgtaagctaactgcaacggaaaaacaccttcttttgctgctgcacatatgactaccctccctcaggtgcacttggctagctccaagcacctggctttggactaggggacaacggaagagcccttttgccatcacaccacctgtacctctac

SEQ ID NO: 650480 - DNA, 327 bp, Homo sapiens
gggcaggcagcttgctagctgctaggtcgactagtaggacccccatctagcagccgtgccgaatacacgctgcgcttattctccgacttataactgggcggacgagtggaatccgacatgatttaattataacgaagtatcgtgaatgcccggtggcggttgttgactgcgatgtgatttcttgcccagcgctctgaatgtcaaagtgaagaaattcaatgaagcgcgggtaaacggcgggagtaactatgactctcttaaggtagccgaatgcctcgtcatctaattagtgacgcgcatgaatggatgaacgagattcccactgtc

SEQ ID NO: 650481 - DNA, 369 bp, Homo sapiens
gttttttcctatttttttatgggggaacttcccccccattttttttttggggtttttcctttttaaattttgaagggggcgggccttttccacccctttttttaaccccctgttttttaaattaacttttttttttttttttttggggaagaaaaattgatgttggcggaaattggggggctcttcccccccaggggggataaaattttttccaaccctcccccggggggggtccttcaagggggggagcccccacccgcctgccccggttttttgggtccgggggggtgggtccccaaacccccccaaaaggggggggggggggaatggacgttttttttttttttaaaaaggccttttcccttttta

SEQ ID NO: 650482 - DNA, 108 bp, Homo sapiens
  misc_feature (84)..(84): n is a, c, g, or t
ttatagacgcattgtctctagagtaggagcgacgtcggggtggtactagtagcatgcagagtctcgttcgttatcggaattaancagacaaataggtccgacaactaa

SEQ ID NO: 650483 - DNA, 161 bp, Homo sapiens
gagactcaaccccaaggccctgacgctggaccagtggctggaacagcacaaaggggacttcaacctgctgtgacctgcccgcctcgcggccccttgttgggattggggggggcagaggggcataggcaaaaacacccccataaagccattgttttcccaga

SEQ ID NO: 650484 - DNA, 188 bp, Homo sapiens
cctgggggggccccccccccgtatcaaggccgagctgacttcctcagccccagcctgttacgccctggccgtcagccccgacgccaaggtttgcttttcctttttggccaacggcttcaccccttcccctgctgcatgtgggggccgatgggcaggggcccccggtggaaataaaatgtttttttcca

SEQ ID NO: 650485 - DNA, 129 bp, Homo sapiens
gccccccccccccgggggtaaaaaaaccccaaaggggacccccccccccccccgttcccaaaccttgcccaaaggggtttttttttttaaaaaaaggggacgttgaccccggggggaggggcccgggga

SEQ ID NO: 650486 - DNA, 111 bp, Homo sapiens
tcaggccggaataaaggtttattgtgctggtgccttatatctcaccacctgtagagctgtgcagaggttgggggagccccacatggagggatgggggagaggacctcctgc

SEQ ID NO: 650487 - DNA, 851 bp, Homo sapiens
gagagagaactagtctcgagtacgatttttttttgagtaccaataagtctttattattcattggtattttcccaggaaaggagaagggaagggaaatgtcagcttgtgtaaaaaatgattagaaaatgggaaaggaagtacccagtacagaaaatcaaccatcaaataaaacaccccagtgatggggtcccaaagcccaaaggggctcatctcctgcagtccaggaatgagggcacaggatcatggaaaaaaacagacaggtacgggctttcctaccctcccgccccataaattcaagattttacacaaagtttgggtttctagcagtaaaacatggagtcacatcgttcgtctcctataaacaatcttgtgccccctttgacataaagtttctagcacctgcataaaagttcctgagtgactggatatacattcatattccctttctgtggctcctgaccccactttctacaatggaaggcccccaaatggcatctcttaactttaggattagaacattaaaaatttagtggaagggttttgtatcccatccaaaattaacagtcaggtgtgtactggggtcctgtgtcatggtctggttctgagcaacagagtcttgccttctgcaaacccagtgcttgtcaggtctacggtgtacccaattctcaggccaaaccggcaaccctactgcatatcgaggacaccatacgattcacacgtgcatcactcacaccggatatcacttctgattatacgccatgccatcacttccggtcacatcacatttcatatcataaagagatattgccagaaaatccaaaccaatggaatcttcacaagaaaccacttga

SEQ ID NO: 650488 - DNA, 339 bp, Homo sapiens
tggcatgatacggatttgttgcacaacagtggtatattcacactctctgtcgacatatttcatcaggttacgcagaaccgtgtgtaattaacagcttatgattagcttagtttatgggatttcccatttaatagttctggcttggaacacccttgtcgtcgaagacactgaaagcaaaacgttaggtaagggggactgctgtagacacaagatctttttctcacggttttactcgcgatgccagaaggaaataatatcgttgtgtatatgaagaaaagttttaataccattaggtggacaagtaaaatacacgatcgagtgaatcagaaattagcgttt

SEQ ID NO: 650489 - DNA, 102 bp, Homo sapiens
ctagtcaccctaaataattatgtaaatgcctttactttgaactagtacattgcaaccagatacatcacttttcagagttagagtaacataataccttggaaa

SEQ ID NO: 650490 - DNA, 215 bp, Homo sapiens
tctggatgcaagtgtcgcccaggctggagtgcagtggcatgatatcggctcactgcaacctccgcctcccgggttcaggcggttcccctgcttcagcctcccgagtagctgagaccgcgggcactcgccaccacacccggctaatttttgtatttttagtagagacggggtttcactatttttggcccagggtaccgcagctcgcacattcgtca

SEQ ID NO: 650491 - DNA, 397 bp, Homo sapiens
atcgcgtaggggagcatcagaatggcaggttgtggtttcggtctccacgcgtgattgggctattaaaaagcaccttcatagtaccagaccatgtggtgccttgtgagagtataggacgagtgctggctcagagatgctttgaggcgggaatcaactgcatggtctaccaactaacctcccgtgggaggcacgcctcagactcaatgaaacgactaccatgtgccatgacagacggtggtgtcggtttacgggaacctcagcagaatctatgaatgaatggaagcattatttgttctcgaacattttacttttcttctgtcagccactaccgccatcctcagagagcatctggtagaacagccagactggaagtttacagcaagtcctgttgccgtgt

SEQ ID NO: 650492 - DNA, 575 bp, Homo sapiens
cggccggtgagattggaagtaggcggcggcggcaggcggcagaggggagtccgaggttatagcgtactcaatagatacccgcggaaacgctacgggtctaagaacacggatacagggtagtactacctagggtactctacaaagacacaggtacctagtacccctagcaactagctagggcagataagcaagcgagtcgaccatacgtcccccatactggacgcgcccagggtctaggcacgcccaggtccggtcaactcctactcacccccacacatgagtcccgcaattcctagccgacagcacctcaggctgggccaactacagactccaagcgcgtcctctccagactatgctgttacggacttcacataagtactcgctctaccgccttcatcatccagcgaatacgcggactcatgattttctcctcactaccatcagctattccgtgagtatactttcgtattacttatctatggtaacgtgcacgtagagctcgaaaggaagaagtgtttcacctggttcgcacttgtccgaccagagcatgcagatagcactaaaaagtcgacacc

SEQ ID NO: 650493 - DNA, 180 bp, Homo sapiens
gcccattccgccagcttcgccactgtgtccgcatcgttcgacacatagacgaagacaaacttgtcaccccccagccgccctgcgaacgacgcgccggtggcgagcgtcttcagccgctgagccaggctgatcagcaaggcgtggccaccgccgcgaccgtgcagatcattgaccgcccgg

SEQ ID NO: 650494 - DNA, 469 bp, Homo sapiens
  misc_feature (347)..(347): n is a, c, g, or t
cttctatgcacactatatatcaaaaatgagctgcaatagcatcgatccgactaatggacgagaaacagtcgtgcatgtccagtgatcatcatcagtattctactacagagtttgaccatctgtcgccgaggaatggagctgactttgacatcataggcataaaggagctacttgagggtctggaccatagtgttcatttagaagagaatctgacagccagggcatattgcagtcgtcgctgctgtctttgttttacaaaccagagcacaagtcctctgacagcacattcctggtactcatgtctcatggcatcctggagggaatctgcggaactgtgcatgatgagnaaaaaacagatgtgctgctttatgacaccatcttccagatattcaacaaacgcaactgcctcagtctgaaggacaaacccaaggtcatcattgtccaggcctgttgaggtaatccgtgaggg

SEQ ID NO: 650495 - DNA, 126 bp, Homo sapiens
gtaaccaggtcggtcaggatcatgtcctgggtaagggcagctttctcttctgtgatcagaggatacttagaacaccaaccgcactgttatgttcccctatcttctttcctctttgctttgaggacg

SEQ ID NO: 650496 - DNA, 1083 bp, Homo sapiens
gccgggccgtgctggtgcctgtctgctgctgtgcgccgtccgtgtgtgcaggctgtgtgtgagcccatcatgcctgggactggccctggcctgcgcgtccctcacctgtgctacactctaccctgcgtctctactgcctcttctgccgacgtgcctgccgcggcacgacaccctgtgcagcactactagcccctggggcagtgccacctagcccagcacagggattcctagggaccgaaccaaacctaacttacgggaaccaggccattctctagccaaaagcgaaacaaactccacttcatattaacacctggcccggctggctaattgggctttctccagctacacatccaaaagccctccaaacgaggtcccccaaacgcaaacaccattcctacaccgctacgttcacgtgcaaacggcggcctgggaccaggggcacccgcgcccaaacaccacttgtcagctcaagccaaaggaatccgactccgccagcagccaagtactaataccagaagtgcgcttgcgctcctgcaaacacaaccatgaacctaaatggttccccagaccctggatcacaggcatgagccccaaaccaattttggcgaaccgtacaatcccgaaacacttcggccactaccaaaaagccaacatcaagcacctttggctaacccaacaacgggcagtcaaaggctcgcacccacaggctaggttgagaagttttcccccagccgggccacaaagccaggattggcactgcttggccccaatgcgataggcggagggggatccccgagttccttttccaatatatttcatacgaccttgacacactatgggcacttaacgaaccgactaggcaactttggcacagcagcacctaccaataatagaagatggccccaaaaatcaaaaaggagcccactattccccctcctgacaccctattaagtcacagttcggaaaacccaattgggaatggaggactagtcctcggcgatctctcacccataagcagcgcacgacagccgacgccccgcagaaggatcaccagcatcacctatattccgtacacgccccaca

SEQ ID NO: 650497 - DNA, 163 bp, Homo sapiens
  misc_feature (47)..(47): n is a, c, g, or t
caacatctgcacttggagcactgaaggttggcaccattttatctggnttctctgcctccaccttggctgcttcccccattggagaggaacctgctttggtgggcagggagaagaaaagtgacttcagattttccttccccgcagcaggcaaagcaacaagaag

SEQ ID NO: 650498 - DNA, 154 bp, Homo sapiens
ttagaggatcccccctttgaggtgctgacaggacaccaacctggtgtgaacagatggactatggttcaaggacactggaattgaggagctgatcaaggctctcttcagccttgctcttgtccctgcctcttatcagaagcacaggttagacaca

SEQ ID NO: 650499 - DNA, 909 bp, Homo sapiens
ttacgggcattgccggcaggcggtgtcgcggatgggctggtgccccgcagcatgttggcggggtgctggttgtgctggcggctggcatgggccttggggctgccggctgcgctcgtggcctgtgcgcggcggccgtgcgtgtgcacgccatggacttcaacatgaagaagcatggctgtctgtgacgctgggcatcgttcattcacccggtgcggtgcagttcactggagtgagaaattttggccaggcttgagaagactgagcttgatgcccactttgaaaaccattctggccctgggcatgacagcaccaagaactggacagagaagatcttgagtgcagacagaggtgcttgctgcagcccaaccccagtgcccgagtggaggagttcctgtatgagaagctggacagtgaagtgtcccctcaagggtcaccaacaggggaagctgctggctcaggtacatggacagacgcggacagtgagctggggccagaccacccccgtatgggaagaccactgatcaaggatggcagaagctgagaagcaaattgggaaccgcggagagggattataatccaacacagaccgtcacatacagcttcactcacaccacttgcgcaacttccatggaggggggactggaagaacagtctcgaccgcagagagcggattcatccaaaaccgggaggtcttggaccttggcatgccctgccacaagccgaggtgctgacagcaacgggccaaggaagcgggaggacaggcccaaaggacaaaggaagcgaggcgcactgacgctaacaacggaggacctagaagccaacgggcgagagcacaaaaccaacgacgagagcgagagaggccgacacgaagagcgccacggcgcaccgcgaagagcagccgcaaccggc

SEQ ID NO: 650500 - DNA, 105 bp, Homo sapiens
ctgttaccactgagccaggagctttgcgtcgaccataggtcaggagtttgcgtcgagcaacaggccaggagtttgcgtcgaccacaggtcaggagtttgcgtcgt

SEQ ID NO: 650501 - DNA, 219 bp, Homo sapiens
ctctagaggatcttatccccggctctgggtagcatagggaagttgttaaaaaactaaaaggatagatccattaatgaggtaacaaattattgccttcatgttgggacagaacagggccaaatggaaaagaatgaaagagaaagacagatagacacacacacacacacacagacacacacacacagatttttttttttaattaaaaaatatatattgttg

SEQ ID NO: 650502 - DNA, 254 bp, Homo sapiens
cctattatagaagtatcaatagcacttattatttgccactatttgaagtctgcactttacaacagattctatggactaggtaggattcatatccatacagctcgttcaactttagcgcctgtctcgtcccagtggcttttccagaactactgccttcaccatgaagctccatgagctatcccaattcaaacttgggcttcttcagccattttaaacttttcataacgaagaacatcatggagacggatacatag

SEQ ID NO: 650503 - DNA, 100 bp, Homo sapiens
cggcaacgaaggtaccatggaatattgagctttctgactgctacaccaacttatatgggtgcagtttatggcaccctaaaacagttgtagtaacatcaaa

SEQ ID NO: 650504 - DNA, 267 bp, Homo sapiens
  misc_feature (9)..(9): n is a, c, g, or t
gaagagaangcggcacagccccagcgccgaccagcagggggcacaggacagagaagaggaagcggctgcagctccagtgccaaccagcagggggcacaggacagagaagaggaagcggcagcagccccagcgccgaccagcagggggcacaggacagagaagaggaagcggcagcagccccagcgccgaccagcagggggcacaggacagagaagaggaagcggcagcagccccagcgccgaccagcagcgggcacagggacagaga

SEQ ID NO: 650505 - DNA, 104 bp, Homo sapiens
gaagcaggagaatagtatgaaatcatggaggtggaggtagcagtgaaccgagatcacgccattgcactccaggctgggcgtcagtggccactgcaccccagcct

SEQ ID NO: 650506 - DNA, 155 bp, Homo sapiens
agctcggtaccccttccaacctctggtggctgccagtttccttggcattcgttcctggttttgtagacgtgtgacagcagcccaggaagctgacccgatagacagcgtgaagtcgtacccgtgcgttgtggacaccgacgcgggacgctgctgca

SEQ ID NO: 650507 - DNA, 997 bp, Homo sapiens
agcggaggtctcgtcgcccctccctgcaagggctcagtgctctctcccctcctgttcttcgtccgccgctgtatcctcggtccctgagcggccctcaggaattccataccctcgataatctgcttactgtaggatcggtccactgttggcggccctgtcctgccgggtctccttcctgcacgatcatccgggggcgccctggatgagtccctgaagatctatgctcctctgtacttgatacttggcgacagttctactcatgcgactcctggctttggtgcctggtctgccaaggatcttatgtggccccttctccattgcagcgcaagaaacgcgaggagagggctgctcgacacatttatatggccgacttggccgacagaaggcactattcacgaatgggctgtagctagagaggaaacatcacgaacattaaggaaactggacgacgatccttcctgttgtatgactatcatcacgactgcccattgtaacattgattgctattccgcaggagtgccaatggcatgtgcttgagaagcgatttcacactattgtctggcaccgtttaggtttcatccgtcaggcgaacgcgaacgaagattcgccacaccattcttattgtcgacccaggaggcccgccatatgcggagaacgtaggtaacaaacacatcagaggagcaaacatgagcgaaaaaacccagaaagaatgaatatgcatttggtctaggtcgggaccatttgtggattcactagtgcagaatagtggacccaagggcattggacctgttgcagaaccccttaatgcgaatgattcacgttggcattcatccttagtttgcctttaaaaccgggttccagtcccgacactgtttcaaaccgttggcgtactttgagccccagatgctgacctccgaaattccctttctggcatttacacggcgctccctgtttaaaccggcaaccccgggttaatatctcctcattctaacagaaa

SEQ ID NO: 650508 - DNA, 349 bp, Homo sapiens
  misc_feature (349)..(349): n is a, c, g, or t
accaagtcaattcagagtaccttattctatgtggttattaatacagtatgaacaattagtctaactctgcatagacagggtctagattttgttaacccacatgtataactgcagttagcttaaattacaatttgaagtcttgcggcttttatatagttaggcactatattacactatcgaactggcacactccgttataggttcatgtgactgtcctgtcataaggtgcttattaatggaacaactacacagactactgttgtacaacctttagcatctagttcttttaccactattgttgccatgacactacctcggattatgcatgagtgagtatagtaccccgtgn

SEQ ID NO: 650509 - DNA, 261 bp, Homo sapiens
ctggcctatatactctatttatgataatctctcctcatatttaatactcaaatattgtgcatattcgtatcattcactattaagtctggcttatttctttgataatgaactgaatgtggccgtggcgcaatgtctcacgcctgtaatccctgcactttgggaggccaaggtgggtggatcacaaggtcaggagatcgagaccatcctggctaacacggtgaaaccctgtctctactaaaaatacaaaaaattagccgggcg

SEQ ID NO: 650510 - DNA, 275 bp, Homo sapiens
tatatgctgctcagtatacagtaacaaacaggatgatgctggagactgcagcgagaatcgctactgcataaaaatgcatgagagagagataggcggagatgtgctgaacagcgttctgtgatcccacaggagtgataaaatagtgtcgatgctggatatttcagagttgaaagcctgttaaaattattctcaggactttctgtctcttctgaagggccttctccaagacttggaacacctaagtctgtcaaccaagctgtatctcagagtagaaa

SEQ ID NO: 650511 - DNA, 1119 bp, Homo sapiens
  misc_feature (34)..(34): n is a, c, g, or t
  misc_feature (210)..(210): n is a, c, g, or t
  misc_feature (217)..(217): n is a, c, g, or t
  misc_feature (228)..(228): n is a, c, g, or t
  misc_feature (268)..(268): n is a, c, g, or t
ctgcgattacatcgccctgaacgaagacctgaanacgtggacggcggcggacatggcggcgcagatcacccgacgcaagtgggagcaggctggtgctgcagagcattacaaggcctacctggagggcgagtgcgtggagtggctccacagatacctgaagaacgggaacgcgacgctgctgcgcacagattccccaaaggcacatgtganccatcancccagatctanaggtgaagtcaccctgaggtgctgggccctgggcttctancctgctgacatcaccctgacctggcagttgaatggggaggagctgacccaggacatggagctttgtggagaccaggcctgcaggggatggaaccttccagaagtgggcatctgtggtggtgcctcttgggaaaggagcagaattacacatgccgtgtgtaccatgaggggctgcctgagccccctcaccctgagatgggagcctcctccgtccactgactcttacatggtgatcgtagctgttctgggtgtccttggagctatggccatcattggagctgtggtggctaagtgatgaagagcaaggagaaacacaggtggaaccaggaggggactatgctctggctccaggctccagagctctgaaatgtctctccgaggattgtaaagcgtgaagacagctggcctggaactggtactggagtgacagacgcatgtgtccaggtctctcctggtacattcagaagcctcagttccctttacacaaacattgtctgatgtccctgggaagttgggtccggggggagaaacggtggagcaccaaaacgtgcccggacacacaagggacgcataccgtgatgcccttggtaccctccaaagccacgttgggcccagcaacaccgggggcagactgtggcatgtttgaacgagtggccacaaagtgggcagcaacacacagaggacaaaacagacgaggtggaggcacaaaccaacggcagaggccacaagagagaagaccagccagggcgttaccaagcatgtgtcccatcaccgggcagaagttgacgatcaacaaggcagagacgctatcctgcttccttctgttcttctcttcgttctcttgtacggaga

SEQ ID NO: 650512 - DNA, 1373 bp, Homo sapiens
gctcatcactgttcatcgcctgtcaccgtctctctccctttggcctttttcttcgctttcttcttcgtcgcttttgtctctaatccccgctgcctgtccactgtgccgctgatttccgcgcgatattcgcgctctcgttctcggcctgtagtgcttcctcgtgctgttctcccccttctgctctgtgtcctttcgtctccattcccaccacttgcttcggctcttgttcccctgctcccatcttttccccttggaccctgtgtcacgtttaacgttgtctcgtcatgctctcctgtcggcccttcttggtttttcgtccctctgtcagccctgtacggcgttgcggcgtatgcttcccctgcctctcgggtgtcctccgctctgttttctccctctcgcgtcacttctcaacccttattcgtgccggctatcttcggacaccatcctcccagggcttttatccagctctgagtctcatctgccgcattttccctacgctcatctctgagatgcccctaactgttgcgcaagttccacctggtatcctctgtactacgtccacgtcagagccaagttactttttttttgtctgctgccctctgccctatccggttgacggcagttccgtactaatccaccctgtcagtaatgtacagattgtttgctcgcgttccatattcagccttttatccccatggcaaatgaccatctgccttctctcttgactcctgtccaatcagcagaatccacatcactagttttcgttgggccactgcattagccttaaacacttagggagagccatcacctataatacctctggcttagaaattttttcatgcacactgcttggaatcgtactgcctaacttgaaacatgcaattggggaagaatcatctagaatgatttctgctatttctagtagaaacgacaatgtctcgttttccaaagataatgttatacatcctactctttgtcattctctctctgatacaagttcaatgttcagttttccttagtttttaccttgttttctctataggtcatgatttctgtgaagcaaaaagatgccttttaccatgaattcttgagtttactatcaataatattgtatattaaggggatcagaagtaggatagcgtataaaataagagatagcagaggataaaagagaaaacatttcctcttataactttgaagtgaatttgtaaaaaagatttgtagagtcaatcagtgtgtctaaattattttatcaacaaacttgaacatggaagatattcctttttaactcttgtaggtgaacttctttgaagttatttagaaatatcctctggaaccaattattttattgtctaataaatatgacttctgca

SEQ ID NO: 650513 - DNA, 115 bp, Homo sapiens
tgggagagaacgtaggtctcagaacgaattagtcagcttcagtctcgtcagcagcgctgcttggattctttgttcttccgcacttcttcaatgtgcttatccttctctctccact

SEQ ID NO: 650514 - DNA, 931 bp, Homo sapiens
  misc_feature (499)..(499): n is a, c, g, or t
atctttggtaggattctgccagatgcttttgcatcttctgttcctgggtaatggtgggtcttaatggaggctgggtggaccactgcgccgatccagatctgtcaacgaggtaggaacagaatgctcatcgcacgagttaactacactagttagacgaaaggacgagaggtcttgctcgctttctctgactcaccgtttttctcgcatggtcgcccgtgtagcgattcccacctagtccgctccctgcgtatacaacctttgtctctcgtctatagtctgtgcgccgaagctcagtcaccttttgccgcacttgcgttaagatagctgtatctaacgtatgcaactgttacagaatcgaaatgaagtgagtctaggatgaccaatgtagtaacaccagggttacctgtttcacctctgaacttctgtgcgaaagtggtattacaagtagactcgctagacgtatcccgaagtgacgaggatccaagggcgctggtcaaancatcccgcaagagtcattggccatactcgccattagccagtttctaacatcgtgtttcagggtatccgagctgtagatgttcttatccccgatatttgtgagttctttggggtagcgcacaaatactaggggtatagggtgtattttaacaaatatatcctaatggtcatatctattctcttttgtagctgctgtcttgacagataaacgaaaatcatcgtgcgcttttctatgctagaatagaatagtcaagcatccgggaactggactcacgcctttttacgccgggctcgacctgccaaataaggtctttaaaacctatcgatgggacccggggccccccagagcgtaccgtgaacacgggagcaaaagcggcccccgaggagaaacacggggcacgcgaacaaggcgagcggaacgccacaaatacac

SEQ ID NO: 650515 - DNA, 385 bp, Homo sapiens
aaggaagatgtggggtgaaagtccatacacagagtctccatcggagactgcttagtgcagctgtgataagagggtcttcgacctccagaccccagaattgtaaaggcattgacagcttgcactgcacacctggaaaagctgcagacactcaatgccaggtcacaaaagcagccaggagggaggctgtgcatcattgtgacccaaatgtgagacatgcagtcaaaggagataactttggagctttaagattggacttccttgctggattttggaattgtatggggcctttagtaaaactgctatggagaacagtttggaggttcttcaaaaaaatcaaaagtaaagctaacatttgacccacaagttccactgcaccattgtatct

SEQ ID NO: 650516 - DNA, 511 bp, Homo sapiens
tgtttacgaatgtattagtcttgtcacgttagaatggttacttcaaatggaacaccctcgatgtaaatgaataaagtatataatcaagttgttgtatttatattatttttacgaaaattcgttagactaatctcgttgtaaatataattgatgttttatatgtcattttactttgtagaacaatttatccggacatccttttgttataaaatttccttatgtaaaagtacttagatgaaagtgtaaataaacaaaataacatagaatatcaatgatattagcaacacacgaaaacaatgacgttaaaggtcctagtaacatataagagtcatacggtcactgatatatacatttccattaaatttttcataatgagggtctcatttttgtctgtttgtttattctttagagtaaaaattacccttcaacacgtattttgataacatcataaaaatatctttacagggaattagtaatattcaagtagtaatattttacatatgataacatg

SEQ ID NO: 650517 - DNA, 379 bp, Homo sapiens
ttagactatataggagaaggctggtcttgaacccctagacctcttgatccgtccgtctcgagctcccaaagtagctgggattacaggtgtgatgtcaccgtgcctggcctatgccgagtgttgaaaacagattagatctattaaggtaactgcctgagtcagcgtaacaacactaccatatacatgaatcatgtccaagtgaaattacctaaagaataatctttcatctttactatatatattgtacagagacagaagtctgagtcactagtctcccggggtggattacaacggtggaatctcggctcactgaaaactccactccctaggttcactgctattctcatgtctcagcttctcaaatagcttcaattatagg

SEQ ID NO: 650518 - DNA, 147 bp, Homo sapiens
  misc_feature (88)..(88): n is a, c, g, or t
gagtccctgtcctgcgcccgcgcgccccgggagcctacccagcacgcgctccgcgcccactggttccctccagccgccgtcgtcatcncggtaccactccggagtcgccgctgccgcggtttcatggtcctctgcgttcagggacct

SEQ ID NO: 650519 - DNA, 1516 bp, Homo sapiens
  misc_feature (12)..(12): n is a, c, g, or t
agattttcatgntaaataaaattaaaaaaaaaaaacaaaaaaaaaaaaaaaaaaaaaaaaaagggagacagacaaaaaagaaaacccaaaagggacccaaaaaaaaaagacaaacccaagaaaaactagggacacaaggaaggagccacacaaaaaggaggaacgacgaataaaacgcgcacaggcatgggccagacagataagcgaaggactagagacgggcacaccaggcaacctgcggcaacatgggcgaaggacccttatacttctcggtgggggggcgcccatctatttgggacacaactactcccatacaggagacgatttaaaagcgcttcataggggcaaaaaattataacaattatctcaaagggtgtatctaacagggggtgatcaacaataaaagcgtgccattagtccatcgagacgacacggacaaacacgaaatgggccactaaccgggggcgcatcagcgacattcttgcggaaacacataattaaacctccccacgagagaaaccatagaggacaccaacacccaccaccccgacacccacaccacgcaccagcacaaaaaagcgcacaaaaccaaacaaaaaacaacagaccaaaatggagagagggggagaggacggagagtagaaggggaagagaggcgaaggatgacccgcgcgaagggagagggcgaacggagcgagaggaagatatagagagagagagggaggcggagaaagaagagaaaagaagcgaccgagtagggacaaaaaggaagggggagagaagagaggggagagagggaaggcacaggagggaaagacagagagaggggaggcgaggccagagagaggggaggtaggaagaagaggagacgggagacggtgagaggtgacaggaggggaaagagggagagaacggcggagtgaggagcgagagaagggcgtcgaggagagaggacgggaggcgggggagggaaggaacgagcaagggagagaggaggaagacgagggggagagaggagagagggagaacgagaaagagtaaaaggataacaagaacgcgaggagcggaacgagcaggagaggaggaaaatggcgaaaaagagcaaaaaggcaaaggaagaagagaggaaagggagagagaagggagaagagagatagacgaagatgaaaaaacagcgagaggagaaagcaaacaaggtcgacaagcagaaaggaagagaggaatagcaatacggggaaagagaacgagtaaaagagagagacataggggaaagagaagaaaagaagaacagaggcaagcaagcggaagcagagaaagagaaaagaggcagagcgagaagaaggagagaaaagacagagaatagacagagaggataggatgacgagagaagaaaagagaggcagaaggagaacacgaggaagggacgaccagaaggaggcaagcaaaacgagaacaagaagcaggaaaggaaggcaagagggagatgaagagagaaggaacgcgagcagaggggaga

SEQ ID NO: 650520 - DNA, 500 bp, Homo sapiens
accttagccgatctatttgcacagtctttattccgtggctttaagagatattccaagatctgcgtataagacgatgggctgtgcctgatctgggtcctaaatgtgtcttgatgtcaagacacacctcctcggtgagttccagagcataagtccagatgctgtcagtatactgaattcactctactacaaatgatgggccaagggctaggtgggctgttatcaaattgtgttgtttacacaaatgctaacccagggtcctcgcccatcagctgccagtgccctctgctactcttcgaggctatggttaccccaagtcttttcattgcattctcacctggtgtgaaattggggctccctcgcaaacgctggtttcgctgttcaaaaaagcggaatattgtatagaacagcatgttgtcttcagtctgttttgcagcatctaaaaattttcgtgcagaaatgttgtcatggacaccaatgccccggatacacgttcgcagggg

SEQ ID NO: 650521 - DNA, 163 bp, Homo sapiens
atggaaattatgactggagatgagatactcagttatactagatacatgtattaataagggaaaaataaagaactaaaatatttacatattaaaaatcaccatgcctggcccagaatcaataattgttaatgcttcatcgagactttcttaaatgaaactggca

SEQ ID NO: 650522 - DNA, 293 bp, Homo sapiens
actttagtcacctgcgatcgatggccaggtccaggcgattgtcctggacccccagttgcattcgtaggggctcatcaccgacaggtgcaaatgcaatgcagggttgctccagtgctgtaggcgccaatacacttcggcgaacggcaaggccttgtacgctagacggtggagtcgagcactccgagcttgagggtgccgccgacaattcgcctttcaacgcagcggtgttattgcctcgaaaaccttcgagttcgcccaacaggcccgagttccctgatgaaccagctcaccct

SEQ ID NO: 650523 - DNA, 224 bp, Homo sapiens
ttaaggacatgtaaccctttacagctagtttaccaatccccttgatcctcgctagaaaaaagaggagcgtgtgaccttaggaatcaacggggctggactggatcctcgagtaaatatcttagttcgaggagaagtttataaacgctctcctgagccagtatttcaaaacttctatgataaactaaaagtgccagtaccagagattccaggaacactatgtagga

SEQ ID NO: 650524 - DNA, 168 bp, Homo sapiens
cgcacatgagatgcatggaacgttgtcaccctgctgaagatcactctggtgccctgtggggaggagccaatgccctcaccccacaatggggcaggtgggggcttggttgctgaccctggcccggagtccccacagagcaccttctgtagctccagcttgtctcccttg

SEQ ID NO: 650525 - DNA, 138 bp, Homo sapiens
aagctgacattgaggatggccagcaaagggcaggggacattctcattctgggtgatgatgggtgtgtactcctcacttccactggatccacttgatgtgatagacagactgtcccgtgaagcgttccttggaggccgc

SEQ ID NO: 650526 - DNA, 160 bp, Homo sapiens
ttgagtttctgttctgattaatataggttatttgtatttttttattgatttgtacaaaacctttgtaattttaaattttagattttattaatttatatagtgcataaagtttagaatttatgcattatataagttaataaaattagcatggccttccatg

SEQ ID NO: 650527 - DNA, 84 bp, Homo sapiens
cagaaatatgagatcaatgttctccgaaacaggatcaacgataaccagaaagtataagtgtctgagctccaagacccgcgggaa

SEQ ID NO: 650528 - DNA, 195 bp, Homo sapiens
gaacaagggacgctctcccaggacgtcgggtcttctgcttgttttgttctcgcctcgaatctctggtcggtttggcagtgtaagtctggctcgggtgaatgttgaggccttgttcccgcctggcccatggagtccaaaactacttacctggaagaccttgccaccaccccctgagtatgaatttgccccgtccaa

SEQ ID NO: 650529 - DNA, 161 bp, Homo sapiens
  misc_feature (122)..(122): n is a, c, g, or t
  misc_feature (146)..(146): n is a, c, g, or t
ggatccggttgcagtgagccgagatcgtgccattacactccagcctgggcaacaagagcgaaactccatctcaaaacaaacaaacaaacaaacaaagaacatagatcaaataatagaacctnggaagggtgtggtggttaaaaccngtattcccacaattt

SEQ ID NO: 650530 - DNA, 403 bp, Homo sapiens
tacgaaccgctatgtcaagctctggatagatagagaaatcatagaacaaacagcacacgatagtattgttgggaagctgactagatgtacacaggacaatcacttcacaactgggggtggactgactgtgtgttatgtgtgcgcagcctactagataataccatgataaaagcatgaaggcaggctatcttgcccgtcatcatttgcgagtactaacatgggttggtacacttaaccagttcccagcatctttgtggcacgttggttggcctcatcagtgctgctcttgatggcgatctgccttctgcatgactctgtgtcggtccggcgatttctgtgtgtcgatctcgttgcccatatccagggccatgtgacggaggttcccgatgcgggtcgggtggcg

SEQ ID NO: 650531 - DNA, 299 bp, Homo sapiens
gaattatgctatgacctaacacctatttacatagtatttacattatattagccattgcgagcgatctagagatgattcaaagtatatgcgaggatgtgtgcaaattgtatgtgaatcacaaccattttatacaagggccttgagtacctgttgaccttgatggggtagggggtccctccgcccaaccccctttggatcatgagggatgcctatccactcgagcacctagccacttgctgtcctatagccattgtctgtgggcccatgaccttcgatccaacgtgtcattcttggtgacc

SEQ ID NO: 650532 - DNA, 702 bp, Homo sapiens
  misc_feature (317)..(317): n is a, c, g, or t
  misc_feature (473)..(473): n is a, c, g, or t
aaataccaaaattgcatgcaggattgtgtaaagaccaatgccaggttggactgccagaataagccaacagtgcgtgatacgcttccccctgcagagagcctatgacggatatgcagtcagggaggtttcacatcaccatgattcctatcccagaaaagcagatgttcatagctctgggaatggaatgtgactcttgtggagagcctataagcgaacgcatgaggggcgcctgtttatatggataagatggggctataaatgcccttatcttgcctcggctcttctaggcctctttagggttaaagcatactcccttntgagaatttgtggtctaaccagttgtctagcttcacgtcctgtttctatggattgtttgcaaccagcttttgctgcaactgttactgctgattaatatcttgctaatcataggttatggaaagactgtgtttctgttttaaggctctgttagaaantgctgatgcacacactatattgtaaattcttatctctgtatactgtacttctgcatactgatgttatgttaaattacttcaccctcgtgaccatctcacctcataatcaaatgaccataaatccctcactaacctatccccaccctcactaaacttaataataaatgctggtatatccagtgcattggcggcatcacaggaccagaagggggaccccccggacacagct

SEQ ID NO: 650533 - DNA, 349 bp, Homo sapiens
tgtgaagactgagatttggaggggccaggcaggggcagaatgatatggtttggctgcgtccccacccaaatctcaacttggattgtatctcccagaactcccatgtgttgtgggagggacccagcggggaggtaattgactcatggggactggtcattcccaacgctattctcgtgatagtgaacaagtctcacaagatctgatgggtttatcagggggtggcgcttttgcttcttccggatcttctcttgctgccacgatgtaagaagtgccttttgcctcctgccatgattctgaggtctccccagccatgtggaattgtaagtccaattaaacctctttttcatcc

SEQ ID NO: 650534 - DNA, 231 bp, Homo sapiens
gggggggccccccccccctttttttttcccccttaaaaaccccgggggggcttcccccccccggttttttttttgggggggggggggggtactttttttccccggggacccctttttccctttgggccttttttggggccccttaaacacctttttttccaaaaaaaggggggggggcgggcggggttttcccgggttttttttcccccccgggcccccccccggggccga

SEQ ID NO: 650535 - DNA, 424 bp, Homo sapiens
tgcactatctgtttgtaccaaatggctaaacctcttgccggagcacgtacatctactcccatatcttcactctacagataatttcacataaagatttacatcctggtctctggtgatcttatcttgtcacatctgtgcctatttgcgctttagttccgtctgccgttccacctttttctgagctcgatctacatttatttgctttccattgagttcctatccgttcatctcatccactgctattctgtggcatcttcactgccctttcaaagctttcttatttcagactcctcttcggattttccacttttccatccagtcattacctttcaccaccttattgcaggcccataacttgccgatagagattccttaagtgcgctcatcattcattttcttctcccaaaattcttgattgttgact

SEQ ID NO: 650536 - DNA, 405 bp, Homo sapiens
tcaagattgtctgcgacacctaacaatggaaggtgctaaaaaacgatatggtgaaattaccgaatcaattcaagaacgtttggattttgaattgctgacaatttcgaattctggatatccaggttactttttgattgtacaggatttcattgccgaggctagaaaaatggacgtatcggttgggccaggtcgtggatcagcagcgggttctgccgttgcatattgtctcggaattacgaatattgacccaattaaatacgacttgctttttgagcgtttcctaaatcctgaccgtgtatcgatgcccgatattgatatcgactttgatgacgagggccgtggacgtgtaatggaatatgtaatcaataaatatggtcaaaaacaggtgtcgcagcattccttgca

SEQ ID NO: 650537 - DNA, 788 bp, Homo sapiens
  misc_feature (8)..(8): n is a, c, g, or t
  misc_feature (85)..(85): n is a, c, g, or t
  misc_feature (136)..(136): n is a, c, g, or t
  misc_feature (157)..(157): n is a, c, g, or t
  misc_feature (164)..(164): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (177)..(177): n is a, c, g, or t
  misc_feature (182)..(182): n is a, c, g, or t
  misc_feature (199)..(199): n is a, c, g, or t
  misc_feature (202)..(202): n is a, c, g, or t
  misc_feature (214)..(215): n is a, c, g, or t
  misc_feature (221)..(221): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (264)..(264): n is a, c, g, or t
  misc_feature (266)..(266): n is a, c, g, or t
  misc_feature (270)..(270): n is a, c, g, or t
  misc_feature (274)..(274): n is a, c, g, or t
  misc_feature (278)..(278): n is a, c, g, or t
  misc_feature (291)..(291): n is a, c, g, or t
  misc_feature (295)..(295): n is a, c, g, or t
  misc_feature (325)..(326): n is a, c, g, or t
  misc_feature (328)..(328): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (373)..(373): n is a, c, g, or t
  misc_feature (379)..(380): n is a, c, g, or t
  misc_feature (422)..(422): n is a, c, g, or t
  misc_feature (433)..(433): n is a, c, g, or t
  misc_feature (442)..(442): n is a, c, g, or t
  misc_feature (465)..(465): n is a, c, g, or t
  misc_feature (467)..(467): n is a, c, g, or t
  misc_feature (500)..(500): n is a, c, g, or t
  misc_feature (503)..(503): n is a, c, g, or t
  misc_feature (509)..(509): n is a, c, g, or t
  misc_feature (537)..(537): n is a, c, g, or t
  misc_feature (546)..(546): n is a, c, g, or t
  misc_feature (559)..(559): n is a, c, g, or t
  misc_feature (575)..(575): n is a, c, g, or t
  misc_feature (602)..(603): n is a, c, g, or t
  misc_feature (667)..(667): n is a, c, g, or t
  misc_feature (711)..(711): n is a, c, g, or t
  misc_feature (783)..(783): n is a, c, g, or t
aatgatanatgtacaaaactgtgtattagtgacgacttatgagggtgctgaagacagaggtgactgggtaccaagaagtctgtanaccaaagaggaactggaactcaaggttttaatgaggacaagaaaaaaaganaataagggctttgttattttnttttttngtaaagnananancatcnattataagatgaaatcnganttaggtagaaannaaaaanatcgaaaagttacctaagtattttaatataacnaaantntctntntttnaccnttcnaactacacaaaantgangtgatataattctaactactgtagtaaatnncnccntnttnccctttctaaaggctcactgatatggcagcccttggnccaaannttcttttcttcatgagaccaccaccataactcactgcttaanaggcgtatgangggaaattntgctccccttcccaccccacttntngaaaaccatctatatacagaggcagagtaatgnggnaactgntaggcctcaactataagggggggggggngggtccttncccatgggtttgntaacccagctgcttgnggggagggagcaaatgcgactgcttgnncaacacaagtggtgacagctgttggaggatcaggggagaggagggctctgggaagggttaaganactcatcaataaccatgccatggttccacatgagacactaatcncatcacaagggctgcaactgtcactgatatactaggtcaagaaaagatctactttccagaaacttcaaagcntgtat

SEQ ID NO: 650538 - DNA, 481 bp, Homo sapiens
gcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaagaaattgaaaattgtaaaaagatgaaaagaaaagttttgagcattatttgcatcattgggatacataggtcacttcacaagatggtcaagttgaaggaaataccacgcagtgtctaggtcctgttgtctgtagggtgcggcagtttttcatatggggttgagcctcctaaatcgtggagtcagggcaagaaaggagtagtgactggtgattcattgttgtagtggttgggaatctgtattgtagagttggggataattaaaagc

SEQ ID NO: 650539 - DNA, 100 bp, Homo sapiens
tgggggggggggggggggttttttatttttgggggggggaaggtttttttattaaaaaagaggggggggggtttaaaaaaatgtttttgaaaaaaagttt

SEQ ID NO: 650540 - DNA, 1173 bp, Homo sapiens
ggacagtgctgacactacaaggctcggagctccgggcactcaggacagtcagtgagtgagggccttgcgacccctcggaatttaattctcttacttcaatgctcttaataattatactcatcttcaaacaattgttgtatgcaatatggttgctaccgagagacgaatcttgctggcatcgttacgatgaagagattcgagataagtctatagtcacaaacatacactgtgggctattgccaagatttccatgatctactatagtcagaaccggaagtaggacaagggatctcatcaagtctatttgggagaggaacgatcgataactagtcagacgtttcgtaaccaatcggaagatcactccagataggttctaaacaagcgtgaattatagagccaagaatcccgagaacttcacgttgatcacactgcctgtagtgatatcattcagaagaggcgaacatagtgcataggagcgatctgaactacgttatggaagaatctcaggaaaaaatgttaggaaggaagatttatgaagatagtgtagagtcgaatggaatttattaatcatgaatgagctgccaagttattacgataagtatggtcaggacacagtatgatttgcattccaaaatgaatctaagaaagattccgttggaacctagagagagcagatagggtatgccctcagactttgcacatgcacaggtggccatggaaactcatatggcgaaaggacgacgggttggcgaagtccctatggatagtcaccgtggggcaacaggattgtgtccaaagaccagtgtggcaaataaagggaggcttaaagcagaagcgggcgttaaactattaattgaaacccgtctggaacagcttaaaccagacatctttcttaggtctacgtgtgcacacatcgattggggtctcggcaccactggcgactggggacctcggtcggtttccaagaaaagaacgaacttgggatggggccagtgggtcggcatttctccgacgaaaacaaaacgtggggaattcccacttatcaaaacgcaaagggatttggggaccccattctggtgctccctacggtggccccacacacaacaattccgggcctggggaaacctgacagaagcatcccttggaaagaggcacaccagggcggggcatccc

SEQ ID NO: 650541 - DNA, 767 bp, Homo sapiens
gcacatgtacttttctctgcgcgtgtgcgtggactcctcctccccgtcctcagggctccagggacaccatggcgctattgacgcgtgcagcaagctgtccgtgctggcattgattaggtcctttagcacgccggcgtgcagcagctaccatggtctcgtgtgagccggacgaaaccgcgcacagtcggtgttatggccaatgggcgacttcgtcacggcgacttcaggcgaagcgaggcgctggctgctaagccgagcaaaggagcaacttcgaaatgttacgttgcacgattcctcggattccagtgagaaggcaaccggctaaagattgcacccgaaatgtagctttccttgagctagcggtaggatgttgggatgagtcgggactttgaaattgatcgccgcgcatatcagtagcctaggctctgtgacgttggggaggtggagtccgtcacagaggcaatagtcgcactcagaagtcatcctttatggatgaattaaccatggcagggtggccaaaggcactttcaaaaacacatcaaattgtgtgatttccacccccaatggctgaaccagacgggccatcacacggccgtgggaccatccgctccggaaactgggcccgtgggcctctgggtggcgaacttgcgggataacgggtccatggattcacgcgtgcgcgaaccaacacaaggccaaggggacggggaattaggcccttacctcccggggaaccaagaagttgggacttggttggcgacgaacat

SEQ ID NO: 650542 - DNA, 2418 bp, Homo sapiens
cagagacagagagggctgttacattgtaataaaagtgtcaaacaaccgagaagacaacaatcctaaatgtgtatgcagaaaataacacagctgccaaaatacatgaaggaaaaactgtcataactaaaaggaaaaagacaaatctacaattacagttgcagacttcagcacgcctccctctcttactgataggtagaacaactagacagaaatagcaaagaggtagaactcagcaacaccatcaaccaacagatctaatgaacattgctaaagtgcttcacccaacagcagcagaatacacatccttttcaagtatccattaaatatatacgaggatagaccatatgctctggaccataagacctcaaaaaatttaaaatcatggaatgtgtgatttttttcaacaacagtggaatcagattagcagacaggaatatcacaaaacacttgggaaataacacttctaaatgatccatgggtcaaagaggaagtctcaagggaaattttaaaaatattttgaacttaatgaaaagtaaaacataacgaatttttttgaggcacaactaaagcaataccgagagggaaactcacagtattaaatgcttatactaaaagacaggaaaagggccaaatcagaaatctaagcttccacctaacctgaaaaaagaagagcaaaagaaacccaaagcaagcggaaggaaggacataataaagaaaagccgagaaatcagtaacattgaacatgagaaaacagtagaggaagtcaacaaaacaaagggctggctctttgaaaagacaataaaattgacaaatagcaagactgacagagaaaaagggaaggcaaaaatttccagtatcaggaatgaaaaggatataactatagatcttgcagatatcaaagggatcacaacaaacaactctgcacatataaatttgacaacttagataaaacgaaccaattctttgaaaagaactcaataggaattagataatttgaatagtcctgtaactgttaaggtaattacatttataatttaaaacctcttgaaaggaaatctccaaatcttgattgtttcactggatacttgtatcaaacattcgaagaacagtgaacaccaggtctgtacaatttcttttcaaaaaaaaagaaaggaagaggaggaaacccatagtcctgtgacactattcttacctgatattaaaccaagacagttcttaaaaaaaacagtatcccttatatgtgtagttggtaaaattctttccaaaatattagcaaatggaattaagcaatttataaaaagaattatatattgtgactaggattgatttccgggattcaagactggtcagtattttaaaaatcaatgagtataatcttccatattaacgagccaaaaaagaaaattcatatgatcatatcgatttagaaaaggtgcttaataaaattcaaaattcacttataataactcagattactaggaatagagggaaatttcctcaacttgattaaaaaacgtatctaaaatatctatagctaacatcatacttcattgtgagagactgctttcttcctagggaatggcacgcttgtctaggcaaggatgtctgctcctaccactccttttcagcatagtcctagaagtcctagccaacacagtaaggtaagaagaggaaatgaaaagcactactaaaggaagaaataaaattgtctgtatttttaggtgatatgattatctatgtagaaaatcccttgtacaaaaaaaaaaaaaaaaaaacaacacctgaactaatacgtgagtttagcaaggtagcaggataaaaataacataaaaaataaattgtatttcaagatactaacaatgaacatgtagaaagtgaagtttaaaatacaataccatttataattttgcaaaaagaaaaaagatggaaatccaacaaaaaatgtactggacctatgtgttcaaaactacaaaactttgaaaagattatgttaaataagctaggaccagaaagacagatattacatgttctcatttacatgtgggaactaaaaataaagctgatctcatgaaggtagagagtagaatggtagttaccagaggctgggaacagtgtgtttgagagaggcggggataaagacaggttggttaataggtacaaacatacagttagatagaatcagtaagttctagtgtttgagagcagattagagtgactatagttaacaatatattgtgtatttcaaaatagctagaatagaagattttaaatgttcccaatacaaagaaatggtaaatgttcaaggtgatggatatcctaaataacataaaaaataaattgtatttcaagatactaacaatgaacatgtagaaagtgaagtttaaaatacaataccatttataattttgcaaaaaaaaa

SEQ ID NO: 650543 - DNA, 94 bp, Homo sapiens
ggcacgagggttgaagagttacagaaacatagggctggcaattccatgcttattcctagcatgtgagggacaatggaaacaagcgtgattatga

SEQ ID NO: 650544 - DNA, 179 bp, Homo sapiens
tatgactcgagcgattcgaatctcgattggagcctgaacgagagcagtgccttctgaggttgccagtctgctggtccatgtaggccacgctgtacttgcagtggtacggtgatgttctgggaggcctcgtgtggacatcaggcgcagtgaaggtcagtctggattgccacattcggcag

SEQ ID NO: 650545 - DNA, 884 bp, Homo sapiens
  misc_feature (658)..(658): n is a, c, g, or t
  misc_feature (766)..(767): n is a, c, g, or t
  misc_feature (770)..(770): n is a, c, g, or t
  misc_feature (772)..(772): n is a, c, g, or t
gatgcgcgggggccatattagcagcggttattcggtgagcggtggtggtttattcttccgcggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctatgggacatgcaggcacctgtttgggaattttagcaaatgatggtgttctgcttgcaggcagagagacgcaacaatccacaagcttcttgatgaagtctttttttctggaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaacacaagcttatacacaatttggaggaaaacgtccctttggtgttcattgctgtacattggctgggataagcactatggttacagctctatcagagtgaccctagtggaattacgggggatggaaggcaattgcttgtgaaatataggtgagtggtgtcatgttgaacanactataaagagagggaaatgactgaagtcagattggttagtatcacgttataataacgacatggtgtagaattctgtgaaaggtgattgcctacaggagatgcagagnntcngntcacaaagtgggggttccaacggagaagcacgggtggaaaaaaaaaaaagggggggggaataatggggggataaattgcatggtttcaaagagcgattttattgcagcgcgc

SEQ ID NO: 650546 - DNA, 507 bp, Homo sapiens
tatgactatctcgccttaggacaatatctagtggagaaggagacttaaaggtatgcgggtgctatgatagaccttgctagtatgagagatagatgtccaacttcattgttttggttggtggctatccagttgtaccaataccatttgtggaaaagactattcttttcccaatgaactgtcaatgaatataaaggtgagggttgatatttatcccctcaattatattctgtagatctgtatgtttagccttagctactatgcccccaagtcttgattaatgtagctttataacaacttttgaaatcagtaagtgtgagtcttccaactttcttctctttggggatggtttaggctgtagccttgcatttccgtatcaatttcagggtcaggttgatctgtttctgcattaaaaacaccacggatatggacagggatcgcatagaatctgtagatgaagtgggggagtatagtcatcttaccaatattaagttttcaacctatgagctc

SEQ ID NO: 650547 - DNA, 844 bp, Homo sapiens
  misc_feature (618)..(618): n is a, c, g, or t
  misc_feature (726)..(727): n is a, c, g, or t
  misc_feature (730)..(730): n is a, c, g, or t
  misc_feature (732)..(732): n is a, c, g, or t
gatgcgcgggggccatattagcagcggttattcggtgagcggtggtggtttattcttccgcggagttaagggctccgtggacatctcaggtcttcagggtcttccatctggaactatataaagttcagaaaacatgaaggtcgcttataccaagttgaatatgccatggaagctatgggacatgcaggcacctgtttgggaattttagcaaatgatggtgttctgcttgcaggcagagagacgcaacaatccacaagcttcttgatgaagtctttttttctggaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaacacaagcttatacacaatttggaggaaaacgtccctttggtgttcattgctgtacattggctgggataagcactatggttacagctctatcagagtgaccctagtggaattacgggggatggaaggcaattgcttgtgaaatataggtgagtggtgtcatgttgaacanactataaagagagggaaatgactgaagtcagattggttagtatcacgttataataacgacatggtgtagaattctgtgaaaggtgattgcctacaggagatgcagagnntcngntcacaaagtgggggttccaacggagaagcacgggtggaaaaaaaaaaaagggggggggaataatggggggataaattgcatggtttcaaagagcgattttattgcagcgcgc

SEQ ID NO: 650548 - DNA, 808 bp, Homo sapiens
  misc_feature (582)..(582): n is a, c, g, or t
  misc_feature (690)..(691): n is a, c, g, or t
  misc_feature (694)..(694): n is a, c, g, or t
  misc_feature (696)..(696): n is a, c, g, or t
gatgcgcgggggccatattagcagcggttattcggaactatataaagttcagaaaacatgtctcgaagatatgactccaggaccactatattttctccagaaggtcgcttataccaagttgaatatgccatggaagctatgggacatgcaggcacctgtttgggaattttagcaaatgatggtgttctgcttgcaggcagagagacgcaacaatccacaagcttcttgatgaagtctttttttctggaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaacacaagcttatacacaatttggaggaaaacgtccctttggtgttcattgctgtacattggctgggataagcactatggttacagctctatcagagtgaccctagtggaattacgggggatggaaggcaattgcttgtgaaatataggtgagtggtgtcatgttgaacanactataaagagagggaaatgactgaagtcagattggttagtatcacgttataataacgacatggtgtagaattctgtgaaaggtgattgcctacaggagatgcagagnntcngntcacaaagtgggggttccaacggagaagcacgggtggaaaaaaaaaaaagggggggggaataatggggggataaattgcatggtttcaaagagcgattttattgcagcgcgc

SEQ ID NO: 650549 - DNA, 715 bp, Homo sapiens
  misc_feature (489)..(489): n is a, c, g, or t
  misc_feature (597)..(598): n is a, c, g, or t
  misc_feature (601)..(601): n is a, c, g, or t
  misc_feature (603)..(603): n is a, c, g, or t
gatgcgcgggggccatattagcagcggttattcggtgagcggtggtggtttattcttccgcggagttaagggctccgtggacatctcaggtcttcagggtcttccatctggaactatataaagttcagaaaacatgtctcgaagatatgactccaggaccactatattttctccagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaacacaagcttatacacaatttggaggaaaacgtccctttggtgttcattgctgtacattggctgggataagcactatggttacagctctatcagagtgaccctagtggaattacgggggatggaaggcaattgcttgtgaaatataggtgagtggtgtcatgttgaacanactataaagagagggaaatgactgaagtcagattggttagtatcacgttataataacgacatggtgtagaattctgtgaaaggtgattgcctacaggagatgcagagnntcngntcacaaagtgggggttccaacggagaagcacgggtggaaaaaaaaaaaagggggggggaataatggggggataaattgcatggtttcaaagagcgattttattgcagcgcgc

SEQ ID NO: 650550 - DNA, 1359 bp, Homo sapiens
cccctaataaaagttacttaaccactcactcatcgacctccgcgcaacccgatccaaacatactccgcatgatgaaacttcggctcactccttggcgcctgcctgatcctccaaatcaccacaggacatatatccatagaccatgcactactcaccagaacgcctcaaccgacttttcatcaatcgcccacatcactcgagacgctaaattatggctgaaatcatccgctaccttcaacgccaactggcgacatccatattcttatatctgacctcattcctacacatcgaagcgaggcctatataacggatccatctctctactcagacacctgaaacatcggcattatcctcctgctagcaacatatacaccacagccttcataggctatagtcctcccgtgaggccaaatatcattcatgcagggagccacagtacattaacacaacacttaactataccgccataccccatcacattgaggacacgacctagttccactgacatctgacggaggcatactcaggtagaccagaacccacagcacaacacgacgcagcctagaaccataacagctaacactactatgccacagtgccctacactagccagccccatagcacagaacgacgcaactcactcatgcatgcaacgacacacggggatccaaaaccaaaacacaccatagcgaaagtcgaacactgccacaaatgccgcgacaatacacaaagttccaaccgtgacccaacacccactaatagcaaccacaccacagataacgagagaacagaacaccacaacgcgagatataccaaacacacaagacgagaatccacgcgccagaaaaacgaacccgcatcacacgacccggctagaacaacaaagcccagcaaacacctacactaagagaccgaaacagccagaccaaacgaagctaagtatcgcccgcgacagcggaccaaggcacgcgcggatagaaacaagccgacgcccgacacaccccgaagaagagacaaaggaccgcgagcgaactgaagacaataagcgcagcacagacagaggcacacagagaacgcaccatagcgccgcggaaccagcgtgacggcaacaacgacacaccgaaagcgacaggcaggcagacgaggaccacgacgacgagagcagaaaaggcaatgcaaacaacgacggcacctcgcgagcaagcgcaccgcacaaagacaactacgagaagcaggcagcacggccgacgcccaaggagactccgacagacccgcgcgacacgaaacgaggcaccacagaactacggggccacacagagagcgacgagacggacacaccatgacacgccggacacgaga

SEQ ID NO: 650551 - DNA, 197 bp, Homo sapiens
caatcaggtatactcgcgggaccagatacataccggcagtctaccttcactggctcatctcttacaggaaaggtaacccatactagcaggacgtatgttataggctgacaagatcattatataagatacccagtcagtagtcgagaacaggtgctcaataaatggtaggatggggagtgtaggagacagtagggaga

SEQ ID NO: 650552 - DNA, 224 bp, Homo sapiens
ggtcgaccataacacttgctcttgcctttccccagaactatgaatccctgaatagtgacggattattggcatggcgaagagcgacgacgtagcaacaccacccgcaggcaagggcaagcttaagcttatcctgctgattgtcctggccttgttcctggcgatcggcctgtccgtgggggctacctggtacttcatgcacagcgcccagagcaaaccggccgcga

SEQ ID NO: 650553 - DNA, 386 bp, Homo sapiens
cgtcgacttcttctttgagcttatcactacttacccagtgtccacattatgttatgtttctccttcccctgtctttagacatgcgatgagaacagaggtcttgactgttctctgcatagctaaaacagtagccaagaatgagtaagcacttaataaatattgattgagtgagcgagcccatgcctgacaaagacagcagtatactagacggcaactgtggaaatcccctagctacatctagcttttgccaggctctgttccccctcccattcccagaactaatattactggctatctaacttggtctccctataaccagcaccaattgtcccagtagtcccttctatttttcactttaaagctagagccacatggctggtcgacgc

SEQ ID NO: 650554 - DNA, 810 bp, Homo sapiens
  misc_feature (623)..(623): n is a, c, g, or t
tctggagtgtacgcgtgtggctcggcaggtggtggacgggcgggactgctgaacggggagcttggtcgctgacgttgattctacgtctgttttggtcatggattagaatgggaggagtggtccgcgggataagtaggggagtagcggaggattggaatgaagcaaaagactgacagcctccaactgctgcagaagcctcgcacccattattcatcgtatgcaatgtaatcagcccctctccatggtccctagccaggcatccggcagtgaatcctaataatcttcatcaacacctagtggaaaaacccgggtagtgttctgtgctccctccaagcaagcgccacagccctggttggatgtgtgttcctgttgtaccccgagttagacagcaaagcgctcactaggcctaccagggtcagtggcggctagattgctgctcccgcagtggcagtacaggactagcagtgtgtcggcggatctccgaggtcccttgcgtgatgtgtgggaaagacaggaggaatagggagccagaatctgttgtgtataagtccatatgtgctctatgagttatcctgataacgctctcttgtgtgagagtatacattgaagtgtgacaaagacanacggcctaaattaacagagtgtagaacggatgtaatgcgagttataacagatcttcaaatataaccttccctgtaggcgcaaaagtcattacaaagggtgtgcgagaccattatttgggtatgagggattgtaattctttataaggggtaccacccctccgtgccgtgtgccttttattatggctcc

SEQ ID NO: 650555 - DNA, 348 bp, Homo sapiens
gctggcttcaaatataatccataggggttgggcaggttgtatacaccatcacgagtgaaacgaccactggagatggtgactgatagggaacgaggataagggaagggagagccactgacgactggcactgtagtgaggagcaccgccacctctcctcctccacttgcccctcctgtggcactggacgagctagtgggcttttcgttgtcccatgggctttttcggtggggatgtgacctgctttgaacccgtccccttttacatgctcctcctgcacggaagtatacaggggctggggtatacactctctccccacttaccagccttgccccagcgcgggggtaccga

SEQ ID NO: 650556 - DNA, 306 bp, Homo sapiens
acacaggcagaggctaacaatgcctataaggatgaaaggagttcggcaatgttaggtgagcttttgtgtgcacgtgtgctagattagttttaagagctacaacataatggcaacctcatgtattacatttcataatccttacaactaggctggcttaaatttcacaatgcaatggggagtgattcataggttttgctgcagcgttaggcactctcattatctgcattatctgacgcatgtggaacgtccttcttaggagtcctcactgtccacatgacatcttttacctattccttttgggcgtga

SEQ ID NO: 650557 - DNA, 803 bp, Homo sapiens
ggtttacagtttcagacttgatgagaatggataagattgtattgcgcataaggtgtgttgtcaaagtcaaagctactactgccttgcaagtttctgcacctgcttcgttattcacctcccttcaattggagaacgtttgcccacttggagaaggcagaatatagcacttaatttggagaagactagaagctcaagctgccggcgtgtcattgcgcggatcatattctgctaaagcaaagccttctgtgttggcattgtctatcattgcgttagagatccaagcacagcaagtgtgtagagttaacagaaggaatagaatgtcttcagaaacattccaagataaatggccagagatctgaccttctgtcaagagcttgatccaaatgtttaactgaaatattcatcaaataagttgttccaaaccaaatgttcagacagttgcacatggattgtttctgggcgtactgacgggaattgaagcatagctactacagaataactcaccttccaacaattcctgagatggtcccttaactggattattacagcaccaaaaaattctctgaagcctttctccacaatgcttgttcctaatgggattccataatgttacaatggattgaagctatgaagcctcataagatcacgagataagcatgactggtctccagagttggggaaaactgcctaagtattatgcctgtagtcgggcaatcatgttaaggatttgaagtcctcttgttgaagcctttcgaatcaagggttaaaagacaaaatgtggagatgctaatgccaaggctgga

SEQ ID NO: 650558 - DNA, 107 bp, Homo sapiens
agcgggtgggcaagttgggggagctgccttgtcctgcacttcagcagctacagggcttgtgaaggagggcctagagtgatcagtgcttaggcttgagctgcccttgg

SEQ ID NO: 650559 - DNA, 175 bp, Homo sapiens
  misc_feature (14)..(14): n is a, c, g, or t
  misc_feature (61)..(61): n is a, c, g, or t
  misc_feature (93)..(93): n is a, c, g, or t
  misc_feature (135)..(135): n is a, c, g, or t
  misc_feature (140)..(140): n is a, c, g, or t
ttggactcgaaatnagaagagcctaccatttcaaatgcaatcacttttggacatgcttttncagacagtccttaatgctgaaaacacagagantgggtaattcaagaggccttttttttaaaatagacttttgtnacccnctaattgtaaggtattgcaaggtcactttgcgtgt

SEQ ID NO: 650560 - DNA, 853 bp, Homo sapiens
agcacgagcctggtgctttctatcagggagggatcacaccggcgtcactgctgagaccggccaggctagacacatgcttgggctctgctggtgcatcataccttgtcactgggtaaacagtttgcccacttaccgcagggatgaaggctgcttgccatgggctctccgtgctctgatgaggtttgtggtatgtgcaggcagtcctttccatcgaggtgctggttggcgtgtgccaggggcatgtgtggggcccgcggcgagtggtgcatgccgctccccgtccaggtggtggcttgtcgcccatggctgattcctcccaccctgctggagccctggcattactgggagggactcagtgcgcgcggatgcattgccatcggtgtgtcggcaactgtccagcgggggggagccatcctgaataatgatcgacgtgaggcaggcgccattcagtcaagcaacccggcagttgcaaacaagagcagaaccggggaagcgctgatgtggccgccctggctcgtgtctgagctgcagccgacttccttgtcttcccatgtgcatcggtgaggtggcgcatgtcagcgcggatatcacctacacctccaagcaactctgtggaggtgcaggtcaacgtgatgtccgaaaacatcctcacaggtgcccaaaaagggtgacaataaggcaccctgtggtatggtgtcccctgtcgctgtaagaatgtggacccagtcctcgaggtggctccctgtgtgtgttttccccggcagagcacgaggactgaaggccgcaaacggtaatgaagccaaaactggagagctgtttggacactggggaaggcgatcctccccctctcaac

SEQ ID NO: 650561 - DNA, 412 bp, Homo sapiens
gatgtcctagtggcgcggtcccggttggaggcgccggaggtactcatcttgttgggttgtagcgatatattcctaccgcacgaactttgaagtgcgtagtgtggacgggttccagtgttaccatgcagtttgagcatgcggtcacgttcgtgtcttgcatcagcatgggctagcgccgttcttaaggggacggcgcgttgtcctccgttgccctcgggcgatcagacatggagtctggttcagatccccgatatcgtactgtcgaatattgctgccgggatgcgtgctttgcggtgacgcggagcgattcccggataatccgtcgggagcccgtgggcggagttctcttttctttgtgaagggcagggcgccctggaatgggttcgccccgagagagggggtttgtgggtga

SEQ ID NO: 650562 - DNA, 634 bp, Homo sapiens
cgcttgcgaggcgggctgcggctcggctcgcggggactgtgcacgaggttggagagccgccccgccgggccccagatcaggccgcagagatcgggacccgcgggagccactatggcgcacgggccacgagagaagcagccgggctcagagggtcccagttatgccaaaaaagttgcgctctggcttgctgggctgcttggagctggctggcactgtgagcgtcgcccttatattctttttggaaaccaacccggttggaccgaccactgggtgccaagattcctgatgaggtcgacaatgatccaattctggtacagcagttgccgccggacatacagaattatttccacaacgattataggaccagatgactcatcgagcccaccagccccttgccttctcccaagaccctctgcaggaacccgttacataccagccaccctacacgctcgtctgggagcctcaccggcgtccctcttgcatcctgagttggtcggctggccacgtggctggaggtcaagaagggcccaggcatcgagaccttgtcccagcagtttgcccctttatatgaaatgtcatctttacgtcagagacttgccatgattgcgttccactcattgatagtgtggacccc

SEQ ID NO: 650563 - DNA, 111 bp, Homo sapiens
agaatcaaactatattttcttttctgtttttttgaaacagagtctccattctgtcatccaggctggagtacagtggtgtgatctcagctcaacatacatagaaaatatctg

SEQ ID NO: 650564 - DNA, 656 bp, Homo sapiens
cccgtaacacaccatgagcgttccgggggtccccatgttacatgtaagacagaacttgccacattgtgggttatttacatttgaaagcaaatacacctaataatatacttattatgagccagatgataataagatacttattaagcaggatcatattatacgctagatgaagctcatgaacacgtcataggatcataggcatagaggattagctgacaatgcacatgctagggtagtggactcaagagtatgaataatcccatacaaggtcagtgaccatttaaggtgtagatgagtcagtagatgcaaccgcatgtatgactaaacagtcaatggagatggacgatcatgtatccaatccaaggtcaggatgtcaggtgtctagtgcccttgcaggtatagctgacgatagtcattccagagctatgggcatgcccaggaggcaggtgggctcatggtccgtgtgactgtgcagaagcagtaggcagcctcgtaggtatccagggtagcagtcttctcatgagtctccgtgagatcgggcaggcccataatacccagggatgccatgcacacccctcctgccatccagcacaggctctcctttgcaccgtagtcatggaggacctctcattcgagggagccccatggctccatat

SEQ ID NO: 650565 - DNA, 1060 bp, Homo sapiens
cccacgcgtccgcgcgccagctgagcggcggtcgggcggggggagcgcggcggcccaagctcgcttggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650566 - DNA, 1165 bp, Homo sapiens
cccacgcgtccgcgcgccagctgagcggcggtcgggcggggggagcgcggcggcccaagctcgcttggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcagcaaacttttaagaactgtgagcagaggccagtaattttggagacaggacctcggcctgaaagtgatagatgtctttgttgttactgagtgtgggccaggtgtaaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650567 - DNA, 148 bp, Homo sapiens
  misc_feature (110)..(111): n is a, c, g, or t
aacacaggtgtcgtgaaaactacccctaaaaggccaaaattgggaaaggaaaggactcatatcaacattgtcgtcattggacacgtagattcgggcagtcaccactactnnaccattgaaaatttgagaggaggctgctgagatgggt

SEQ ID NO: 650568 - DNA, 270 bp, Homo sapiens
cctggacctgtggaccctggttgtaaaaagtaaattgtattttaggaaaccagtgtcccctttttttccccttttaattttatattatttgggtcatacatttcctgtaacggaagtgttaatttttctggactttttgggaccctttgggaatttaatgtattgtaaggtattttacacgtgtcctgattttgccccaacctggatattgaagctatccaagctttttaaataaaatttaaaaaccccccagcctgggggagtgtggga

SEQ ID NO: 650569 - DNA, 1109 bp, Homo sapiens
gagtgtgtgtcttggggccgaatctgggctgtggggtggtcggtgtgcttgtgaccctgcctttgtgtggctgtcaccggtgggactggcggggagctgtgttagagacggggtttcaccgtgttaggccagtgatggcctcgatctcctggacctcgtgatccgccgcctcggcctcccaaagggctgaattacaggcgtgagccatcgcggctggccactgaggagtaacttactagcgtgtgtccaaattccaaaagcttttttcccaagagcatgagaagagatgtcacgagatgtcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650570 - DNA, 150 bp, Homo sapiens
ggtcagtcacggtgctcacgtgtccgacggaatcttgtacagcgcaggcatagcaccgcagtggtgaatacacgtacgaccaggctaccatctattagcgatatatggaggtacagcagcggtagctacacgtgtctgacgcgaactatg

SEQ ID NO: 650571 - DNA, 973 bp, Homo sapiens
cccacgcgtccgcgcgccagctgagcggcggtcgggcggggggagcgcggcggcccaagctcgcttggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650572 - DNA, 741 bp, Homo sapiens
gctgcaggattcggcacgagagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650573 - DNA, 264 bp, Homo sapiens
aaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatatttagatatgcaaagcaatgcagataccaaaatatgctttccatatctaaattttcccataaagtaataaagtaaaatggttgcagagtga

SEQ ID NO: 650574 - DNA, 908 bp, Homo sapiens
gagtgtgtgtcttggggccgaatctgggctgtggggtggtcggtgtgcttgtgaccctgcctttgtgtggctgtcaccggtgggactggcggggagctgtaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650575 - DNA, 1006 bp, Homo sapiens
cccacgcgtccgcgcgccagctgagcggcggtcgggcggggggagcgcggcggcccaagctcgcttggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcaggggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650576 - DNA, 679 bp, Homo sapiens
  misc_feature (30)..(30): n is a, c, g, or t
  misc_feature (320)..(320): n is a, c, g, or t
  misc_feature (331)..(331): n is a, c, g, or t
  misc_feature (338)..(338): n is a, c, g, or t
  misc_feature (352)..(352): n is a, c, g, or t
ggaggccatgtgacagagatgagggcgaanggcttgagagggctacactgtgggggccttggagtgttggaagccccacttggggccttggcagggacctgtaccaagacagttgaggtcctgcagcaagctggggtgaggagacggagactcccaggcactggtaaagcgcacaaggggcctctggcacccctacaagaggaggttggagtcacctgacgctgtcctgatgcggctcctgcagagaagactccttacttagcccacagtgcttctacccgccctgacaccgtcctgatggggtcctgcagagaagcctncttacttagcntacagtntttccacacgcccngacaccgtcctgatggggtcctgcagagaagcctccttacttagcctacagtgtttccacacgccctgacaccgtcctgatggggtcctgcagagaagcctcattaattagcttacagtgtttccacacgccctgacaccgtcctgatggggtcctgcagagaagcctccttagcccacagtgcttctacccaccctcaatgtataacttcacgttcagaaatgtgttacccccctcctcagacctcacacaattcacgaatttccaaacagcaggaaacagaaacttctaagaaagcagaacccttgagtccaggtgggagaaggt

SEQ ID NO: 650577 - DNA, 393 bp, Homo sapiens
ctagcatgcactgtaggcagtcccagctactcaggaggctgaagtgggaggatagcgtgagcctgagagatcaaggcttaaatgagctatgattgtgccactacactccagcctgggcaacagagggagacttgtctctggaaaaaacaacaacaacggacaaatccatagattagatagacagtggtattcccaaggtgaacactaataaaaagcatgtaattaaccaatattgtatggtaaagagaggcagaggagcagagaggaagacaatgtacacaaattttatcatttcttagtatcatcaaaagaaagaaggtatagtgcattgagtaaagttacaaagattgccaatagaatatacaaagctttgtaaatatcataagaaataaa

SEQ ID NO: 650578 - DNA, 979 bp, Homo sapiens
cccacgcgtccgcgcgccagctgagcggcggtcgggcggggggagcgcggcggcccaagctcgcttggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctgttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatgggtagacaggctagaaagtttgggtcagagtgaactgggttcaagacttaccttggattgtcaaaatcttatgtggaacctcataaaattcggacatacctgtaacattatggatggggttgatcagagtgcgctttcaactgaagcttaagaggacaagctgatcctaatgccggagagctatctgaaacaggaggaatttccctgtgccgagggcagaggcaacttgc

SEQ ID NO: 650579 - DNA, 357 bp, Homo sapiens
catacttgtaactgtttacataattatttatgaccatttttaatacctgtcttcagagtagtctataagctccatgagtacacagatcatgtttgctttattgagctctttctactaatatccagtgcagtgcctggcacatatagatgtttaacatttattgagtaaatgatttaggtttattctttataaatatagaaaataccttaaaaatatatacagctgacttatcatctaaaatacaaatagaatcttaatcctcagcccttactatcttttaattgccctcattccaaaagcctaaaagctaactccttagtctggcatagaaaaccttaactgcctttctaatgtcac

SEQ ID NO: 650580 - DNA, 390 bp, Homo sapiens
  misc_feature (303)..(303): n is a, c, g, or t
  misc_feature (330)..(330): n is a, c, g, or t
cggcgtttcatcagccagcgaagcagttgtgcggcgtcagcagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcctagcatccggctcatcccggcgacgccgatcgctgacaacaggccgccaatagtggttgggatcagacagaccagcagcgccaccagtaccgttacgctgactgcattaccgncccacgcggaaaacggccacagcgtgngggttgccagtaaaaagacggtagtcagggcaatcagcagaatggtcagggcatttcgtt

SEQ ID NO: 650581 - DNA, 209 bp, Homo sapiens
ggaggacatcagtggcacagtcgagctataaaaagaaagagagagagaaaatgtactcttcctcacatctggcacccgaacgagctgtagctccatctaatccccaaagcaagacaagctagctcgcttcccagactttaggcattccgttccacagtctctttcctcgattgtgcctgtggacaccctagaccgacgatccctccttg

SEQ ID NO: 650582 - DNA, 234 bp, Homo sapiens
gctgccccaaagggccccccccagggaaatgtttagtgtttagtggattccggccccaggaaaaagtgccttggggccgtggggcagcccccgaagtcaaaaaagatttttttttttccccagataccttttttttcccctgacccttttacaggatttgtttttttcccctccccttccccgggtgttttggggtaaacttttaagtaaaataaaaactgggtttgggcctca

SEQ ID NO: 650583 - DNA, 829 bp, Homo sapiens
  misc_feature (5)..(5): n is a, c, g, or t
  misc_feature (11)..(11): n is a, c, g, or t
  misc_feature (34)..(34): n is a, c, g, or t
  misc_feature (44)..(44): n is a, c, g, or t
  misc_feature (56)..(56): n is a, c, g, or t
  misc_feature (70)..(70): n is a, c, g, or t
  misc_feature (81)..(81): n is a, c, g, or t
  misc_feature (84)..(84): n is a, c, g, or t
  misc_feature (146)..(147): n is a, c, g, or t
  misc_feature (160)..(160): n is a, c, g, or t
  misc_feature (223)..(223): n is a, c, g, or t
  misc_feature (227)..(227): n is a, c, g, or t
  misc_feature (252)..(252): n is a, c, g, or t
  misc_feature (260)..(260): n is a, c, g, or t
  misc_feature (328)..(328): n is a, c, g, or t
  misc_feature (347)..(347): n is a, c, g, or t
  misc_feature (355)..(355): n is a, c, g, or t
  misc_feature (361)..(361): n is a, c, g, or t
  misc_feature (388)..(388): n is a, c, g, or t
  misc_feature (395)..(395): n is a, c, g, or t
  misc_feature (433)..(433): n is a, c, g, or t
  misc_feature (453)..(453): n is a, c, g, or t
  misc_feature (456)..(457): n is a, c, g, or t
  misc_feature (459)..(460): n is a, c, g, or t
  misc_feature (462)..(462): n is a, c, g, or t
  misc_feature (472)..(472): n is a, c, g, or t
  misc_feature (501)..(502): n is a, c, g, or t
  misc_feature (521)..(521): n is a, c, g, or t
  misc_feature (544)..(544): n is a, c, g, or t
  misc_feature (550)..(550): n is a, c, g, or t
  misc_feature (572)..(572): n is a, c, g, or t
  misc_feature (594)..(594): n is a, c, g, or t
  misc_feature (602)..(602): n is a, c, g, or t
  misc_feature (673)..(673): n is a, c, g, or t
  misc_feature (815)..(815): n is a, c, g, or t
gccgngatggngccccgaaccctcctcctgctantctcgggggncctggccctganccaggacgctgggngggcgtcccantcnagtggtaggctatttctactacctccagtgtgcctcgcgtcctctgcgccgcggggtaggcnncgcgttcatcgcnagtgagagactatcgcttgcgagcagacgacgcgagttcgtggcgtgcttcgggacacgcganagcngccgagcccatagagatggagccgngggcgcgngtggaatgatgagcaggagggcgccggacgtattgtgtgaacaggagacacgagaatgtgaaagagcncagtcacagactgaccgantggacctngggacnctgcgcggctacgtgacagacgcagancgagganggttctcacaccatccagaataatgtatggctgtcgangtggggccggtacggcgcgnttnntnngngggtaccggnaggacgcctacaacggcaaggattacatnnccctgaacgatgacctgcnctcttggaccgcggcggacattncatctnagatcaccataactcatattgnggaggcggtccatgcggcgganagcatganagcctacctggagggccggtgcgtggagtggctccgcagatacctggagaacgggaaggagacgctgcagncacggacccccccaagacacatatgacccaccaccccatctctgaccatgaggccaccctgaggtgctgggccctgggcttctaccctgcggagatcacactgacctggcagcgggatgggggaggaccagacccaggacanggagctcgtggaga

SEQ ID NO: 650584 - DNA, 377 bp, Homo sapiens
tggttcacctcgagattatagtatgaaatggtaccgggacaagggtgccgtgaaaggttctccctgagacccccagagagacgtgtggagggccggcttgcctgttactttactattaaattgcgcgatgggaatcgagaggaaaaagttattcagggtatgatgtctcagcctctcagcctgtacaagagaggctgagggcccggggccctcaccagtcatcgctgctggctggttggtaaggggagtcctcaggtccctggatggccaggcggggaggcccctccgcccttcgtcccccagcccctgaggactcaagccgccgaaactccaggggacgctgctgccggaatcgggaggtctcccgccgccactcg

SEQ ID NO: 650585 - DNA, 109 bp, Homo sapiens
actgctaccagcctctctggcctatggggaccaaggaggcaacatcccctttttgccaattctctctgtgtaatttggtggttttggttgtgtggtggttttctctctt

SEQ ID NO: 650586 - DNA, 569 bp, Homo sapiens
  misc_feature (327)..(327): n is a, c, g, or t
actgcagcgctggataagcgaggagcggcggcgacacttgaggccttccgcttcaccctattcagaagtcaacatccgctgggtcgggctcgcatcgctccacagccgactgctgccagccggcaagggctcagcgctctactctctggaagtgtcgcaccagccctgccgccacccttcccgccagctcgcgcactgctcaacccgcgccgcagccgcgcggccagaacccgaccgcctccgcttcaggatttttcctctatactccacagaaagtttttcttcccagctgatctggcaccccacggactcttcaaaaaacgcctnccagattgcactgatgacgtgaaacatggccagtctgtgacattagtgggcttcagttagcttgccgaacgccaatctgaattgcaacgcaaacaagcgagcttcccagtattctcagtgcccagaccgatcttctaattggatttgacagctcagttgcctctcagatccaaagctttagtcacggaccaaagccacctattaaagccatttcgacagagttattcgtccaccgcctccac

SEQ ID NO: 650587 - DNA, 651 bp, Homo sapiens
  misc_feature (254)..(254): n is a, c, g, or t
gttctgacgatctgagcggagaatgtagaaagtcagagtgtatacatcaggcatccgaattacaacgcagcacctacatcagctttagcacagaagggctttaatataaatgtacactgggtagaaagtcagtaaccaggtaactgggtagaaaaaggaaacttctagatctcaggaacgtagcaacgacaggaaacagccaccagccctaggcctgagggaaccggttagacttaaccttagaagcgtagccnaagggccctgaggtagagacttccttggaggagtggtgggatctgcagggagtgtggacgatgaggctggctggccagtgctgagataactgaagactgaatacaacagctacagctggggcaacaggaagccaacaggaaggacaaagccccatcttgctggtgcttctaccgacttctgctgatggaggtaggccggaagccactggcaaaagcagcagggatgtgcggacctagctccaaaactgcagaaacagaacacagagtactggagctgaaacaataatttcataaattacatgtagggatttttgaaaaatcaatctccatcaataccctaaggagagggtatagatactatacacagaaagatccccagacgagaggccgagcatca

SEQ ID NO: 650588 - DNA, 744 bp, Homo sapiens
  misc_feature (311)..(311): n is a, c, g, or t
gttctcgtttgtctcttgcacattttgcccagttggccacattggccaatttggcattttggcatacctgtatgggagaatagagtaagaggaatactccccagcccatgaagggtgaaagggcacctgtgcctagactaggcctgcctggtcatcccaggtgagcccagggctttctgcccctctccgggagggcccccaggttcctcccctcaccccactagttccagtcaaccttcctcctctgctctgggtggtaagggaagccctcccggttcccacccggctatgatgctgcacctgccacgagnccggtataacacccgcaactacatattggaaattttttatttttctaaatacccatgccgttttgctacggttaccattttgaaatattaactgagcctccaaatcacccctttctgtcaagcatatcttggcctctcccatgtctcagtgttgcccgcactttctccccggaacttgggggtggggtgaaaagcgtacccaaagatatcttaaaagggctcctggggtacaccagcccacgcacggtcctgagtgaaagccctgggccctcccaatgctcgttttatagccacctctctctaccctagttctcccaattcacttctgccttcctcaggtttgatatctggccggtttgactatcccgaggaaattaaatatttttatataaaaattaaattataataaatattcccccatgctttcccttta

SEQ ID NO: 650589 - DNA, 192 bp, Homo sapiens
cccagcggtgggatggtgaggaacgggcccttttagaaatcactcgtcagtaaggagcaaggctgcgacgcgaaatgcatctgttgcataaaacacacaactccgaatgggaaaaaggagacacttgtttgcaaagaacctcttccattaaaacgacgtcggtcttcagaacacccgctggcctacagcaca

SEQ ID NO: 650590 - DNA, 415 bp, Homo sapiens
tctagaggacccgctgccagaaggtatatcacgcaagcccacgatccataatccttctaatagctatcctcttcaacaatatactctccggacaatgaaccataaccaatactaccaatcaatactcatcattaataatcataatagctatagcaataaaactaggaatagccccctttcacttctgagtcccagaggttacccaaggcacccctctgacatccgcagggttttttcacacacgacaattattagccgaccatcctcgaatcatataccaaatgctctccacgtctagtaaacgtgaagcacttctcctaactcatctcaagcgttagccatcatagctagagcatcattagaggtagattaaccaatcactagatacgcgtggagagagtagggggatctacag

SEQ ID NO: 650591 - DNA, 146 bp, Homo sapiens
  misc_feature (75)..(75): n is a, c, g, or t
  misc_feature (83)..(83): n is a, c, g, or t
  misc_feature (109)..(109): n is a, c, g, or t
  misc_feature (119)..(119): n is a, c, g, or t
catgtgccgctcctgaatccgaatacagacctaattggtcctgaggtgcgaggccgttagcgacgagccacaaangggctggngtgagacacgtatggagtccttcgcngctcgcttcnctcgcacctcagtagctgcacctggcg

SEQ ID NO: 650592 - DNA, 722 bp, Homo sapiens
ataaacggacgattcttaagtcaagatattgaattcgctgatggggagagggacgttcaggcgcgtttcagagaggggaaagtgtgagctcttccctttattcctaatggctatctttgaagcaaagaaggccagcaacagtaggaatcatgccaactggcaagggaaccttgagtaatgtgaaggtctccttctgggattatgaaatcgtgttctcctcatctccaagggcagtgaccatcaagaacctaccagactccatctcgtctgtaagccttcgtgccaaccctgggctatcggtgctgacccttaaacacaggctgtccttaatcgcaactctcctgccctgtgatatgtctgttgagttggcctgtgcattgcctataggctgtagaaaggggagaatgtcaaggaagactttaggtagagaaggcgcagactgatgtgtatctgggaagaagaagacctctaggaggagctagtaggactgtacatgaagcaattagtctgaaactggcttccccagtcccccggtgctccttttcctatccttataggactgtaccttgactctgacctgggataggttggcagactaaaggacttgatgtacataactcctggtccttttcccttaaagggcgggatttcccttgtttgcgccatctatgtggccaaggcatgggggaaccatccaacatccaagggcctattagacctcc

SEQ ID NO: 650593 - DNA, 114 bp, Homo sapiens
ttatatgcaaggccaatgagttgtgtaggcagcggagcatgtgcagtgatatctagtcgagtcgaaattaaaaaagctacctactggagtgccttgagccttgcccatatgcta

SEQ ID NO: 650594 - DNA, 1225 bp, Homo sapiens
  misc_feature (851)..(851): n is a, c, g, or t
tcttgttatgactagtctcttgtgtcgtatagtttttacttctctctcgtctgtttttcctccgctagttctgatccctccttttttttactagttgtgtgatctgattctcacagtggtctcttcctggaccaccaatccctcaaatgctcgtgttttctgcgtgcccacacgcccaattacctcctggcctcacgaacaaccccgtcttttaaaatgtctcaaggactcttgggttcctggaggtcttaccccggaagcgtattgtgttgaccgggcccacccgcggtattctagaatttggcgttcaactgtattagtctaccacacatggaaatgtctaagaatgtaaacacatcagaaccattcaagttgtcccacaatgtgccacatgaatttcaccaccccttaatggaccaaaccatggaatgaggactttaagaatttcaaaaagcggatgaaggacccagttcttccagccttaaggattttgaaatctccctttgcttataccacaggacatgaatgcccaccaactcctgaatgccagaacttaatccagcagcgtgcctcccgtagaaaataaggctgaagttcacaagtattcttctatgaaagaaagagggaatgtacccggagaaaattctgccacggccctcgggtggtccacgcccctcgagtccacggacacttctgaactctcgttggctcttcttagcctcgtgggacaccactgggcccacagagagcctcgtgaatgagaaaccaccgtgagaactctcacgccacggaagctgattctaatatccctctggtgctaccacacaatgtttgttggctcaccacatagnttgccacgaaatgtttatggaacactaatgtgaaccccctacaccacttttgcacaagtcgaatatctctataaatgttgttagtcttataagtttaaaatggtcactagcgccactaagaaattctaaataagtgccacttgagattgcacaagagaaataattgtcttttcaccacgtattatgaacacgataagaaaaaataaaatgcttaccactttttaataagaatacaccccccatttaaccacgaatgttaaaatgaaaaatatggtccccttggaatcacctgaaaatgtgaaccacattaaggatataatccttatacattataaatattgacattaaaaaaagcctgctacattattctttta

SEQ ID NO: 650595 - DNA, 413 bp, Homo sapiens
cctcgaggcccggtataatagcacgctgttacccccttggccatagaggggaatattctgcatcacccctttgattgccgtttcctacaggtgaaacgccatcgttaggattcactgcaacgttagtgctattaaactcactagcatttttattaatggccgatatctacactaagctatactgcaacttggaaaaagaggacctctcagaaaactcacaatctagcatgattaagcatgtcgcttggctaatcttcaccaattgcatctttttctgccctgtggcgtttttttcattagcaccattgatcactgcaatctctatcagccccgaaataatgaaggctgttactctgatattttttccattgcctgcttgcctgaatccgagccatgatgttttctgtaaccca

SEQ ID NO: 650596 - DNA, 469 bp, Homo sapiens
ccatgtcctgtatcttcagagaatgggatatataatatttcgcacaaatgaattttttttttttgagatggagttttgctcttgtcgcccaggctggagtgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgcaaaaa

SEQ ID NO: 650597 - DNA, 206 bp, Homo sapiens
  misc_feature (83)..(83): n is a, c, g, or t
gcggccgcctactactactactactgctcgaattcaagcttctaacgatgtacggggacatggcttgtacctgcatcacagcntctcaggaggctgaagcaggaggatcactggaggccaggagttggagaccagcctggatgacagagggagatcccatctctttaaaaaataaataaataaataaataataaatatcgaaaaaa

SEQ ID NO: 650598 - DNA, 256 bp, Homo sapiens
ggaacaagaggcagcctttctggcagaagggcatccagatccagaatgcagagctccagaggatggagcaagaggctgagaggcgcagcagccacaattaagcagagccagaatcagaagtagaggagaagaaagcagaaaggaggaaacgagagaccatggaagaggagaggagcagagcaaagccttgtctgaaactactctaaggccatcagctctgtccatctgtttcctctgccagtgcattgctacacct

SEQ ID NO: 650599 - DNA, 212 bp, Homo sapiens
  misc_feature (2)..(2): n is a, c, g, or t
  misc_feature (29)..(29): n is a, c, g, or t
  misc_feature (51)..(51): n is a, c, g, or t
  misc_feature (84)..(84): n is a, c, g, or t
  misc_feature (124)..(124): n is a, c, g, or t
  misc_feature (159)..(160): n is a, c, g, or t
  misc_feature (169)..(169): n is a, c, g, or t
  misc_feature (180)..(180): n is a, c, g, or t
  misc_feature (207)..(207): n is a, c, g, or t
gnagacaaaatacgggaacagcaagtcanagaacgaaggcagacagaaganagaaggcagagtaacctacaagaagttttaganagggaacgaagagaactagaaaaactgtatcaggaaaggnagatgattgaagaatcactgaagattaactaaaannggattaganatggaaaatgnattagacatgagtaatcaagacataanagaca

SEQ ID NO: 650600 - DNA, 412 bp, Homo sapiens
agtcgtacctctctgctcccagattcactttgatcttagtcatttttttttttcttctgctagcttttggatttgtttgctctatgcttctctagttctattaagtatgtagatagtatagggtattgatttgagatatttctagctttatgatagcgggcatattagtgctataaatttacctcttaacactgctttagttgcctcccagagattctggtacattgtctctttgttctcattggtttcaaagaacttcttgatttctgccttaattttattatttacccagaagtcactcaggagcaggttgttcaatttccatgtagttgtgtggttttgagtgagtttcttaatcttgagttctaatttgattgcactatggtctgagagacagtttgttgtgatttct

SEQ ID NO: 650601 - DNA, 743 bp, Homo sapiens
  misc_feature (182)..(182): n is a, c, g, or t
atttaacgccccccataaggggtttgcgcccccgggccagatttggccgcagcaacccaaaagaggccctaatttaaaatccctttgggggcccggtgggaggatggggggtccggttacccaactctaggggaagggaatcctgtgggcccttctgttccccccgcgcggcgctgtggtcntgatgaaactctccctggggggttccaccccgccgatgtccactgaggcgccccaaaattacctccctcttccaggggtttcccagttgttagccggtggcctgggggttaaaaccccccaaggggccaggggtttaaaaaaaccccggccccacccgacccccctttttaaactggggtttttccctggggggggggggaggggccaaaaccctggggatcccccccccccccccctttccccgatggtttggtttttttttttaggggaatggggaaaaatttaaaaaaaattggtttttcccgggttttggttggggtttcgtttgcctaaacccccccccccctagggtccccgggaaactttgttagggccggtttagttttccccccagggtttatttggtttcctggtaaaattcccaaaccgggccccctgggggtttgggcccccctttggtttgtttttaaaaattattttccgctttaaatcccctttctttttccccttttttttggaccttttttggtaaaaaaaaaaatccatttaaaaacttggga

SEQ ID NO: 650602 - DNA, 451 bp, Homo sapiens
  misc_feature (268)..(268): n is a, c, g, or t
agagccgatgcgtaggcagcgcgttcgcggcgcgtaagtgaacgtggcatagctgggtcataggagatcctgatgatagacagggcatgagtctgaccccccttaaacaacgacatggagtaaagccggtgcgttcatgcggacgaagtccatgaatgagagtccctaggagtgtccagttcactgaggagtcatattcactgcgaagtagatctcacagcacgagacggtccgaatatcgacagactcaaaagtcctcagacctctnaggagacacccaggacacatggaacaaagaaaaaaaaacagaaacaacagcaacaaaaacaagaaacgaaacagacatacaacacaacagcaacagaaaaacagataagaaaacaacaaccaatacaataaaaacaaaacagaacgacgaacaacaacgagacaaaaacaaaaaaacacacaa

SEQ ID NO: 650603 - DNA, 645 bp, Homo sapiens
caggagttgaagaccagcctagaaagcatggtgaaaccccaaccctaccaaaaaaaaaaaagacacacaggacactttctaccaaggaaccagctggctgcttccagatagctgcaccagacttctttcagatgcttctgggatatggtcttctgaccatgttctttagcctcctttgcttcctgttacctgctcagtctcaagagctcctgactcaggcttttggtctgttttcctgaaatcttctgcgtctggcccctccccagacctaaagagagcttcttgcctctccccagacctaaagagagcttcttgcctattttgctatctaaagacctctatgattaaaattttcctttaattgagtctcacagctttacttcagcacacttactattacatagtaatggataagcaggaaataaagatctacaaaagtcaaacaaatcatatatagttatagaaacatttgtaatatttgaggtaaggatttacaaagctgttttatcaaaggtcctgggtttcttctagcttacttagctctttatacaatgcattgtataaccacaaactttttgctaaccccacaccaaataggggtgcttgtgaaaactgtcagatgcatgcctaagcttcaaagagctg

SEQ ID NO: 650604 - DNA, 1851 bp, Homo sapiens
  misc_feature (123)..(123): n is a, c, g, or t
  misc_feature (844)..(844): n is a, c, g, or t
tataaaaccataataaattacttagactacaatgagcaaaacacatttgtgggtttggtcagcagatactgctctgatttgccattaaaatcttaaaaattcttaaaaagctctcttgaattngacctctactaccttccaaggaccttggaaagacttaagtatgtgttagaactctcctgaaggcttggtcttcctttagtgacattaacactcaggtttgttattccagtgggcagccccagttcatgcaaactgacctgttgtgtctggtgtccttagactttgatatgcaggccaaagtccaagggatatgcaaacataacacacacctgtacttccataaaaaccagcagaattgtagatcagctcattttactgaaattttaaaccctgtaaaaaaaaaaatactatgtttgaagaaagaaatcctggtgcatataaaaactacaatgagtaacagtaatacaggtaagaatcaagcaggccttgagcaaaacagtccattattactgcgtaaactatgttgctatgatacttattttgagcctttatgcaccagcacatacatagtaagacacacaagatagttcaacaaaatctaagtaatatacaaacactgtaagagcttttccaaccaaagaaactttaatgtagatctgaaatgagccatcatgatacagaaaaagatgattatcatttcgtgtcctttccaagtagaactatctgataaccttttctgtttgtatcagaagagatttcaactcaacatgaaaattctactacttggaattatttgaaaaatcaagtatttgaaggaaaaaattatttttcatctaaagangcattacatttccttttgctagaaacgattgacaatgatgtaatttttcctgacatataattaattatggtactcttcaggtggatggcagctgtatacctacactcattccaagtcatgttgaagtgagtccagcatttccctttctccagcatccagctatatctaaggagatttttttttccccacaaatgacagtggctgaaatttcatatgtattgttctcttctcacccaaggcaactcttaagaaagaacagtatgtggaatgttgcatgtaaaagatttttgcatactcaaaaaattgctctgacataacaggggcatgcatttaggggatatatggataaactagggaggaaactgacagttattgatggactcacatatcccatagtgaagtaggcattacatatattatttcagaatacctggtatgtttttgcctacaaatcttttatttgattttgaagaaagctattgtataatgtttgaagaccagtccctgtaagtaggactaatgtgtggtggtggcccatagtcttctggatattggtttgtttttgtcatagatttcattaataaatttatttctgccctcaactatatatacaactgagtaagccatttaagaattctgactccttggctgggcatggtggctcatgcctgtaatcccagtactttgggaggccaaggcagccagatcacttgaggtcaggagtttgagaccaacctggccaacatggtgaaactctgtctctaacaaaaaaaaaaaaaaaaaaaaaaaaaagaaaaccaaacaaaaattagcctggccaacatggcaaaaccctgtctctactaaaaaaaaaaaaaattagccgggcatggtggcgggcgcctgtggtcccagctactcgggaggctgaggcaggaaaatggcatgaaccctggaggcggagcttgcagtgagcccagatcgcgccactgcactctagccagggcaacagaacgagactccatctc

SEQ ID NO: 650605 - DNA, 364 bp, Homo sapiens
cgtgcattgtgtcagacaggtggtactatgctggccaggaaagcatgaaagtgtggtgctgacaaggaaagttgtaatggagtgcttctttcactggtaattgacatacgtatgggatgacttcagcaggtatagagaatgaaccggctttggtagaggtgagcaaaggtgtgctggtatcaccaggaggtgttgaaagtgtgctggcctcagaaggactcatcacagatatagggctgatgaggacagttgtcaataaagtgcttctttcactcgtagttgacataggcatggtggtggtgccttcaagagttgtaggagatgaactgccttcagaggcagtggtcatagacatgctggtgta

SEQ ID NO: 650606 - DNA, 331 bp, Homo sapiens
ctctgtgatgcaagtgtcactgtttgctgatgatatgattgtatacctagtaaaaccctaagaacttatccaaaaagctcctagaactgattaatgaattcagtaaagtttcaggatacagaattaatgtacacaagtcagtagcactgctgtacaccaacagtaaccaagctgagaatcaaatcaagaactcagcctcttttacaatagctgcaaaaaataaaataaaatactgaggaatatacctgttaccaaggaggtgaaagacctctacaatgaaaactataaaacactactgaaagaaatcatagatgacactttgcatccagag

SEQ ID NO: 650607 - DNA, 382 bp, Homo sapiens
ggtaagcatcactacactgcttcctccacttcattggacagcagctttaaatcttgactaacaaaaaggcacaggacaccagctgggtcaatgtggagctttattgggctgtgcaaatttgggcaagttacttaatctcccagcgcctggacatttttaaccatccattaatgaaagtttcatgctttccgatgatgataaatggtcagacttccctgaccaccaagagctgaaagtttggaagaaaagcttccgtggggcgtgactgcagtggttcctcgtggagtgaatttcacccactggcaggttgaaatagtagcctgggagccaggatggagttccggagctttcctattgcttgagaaagaggcttctaagaatg

SEQ ID NO: 650608 - DNA, 250 bp, Homo sapiens
gtatccaacaattaatagaagaaaataaataataataaatactaaagatcaagcagaaataaatgaaattgagacaacaacaatagaaaagatcaccagaaaggaaagagttgtctattgaagatgatacacaaacattgacaacacttttccccaggactaagcaaaaacagagagtagacccaaactaaataaaatcagagacaacaaaaggagacactataaccaatactgcagaaccacgacacag

SEQ ID NO: 650609 - DNA, 289 bp, Homo sapiens
  misc_feature (1)..(1): n is a, c, g, or t
ntctagcggatctgatgagcaagctggaggctgcgcaagtgttcagcaggacagcagatcagcgcctcgcccaggcctccgtgctgggacaccaccacccagggccagacacttccaggagcacccccgccagcaactggccaccagctccttcctcctcttctggctgacggggatggtgtctgtggccttcctgctgctcccactcccggacgacctaggcagccacggtgatgctcataccttaccttgcctcctaccctcttctcttacctgccagctggctcag

SEQ ID NO: 650610 - DNA, 939 bp, Homo sapiens
agttctggtgccctgggtcccctgaaaggcggatagcggagggagcccctggggctgggctgcagcgctcggcttcctcctcctgtgctggaaagggacctccatctcagtgccaaaggagtctccgtcttgccagaattatccccgaccccctccccgaatctgccgagatccctctgatcctgatactgaggtcaccaagtcctcctccttggcttggagaactacctcagcctccctccgaggattctcggagcactgaatcctccacgccgaatccaaagcgtccccacagtctccacggtgtcccccatgcggactcccggtgacccgaccggaggtcctaccagatgcctgtgctgcggattgatgtgagtcaggaatcccagagaaaaggctcgctcccgtgctcatgcgccagtctacggaggtccatcactacggggttgtagacgtccttacacggaccttgaatggatggcagaacaaggcctgccacaggaaaggccccagacgtcaagagaagccgagcgcagaacctgttgacccttccccgaagggcccctgtctgtcccttggtactggagaactctgtacatgtgcactgcactccatgagactaatggcgcgcccgacgggcacgggtccgggaccgacaggcggccagggagccaccgcagggtcggaaaggacctggagtggggcctgccgagaaggcgagagaggccggagccggcgtgaccgctagtcaggagtccaggcacccctgcagggcggcccatcggtgcccgccgggcaccggtggcagccgggacctcaagccaaaccctggccgaatcggaaagccgagcgaggcttaggacccgtttcgacctcggcagggaacacacgggttccgaggaccgaccaaacacttgccgggacgccacgggcagggcc

SEQ ID NO: 650611 - DNA, 352 bp, Homo sapiens
gaatgaccagcacctggcccagcccccaccggggatactcagtgagcctgctggggggcaggtgcaggtgtcatcccatctacctcaccaggggcgagaacagcagttgccccactcccaggttgctttgatgagcctcttgccaagttagggggacccagaaccacccagcctgaatgtgagacttagccctggctgagctctacttccaggatggtgagggaacccaagagtccaggagcagtggtgggcagcatcagctcagcctctgaaacccacgcttgtcaagcttcccaagggcaacacttttttgcccttcttgtttctaattaaaaagaattagtcagcaaaa

SEQ ID NO: 650612 - DNA, 142 bp, Homo sapiens
tgattccaggacttatggaggtggggtgggtggcccgtggtggaggaatgggctcgtacaagaagatctgatttccgagttcttgtttcaggacttcctccgtcaggcagctggaggacctgaaggatcacatgcgagacag

SEQ ID NO: 650613 - DNA, 903 bp, Homo sapiens
cacgcgggaattttttgaggaagtgggtacgccccgggttgatccccggatggggaactttgtgtttcacccagaccgggaaaaaattattgggggcaagctttttaaaccaccgctgtcgcgcgcggggcaacattaaaacggggttcccgaaccacttgtgcaaggctcttcaaaaaaccggtgttaagacacatgcccctgaccagaggcacacttcccgggcgacttggtcccaaatccgcgagctctacttctggcaatacagaactacccttcgggcgtcaatttcctaaagctttattggagttactttccaggacccggttgcattatacacgtgacctttctgggccctgcctttgattatacggcctagatggaaacggagcacacatgcggactggagtctatgacttggatatccaaaaattatcgcggtcgacattactattctcattcacgcccatgcagagccgctaccaccgtcccaccccccacggcacatctatacacatgggcacggcccatctcacatcaaggagatttccacgctttcctaaaggtctttacacatcatggaatctccacccacgagaaatattcgcgccaatacttatgatacttatcatcacgaaacagtcctttcccatcatacatatgacagatcgacaatttggggccaaggcggcacaacactggccaaatacccccgtctctagcttcaaaggaacaaatcaaaaagtccaggccacaggcttttggtagggaacacatcgtcctgcttaattcccacacctagtctactgggacgtctagaggcacccaggcactcacacttgaacacttgggaagcgcacgaaggttcgtccgtgagcctgggccaccgactgacactgtctt

SEQ ID NO: 650614 - DNA, 501 bp, Homo sapiens
  misc_feature (434)..(434): n is a, c, g, or t
ctgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaatgtgaacattttgtagtagttttgtaaaagaacatcctttttaaatatgtatgttaatgtacccttgcactcaaacgccagcacatagtcagtttgtctaacttttctgtgaaactttgccgacaacccctacaccatttcatttatatttgtccctaccatgttataaatgttcataagtcccttcatgtgtntataaaaactgtcatatctacacacctgtgcacttcacctaaaatttttgattatcctcagatccag

SEQ ID NO: 650615 - DNA, 1133 bp, Homo sapiens
  misc_feature (425)..(425): n is a, c, g, or t
gggaccccaagcaatggaagaccatgaccactgcctttgcatctgcccaggacgcagctgtgaaacctaaagcggaattggtctttagtcagcaactcacaccagtgtcacttaagtgaaatcgagctgcacaaatcgacccaaaggggtgccctccactcctgggcccacgttggtcctcgtcacgcttcccagatgtggtccccgagtactctcagggcccagctggaatccggctgccagccaattccgcggagcgacgacagcagggcttcattagcgatgcagctgcgcgggcgtcctacctgacgcctaggtggcgctgttccggcccccggcgggaccccgccgagtcggtgagtcgacttgggctgccatactcgtaggactacagcagttgcctccatctaatatacaggaagaantaatgattcagagagaaatgcagaaggctcagagatggggaactcacagcagtgcccgaggagcctccgtgttgctgcctgctgggttccaggacctgtaagaagctcagttgtacactgtccatggaggcacgagacacgtcatttagattcgtttacgttaaggtggcatgaggtccgtttccctgttctgggagtagactggaaatttgttggttccctcttccaaagacaggctgcacgagagccgtcatgggctgggtgtggtgggtatgcctgtaatcccagcactttgtggggcttaagcagaggatcacttgaacccaaggagttcgagaccagcctggggacatagtgagaaaccccatttcttcgaactttatgaacccattagccaggttgggtggttacacactgtggtccctgtattggaggctgagggggaggagccttagaccagaaagcaggctgacgagtaaaaataggcctgattccggctagaacaatgtaccttttgagaaaacggatgcacgggcacaaaaaaactcggctttttgtggaaagcaaaaaggcggaattgttgaccctataagcaacaggctagggttaggatggaatataataaacagaataatgaagaaataaatagtatatagaataaaatatatatcataataagtagaagtaagataaagaacgaaaggttgt

SEQ ID NO: 650616 - DNA, 403 bp, Homo sapiens
gaggagatgaccacagaacagactgaggtggataaagtgacgcggacctatatgaggagagctgctgagccttcctcattacacatcccatattccagacttggataagggaccagccggaagaaaacgctttccagcattaagcttggattcctctgggtcacagacaccaattgagacccaaaattctataggtaaacttacatggtgagcaaatggcagcaagtgtggctctctggcgttggaaagaaggaggaaactctaatgatgccttggacacgactataggagctgagggaatttgctaactttgagtttgagatctggcgcaatacatgccaaggatgaatcacacagaaatctcgagtgagaggactctttcaggagttgatgaccacgtggg

SEQ ID NO: 650617 - DNA, 560 bp, Homo sapiens
  misc_feature (71)..(71): n is a, c, g, or t
  misc_feature (249)..(249): n is a, c, g, or t
  misc_feature (514)..(514): n is a, c, g, or t
  misc_feature (552)..(552): n is a, c, g, or t
agttacaacagctagtaaagggcagagctagaatatgaacccaggaatgtcggagtactacaagctcttanctaccatgccatactggtggcaacaattagtaattaccaagacttcaaaggtatggtgactcacaggggcaagagttaatgtactcttctctttgcaaagatttccttccaggcaaatgatgataagttctatcgttcttgagggctgtggcagtttcccggtacatggtggcagcantgggatcacagccgtgggtaagctaggctagcaaaccaaagcatcctgtcctcagacagatgagaatgttaccatctgaacttcttcaggtcaattttcgaatactaagctgaatactgaaaagacaccttttctatttcattctccctctgaatgggtaatatccagccactccaattagtttcatattaggtatcttttcttaaaatctctgttggcatcatgtccctgcttagcctgagaatgtgcagagacagaacgctgngacgggagttatcctaggacacactgactactttcatnagaccatg

SEQ ID NO: 650618 - DNA, 686 bp, Homo sapiens
acgatactaagaaaagcggctttttctactggctactgcgcctgaaagaggctctataagttcattcacacagctggctgatctggttttaacatgatggacaggatgagtacctagtaactgcgcagtgcttacaatatgaaaatgactacattgccctgctattgccacagagactgtgtcctgctatcaacgtgtagatgagatgaccttcaaaacgaagtaatataaaattagctctaatgagcacttcatgtgacctctgtccatatggaagaagtgaaagaactgagccttcaataagattgaacattgtctctacagcaggaagctaatactaacatccaagagctgttactctgtaatgagaataacagactttcctagtttgcgattagtctaatggaaacttgcgcactgttgcaatgatcttcctataaagaaactgacattttatcaaatatagatgagcctatggatcatacactgaatacgatgtgaagtggcagcaatgaaatgttgagatagttacttctaatgggccaagtacctatatgccacttgtcatgaggatacttaccacaattcagattgtctcagacgtgtattctagctactctctatcgagcgcgcgaggagataatttgtaatctcagaattagcagctatgttcttggtgagctttg

SEQ ID NO: 650619 - DNA, 1086 bp, Homo sapiens
  misc_feature (127)..(127): n is a, c, g, or t
  misc_feature (813)..(813): n is a, c, g, or t
  misc_feature (815)..(815): n is a, c, g, or t
  misc_feature (823)..(823): n is a, c, g, or t
  misc_feature (833)..(833): n is a, c, g, or t
cgtccggaattcgcggatgtgcggaactcaaaaccgactgcggagagcccagcggcgggagctggggcgcacgttggggccctgccgaggggcgggcaggcccggtgccagccccggcaccgacggnacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggacccctggaccgccaagaggtgcagacaagccccggtaggggcggggaaaggggaggggccctgcccgcctccgcacacgccggaccccagcctctctccccggcagcggaggcgcgtggagaccatcctggaggagaacgtggatggcacnancttcccgnggtgacggcnactgagagtgtgcgacgcgccccagccttcccacataaacgttataattctccgaaaaacaccctcaacccctcctcacccatcctccacccttccctccactccccaaacaaaattcaacctaccatcatcataaaaccactcctaccctaccatactacacatgcagccgcctcctcacaattcctcatctcaccaggagacatatccatcatccacctcaccgatacctcccacaacacaccgctcctct

SEQ ID NO: 650620 - DNA, 784 bp, Homo sapiens
  misc_feature (35)..(35): n is a, c, g, or t
attaaaagtctagagggttttattagatcaccgtncccattgcgttcccattcggaagacaatggtgaagagtctagtacgccctatgctaaaagccacttgcacaaggtataggctcgaagtcattagctgtgacagtcagttttcctaatcaggccctgtaattgtgcccaatcaatgtattctactgctatcgggagcaagagtcgaggcaccccctttgagtagtattgtgaggtagggaagtcataggagtatcacatacagttgcaagtcagtcatatactcactctcacagagagtcagttgatcgttttagcccatactccgatacatccgtatggtgagcagccttgagtagctggttcagctggttatttcaagcattccacctatcaagggaggaagaagaacacaggtcacagtctcagcttatcataaacacatggcacagcatccaaatccagtctctcatatcccgtattctttcgttagttcgtctactgtgttgaagaacgctatcatggcatcttccttgcaagtccattcacgctcattcaggatatcacactgtgcattgcctgtgaagtccacgatcatggcccgtagtgtatatatgtagcacacagatgattatcagtagtggccatagaagactgagtctcgtcatcagaggcctgttcataaggtcgcctggcctcctgagcagctttctcaccctcagcggcagacatgctggctggtccagcaagaactccatgcagccagccgaccaggaaagcac

SEQ ID NO: 650621 - DNA, 998 bp, Homo sapiens
  misc_feature (127)..(127): n is a, c, g, or t
  misc_feature (725)..(725): n is a, c, g, or t
  misc_feature (727)..(727): n is a, c, g, or t
  misc_feature (735)..(735): n is a, c, g, or t
  misc_feature (745)..(745): n is a, c, g, or t
cgtccggaattcgcggatgtgcggaactcaaaaccgactgcggagagcccagcggcgggagctggggcgcacgttggggccctgccgaggggcgggcaggcccggtgccagccccggcaccgacggnacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggacccctggaccgccaagagcggaggcgcgtggagaccatcctggaggagaacgtggatggcacnancttcccgnggtgacggcnactgagagtgtgcgacgcgccccagccttcccacataaacgttataattctccgaaaaacaccctcaacccctcctcacccatcctccacccttccctccactccccaaacaaaattcaacctaccatcatcataaaaccactcctaccctaccatactacacatgcagccgcctcctcacaattcctcatctcaccaggagacatatccatcatccacctcaccgatacctcccacaacacaccgctcctct

SEQ ID NO: 650622 - DNA, 813 bp, Homo sapiens
  misc_feature (115)..(115): n is a, c, g, or t
  misc_feature (124)..(124): n is a, c, g, or t
gaggggggcgtcctgtagggtggtcggtgttgggtgtggagtgtcccagcgcccctcgggtccgacccttgagcgtctgctccgggccagctacctcgctcctcggcgccatgancacaaccancaccttcaagggagtcgaccccaacagcaggaatagctcccgagttttgcggctccaggtggtggatccaatttttcattaggtgtgatgaaccaacagaacaacctgtgaggaagaacaaaatgggctctaatatctttgggacacctgaagaaaatcaagcttcttgggccagtcagcaggtgccaagtctagtggtggcagggaagacttggagtcatctggactgcagacgaaggaactcctctggaagcaaggctccggagacttcttagatctgaagggaagaaggtgatattcatgaacaatgtggacacagacttgtccaggcacgcctggggcaagagtgaagagaagcccgtgcttgtgggctgtgccatccggtgggcccggctccagtgctatccagaagaaatccccctggggggaagtccagcctcgtcttggggttagctctgactgtcctgaacgctgtccgtcctgtcgtggttacatccatgcttgttgaacttggaccaacttggagtctgatgggagatctcctggattggttcattaaccaaaacgcggttagggaatggccggccttgggggagtcttctgacagacgaaggttcaccactgggcgaaattcgggggtcgggggacaggaacacagggtccacaggcaatggggcagacccattgtc

SEQ ID NO: 650623 - DNA, 475 bp, Homo sapiens
gaccagcacatgcatctactgctcatatcaccaacagcaacctccttacctttctatatcctaccaaaggctacttgcctagcaccgtcgccttctcatctgatctgacttgatagtgccgctgctgcagacagctgccttatccacccggatcttgctgatccctggcctggcgaagaatggtgtaccggcgcatggtctttgcctatgggtttagcttcaacatgattctcatgttgtcagttgggttcttctttccgactctgcgatgcctcttcttgcgtgctgctcgaagggctcttcggatctctgggacttctcaatattctagctaaaatctgtattaatcatcttgtgcatggaaagattgtaataactcttgatggaagcggctttacgccaattgccgtacaatccatcttaacttccggaaagcacttgcagtccaaatgcagaaacgtcccacatgcccacc

SEQ ID NO: 650624 - DNA, 1435 bp, Homo sapiens
tcaaatgccacttccccagctttagcatatccctgtatgcctgggactggcttcctgtgtcagagtatagcagatgagaccttttctttcatgctagactggggaagatggcagcgagacgcttcggctactgcaggcgcttactgccaatgtgggaaagggccccggttgccagaggctgtactgtgtcatcagtccgccttgtgctgcttcggcgtaagtatctccaaggtcctagatgaggtggagcgccggcagtgggatctccgctgcactcggtctatcctttcatgacgaagtctcatggagtcgccctatcccagccccagggtaagaccatcacagtgaacgacattcctgcacaggatgctggcacatgagtgttgtatagagctgctgagacaggaccaatggaactacaaaggctaggagacacagtggaacctatatgagtagcactattaaaacactggacataccagagatgccgcacaggcatacactccggaaaatccacagacactacactggcattgcagcgcagacgaccaggagataccaacaaacgaagagagccaggagtacaggccaccagctaacccacgtccacccacgcacatgccgacacccaacgccgtgacagagtggagcccacttctgacgttcactaaccacactaaatatacataacattggtgcaaagacataccaacacgttatttgcagtactaaccactttgctaatactatacccctgatgaccacatatcgaccactcgacacatatgagaacacaaatacgatacaatggacataggtacacactaaatacaacacacgtttcaccactgggtgtaagaggaccaatagtaatacatcaccccaagcacaacccaccactgataccacacacgaaaccaccagtaggacaccaagcgacaagacctcggacccaccggcactgagccacagggcacaacgtgacaagccacaggccacgtggagcgagaaacccccatgcgccgcagatccgtggccaaccagtaactacacaaacacgcagacaccacacgcaacagtgacaacagacacacgaacaacgcaacacgacccgaacaggaaaaataaaccacaaacgagagcacgcgcaaaacgcacaggagagccaagcgcacgccgcgaggggacagcacacagcgcactctgggtgaccagcaaagcagatccagcacccagctacatcaacgcacatagacacacaacgacaaaacctccttgaacacacgacacacagtaacggccacacacgactgcaacaggcataaaaaacacccacaactcacaaaggcgactatcgagagagaatccacacacagacgcgatccacaagacatctgacccgtcgcaatgaactacgctaagatacagcagcagc

SEQ ID NO: 650625 - DNA, 109 bp, Homo sapiens
tagccggtccggaaatagcaggaacactgaaaggtcattcggtcttattggctccattatacataggtccgcctctgaatactaaagtttgtagctcctgttatctcct

SEQ ID NO: 650626 - DNA, 154 bp, Homo sapiens
cagaagtgatttggccggggtgcgtgtacacgggggtgcgtgtacgcccgggtgcgtgtacgcccggggtgcgtgtacgcctggggtgcgtgtacggggggtgcgtgtgagccggggtgcgtgtacacgggggtgcgtgcaccccgggctgtgt

SEQ ID NO: 650627 - DNA, 250 bp, Homo sapiens
cccagtgaatacgactcgcgtactggaggatctctagagtcgacagtgctccatgcttaactgatattatggaggtcagcactggtgctcactgtgtcgacggaacttgtacagggaggcatgcacctgagggggtgaatacacgttgaccaggctccaggttaactgatatttggaggtcagcatggtgctcacgtgtcgacggaacttgtccagggaggcatgcaccgccagtgggtgaatacacgtc

SEQ ID NO: 650628 - DNA, 369 bp, Homo sapiens
  misc_feature (56)..(56): n is a, c, g, or t
  misc_feature (101)..(101): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (150)..(150): n is a, c, g, or t
  misc_feature (185)..(185): n is a, c, g, or t
  misc_feature (278)..(278): n is a, c, g, or t
  misc_feature (345)..(345): n is a, c, g, or t
ctcaaacatcttcacgctaatgaaccggcggccggaaggctgtttcccaaggcganacagagggttagctggcccagctagagtcagagcccaggcctccnccngncnttccggctctttttccgttaccccactgcccgaggggaaaantcatgctttccacccaccgctgtgattggtttaanaaaggcttagcccatcttttcctgggcttcaccacgctgtcctcgttcctcccttctcagatatgtgcccactgtttccaacttttcatcaanaaaaaggccctttccaactccttccaaattagaaggaccagttggtgtacacacagcacctctggancatgccccctgtgccggggccgga

SEQ ID NO: 650629 - DNA, 252 bp, Homo sapiens
ctattagtgatcattcgtatttccccctctattgatccccagcgctccatatatatctcatcaacaaccgactaatcaccactccaacaatgactaattcgatactaacctcgaaacaaatgattatcatacataacactgaaggacgaacctgatctcttatactagtatcctttactcatttttattgccacatctgacctcctcggactcccgcctattttacaccaaccccacggtgcgttggcccaa

SEQ ID NO: 650630 - DNA, 465 bp, Homo sapiens
caaggtttaccacccagactcacggggagatgaatttgaggtggaaaacctcatcctacacaaggaccacagcgctgacacgcttgctcaccacaaagacatagccttgctgaagatcccgtccaaggagggcaggtgtgcgcagccatcccggactatacagaccatctgcctgccctcgatgtataacgatccccagttgggcccaagctgtgagatcactggctttggaaaagagaattctaccgactatctctatccggagcagctgaaaatgactggtggtgaagctgatttcccaccgggagttgtcagcagccccactactacggctctgaagtcaccaccaaaatgctgtgtgctgctgacccacagtggaaaacagattcctgccagggagactcagggggaaccctcgtctgttccctccaaggccgcatgactttgacgggaatcgtgagtctg

SEQ ID NO: 650631 - DNA, 131 bp, Homo sapiens
atacttttccgtttccaagaggtgtctatagaacaagggtaaaaggcatatgacatattataatactggcacacagagactgaaagctcgtagagcaatccgctccattcaccaagtgattgttccccgct

SEQ ID NO: 650632 - DNA, 246 bp, Homo sapiens
cccttttttttttcccccccgttccccggggggccccccccccctttttttttcccccttaaaaaaccccgggggggttcccccccccggttttttatttggggggggggggggggaaaatttttcccccgggccccccttttccccttgggccttttttggggccccttttaacccgttttttgccaaaaaccgggggggggcggggccgggttttccggggtttttttccccccccggccccca

SEQ ID NO: 650633 - DNA, 687 bp, Homo sapiens
  misc_feature (596)..(596): n is a, c, g, or t
  misc_feature (605)..(605): n is a, c, g, or t
  misc_feature (678)..(678): n is a, c, g, or t
tgatattttgaccttctcctttgaattatgaatgttcttaatggcatctagaatggttaatactttcgcagaagattgtcaatttattttgcccagatccatcggaggaataactgtggcagctttagccctaggaaatgttatttcttaaataataagactttaaagtcaaaattactccttaatccatgggctgcagactagatgtatcagcagacatgaaaacattaatcgttttatacatctccatcagagttcttgggtgactatgtgcattgtcaatgagcagtaatattttgaaaggcatcttttctaagcaataggtcttaacagtggacttaaaatttcagtaaaccatgctgtaaacagatgtgctgtcatccagaccttgttgttccccttatagcacataggcagagtagattaaacataattcttacaggccctagaatttttagtatggtaaatgtgcattgacttcaacttaaagtcaccagctgcattagccccaaacaagagagtcagactgtcctttgaagctttgtttccatgcattgacttctctctagctataaaagcctcagatcgcatcttcntccaatggnaagctattttgtctgcatttaaaaatccgttgcttagtgtattagtccattttcaagctgctggataaagacntacccaagg

SEQ ID NO: 650634 - DNA, 281 bp, Homo sapiens
  misc_feature (4)..(4): n is a, c, g, or t
agantctaaggatccccagtctcactccacctctcggtcaggccatcttcactcagcctcttgagtagctgggactacaggcatgtgccaccatgcccggctaattttttgtattttaggtaaagatgggggtctcactttgctatccagggtggtcttgaactcctgagctcaagcgatcctcccaccttggcctcccaaaatgctgggattacaggacttgatttgttttttttttttttttttttttttttttttttttttttttttttttattttta

SEQ ID NO: 650635 - DNA, 620 bp, Homo sapiens
tttattatcttttttttttctcatcatcccatcatgtacattttatttaatcgccgattagatagtaggcaaattcaggatagtaggcaaattcagtatcatatacttccattcatagttttctttggcttaaaataatttcaaagatagaagagaaaatatgatggtatagttttgttaatagggccatgaacagtacaaatttgtgagaaaatttttatttggaagtgtctagaaagaggagtgcacagaactccaagtcctcttcatttaagtagtcctgagcatcaccagcacagatggcaagcagtgcttttttataatgcccagaatcaaaattaatgccgtatgaaatagggattttccatatcgctctttgtatcgctaccttatggtcagcaggtctatttaacttttggcaaatgaaaatcctgattacagttttattatggaaaaccaaagcatgaaattgccctatataaatcttataagccaaatagggctgggtttgtttcgaacacaagaaaacaattggaaaccagcagtttcctgaaagtttccaatcataacatttattaaatgccatttccccaaattttggcccaaaaatattttggaag

SEQ ID NO: 650636 - DNA, 356 bp, Homo sapiens
  misc_feature (355)..(355): n is a, c, g, or t
attagaggtcccgtcgaggtaccaacactgacaggcttagcaaaaccaaaagggtctgtagagctcagaggcaggcacgagattgggagagctggatgacggtttggtaagagaattaaacggtgtagtcctcctgtgtatcctttggattctgttatgctgttgcttgtagagggaaaaagttcatgtgtcatttatatacaagtgcccatttgacattgagtgagtcacatttattttaccctatatgaacacaaaatctctgttttaaaatcagattctagaactttaaaagggttcttatgtattgttctgaagtaactcagtggctcttggtgagcccgccccacctggnc

SEQ ID NO: 650637 - DNA, 274 bp, Homo sapiens
  misc_feature (167)..(167): n is a, c, g, or t
  misc_feature (254)..(254): n is a, c, g, or t
  misc_feature (271)..(271): n is a, c, g, or t
tcaagtactatttcatggtccaaacctgttgccatagttggtaaggctttcctttaagtgtgaaatatttagatgaaattttctcttttaaagttctttatagggttagggtgtgggaaaacacctacagatttattaatatagcattaaaaacacaccctaacccntataaagaacctttaaagggttagggtgtgggaaaatgctatattaataaatctgtagtgttttgtgtttatatgttcagaaccagngtagactggattgaaanatt

SEQ ID NO: 650638 - DNA, 848 bp, Homo sapiens
tgcccgggcccctagcttggagtttcgaagcctcaagcgtctcacactcgtggtcgcggtgccttcggcggtccctcctgtgccccctcccttgcccttccccttgccccccctggtgatccgcgatttcttggtgcaaatgccagagcccctctcagatggccccgttagttcttctcggcacaggacctggtcataggacattaccggaaagtgcaggggcccctgggaaccacaggtgaggtccccagggctatctgggaggatgtagaacggattgggctcccgttgcggtcccctattgcccacggtactgacgcggtgcccaagagccctggtcaggatcatggggccctggcgcaagccagatctggagcctgctgctccctgctgcggagtcctcggaggcttcgcgttgactccagttccttacagaactggctgatgggccaggaggtccaggcctgggctctcggtccctcctatgacgggccattggagcttgcagctcagacccccatctttgagttgttaccttatatcaaatagtacgttaggatgcttggcacgtcgtcctcgtaatagggatacccttgcctcactcagttttcctgagtttaccaagtgcaatagttttagccaagtgccttgagatgaagctgccatgtcaaaggtggacaccattctccagcattcagggtgatatgctcgtcccgcgcaccgttggcaggcagctggccttccggaataaggcagcctggccccacatctgcagtctggctacacacagagatctggcacccctgggtggagtgtccctcgggggcttttacgcccatgcaccctca

SEQ ID NO: 650639 - DNA, 253 bp, Homo sapiens
  misc_feature (26)..(26): n is a, c, g, or t
agcctagtttgaacatcctcatcccngtgttagaccggatccgatatacagagtcttaaggaaatcgcatcaacgtgcctgagcagtcggctgtgactctcgacaatgtaactctgcaaatcgatggagtcctttacctgccatcatggacccttacaaggcaagctacgacgcgaggaccctgatatgccgtcacccagctagctcaaacaaccacgagatcagagctcagcaaactctctctggacaaagt

SEQ ID NO: 650640 - DNA, 321 bp, Homo sapiens
tatgttctcgactcgttacatttacattattgggaaaatgacaactcatgggcgggcattatggatacatacaaacggatactggtgaaaggcctccaaataggaaagggctcataaaaatatatataagaatatctgatggtacaaatccacttaacaaataacctcagggactagggaccagaattctctcttataaagtcattcagcatcatcagggagcacacaagtccattcaagtttcaggcacacaaatgcaggcacagcattcagcattcacaggagttcagcatttttcagcacaggtgtcaagcttccagc

SEQ ID NO: 650641 - DNA, 110 bp, Homo sapiens
ggctgtcctatggtagctatggatgtccgcatccaagcccatcttcactgtcacccttaaagcatacatcgtgagggattgtttgagtttcccagacactttcagttgaa

SEQ ID NO: 650642 - DNA, 944 bp, Homo sapiens
gcccatgggcccagcggtctaccacgagaccctggtctggaggagcagacgagccctaccccgtccagccagcctccttacaacccggctacatggatgccccgcaaggtggtcctctgagcattccctggcctctctgggctggcaggttggatcatgttgtgtgtgtgcgtgagtgagtggtgctggcgcgcgattccttatcgaccccagtgtgatgctgtgtgtgtccaggcgacggttccttacgctccatggtgtgctgtggtgtgtcctggcctgttgatattgtggggctttcctgcgtgatgctgccctggggtggggagatcatagtccttggccagcacgctggtgctgggaccacgacttggtgctcttcctcacactgacgattatgcttcctagactctcaacgccaacatggtcataacgaatgggggttggtcggggggctagcccctgctgacgtggccccgtgtgagggtgggggcctcgtcctagggtcgacatgggtgggcagttcttctcctacgcgtatacccgtaggcggtgacctattgctctagtgctgttcacgcccaggtggtgtcccttttctgtgtggatcgctgatttgtgctgtttgcgtcagcgtggagcagcgtgcttgcgcgtgggcagggcttcgtcccgcggagtagcggcgggtgatccgtgtcgctgatgcctgcgtactcttgtgccgtgcgagcgctttgggtagtcctcggcctgacggagtggcctggggaacctaaggtgtagatgtcgccgtggttcacgggggggccggtcatgcccggttggggactcagggacctcctggcgcaggaagcttggggggggcctccagtgtccgtcggccggatgtgcccggtccgattccctgggcacggggggcctggaaatcttttgcccgtgtg

SEQ ID NO: 650643 - DNA, 140 bp, Homo sapiens
tctgaggtcctacgctggcgcagtctcagcggtatctgggcttatggtgctcagtttctgatgagacattgaaagaagagtagctgaggagctggcattggagcaagcaagaaagaatccgaagatcagaaacgactaaa

SEQ ID NO: 650644 - DNA, 875 bp, Homo sapiens
  misc_feature (218)..(218): n is a, c, g, or t
gaccgtcgtgaggtgtcccgggtctcacggtgtttttcggccggctgtcaacgtagctgctttacctcatcgtgtttaaatgctttggggaccttcggctaggactttagttcctggtccccccgatttgggaaagaagtaagcaaagtcacgtgacctaggattggaccttcctgcccttgttggctggcagacgcgcgttctatcgcaggatcacnctggagaaattctatgaacctgagacttctgaaggacccgcttaggttcttcacgtaggccctccatttcccttccggtttcccaggggcacccttagctcccatggccctgacacgacacacatttcccccttcctgttccccgagagccgctggccccccatgcaccccgtgcatcctgtttgaccagtggatagtacttggatggctttcccgaagtcttctagaatatgagagttctttctctggcagctttcccccctggagccggagtgtagatgttcattatcttgggcctgggaaccacttccccaggcttctccctccccccacccccataggacaggatttggccttagcttctgggcctatcggctgccttccctctgacttcctaccacctcttctgccttcctttgagctctgttgggcttggggatcttagttttcttttgtttatttccccgctcctttttttcttctctggtcaggttttttatagggggggtttgtggttttttgtttttttttgcattctgagcaagcatttgcctttcttcctctccccacataccatcgtggtacagaatgcgcctgctgatttaccgatgtagttcatgtaagttcataaaggtaataaagataaaaacaaaacca

SEQ ID NO: 650645 - DNA, 1150 bp, Homo sapiens
  misc_feature (1)..(1): n is a, c, g, or t
natatgggcgtttccttcggggtgtgctcgtatgtagtatggcttggctagtgggtacgttctaatagttccctcttggctttttcttgtggcgtgttatagaaatgagagccctctatccagcggtagtggatagctgaagcttctcctgtaatgtggaactatcgtggcttggcgggtggtcccttctttttcaagtgtcttgatcctgtgaaggtgattgattctgaatggccttgtctctctggcctggtgaacttgtgggtgctatgaatctcctttttggtaaattggtctctccttctgtcttctacgtcgttcggtagaaatgtcatgacaatgcccgcgcccatttccgtaactattgtaagatcaatgtgtcatcgtggctcttgtctgtctcaatactggggcttaccttttctttgctgacaggccttcggttcaaatatgtctttgggtatggaagtttctcataggcccctgggcctgtgctcgttccgtccaattcgtctgtgagatggcgcctccaacggacgtcgtaatgaatggtatgatgatgtctctgacttgatggtgatgccctgtgatgtgcctcaataacgcatatgtacgatatacggatgtggtaataatactgcatcatcatttggccgacaactggttaactttttggaggtctctctggaatcgcatgaaggcccatgtgaaccatcacacataggcaccttgccctgcgcatgttagaagcacggagaaccgcagcctcaccagcgtacagtctatcagatcctcgcgaggcgcagcaaaatcggcgaaggcccgatcatgggacacaaggtggattgtcggaaccagcaagagacacatagaagactggaggagccagagtccctcgctaccggggtagggactctctctcagcacatggagcgtcgcgaaggatcccacaggccaccgaccgagtcgcccgccaccgtccgcgagtcctccggcgagataggtctcgtccgctgcggacagacggaaatactgatttcccactggatcctgcctctaggggatgcagtgtccgtacctgctaggagcctgggccctcattccaccagacccagacaattgaggaaacttgggaagaaagagagaaacg

SEQ ID NO: 650646 - DNA, 127 bp, Homo sapiens
ggctgcactaaaggttgctgtatctttctcctaccatttccagcacagcgatggtttctggtcccagtgaggccctgttcttgtgctgtgtggtacccttacgtaactatgatgagcatcccgggta

SEQ ID NO: 650647 - DNA, 338 bp, Homo sapiens
gcgtcgacgtgtgtgtgtatcctggaacttgctctatagatcaggctagtctcgaaccattctttttaaatatgcatataggtattttgcctaaatgtgtctgtgcagcaaatgtgtgcctgatgcctgtggaagccagagaggtatcaaaccccatggaatttgagttacagacaattctaatgtgggcactaggaaatgaacccatatccagtgttcttaactaccaagctttgatgacacaattttaaaaagctcttaagactggacaagtcagacaggcagatcttttgttattatggtacgcactactcttttagtgtactaaatggtttttc

SEQ ID NO: 650648 - DNA, 208 bp, Homo sapiens
gagatactagggatgatatagtgctagatgaaacataatatttatttataaaagtgtgtagatggtgaaatcacgaaaaagagtgctatgaccattatgtatgaggaaacaggccgttggatctccgggaaaggcactggtcaataagtcattacgtgcccatgtttggacattccccaaagcgagaaagcttcttaggaaaacacgc

SEQ ID NO: 650649 - DNA, 207 bp, Homo sapiens
tatcagccgtgggcaacatagcccgacctcatctctgctaacaattaaaaataaataaattagctgggtgtggtggtgcatgcctgtgatcctagctactcaggaggctgaggtgggaggatcgctagagcccagagaaccaaggctacagtgagccatgatcatgctactgcactccagcctgggatgacaatgagaccatggctc

SEQ ID NO: 650650 - DNA, 986 bp, Homo sapiens
ccagcctgggcgacagagcgagactccttctcaaaaaaaaaaaaatgcataaaataatatgggatctatgttaatagggcactaattggtttaaacgacataattggttaacctatagggtagggggacagagaaagggagcagagttaatggtatgctattggaagctgagttggctatcagtctggaactagactttggaactcagcatggttaaatggaaatcttcatagtagccactaaaaaaataactttaaaaatatacaggaaaagaatttaagaaagggatcaaaatattacagggataaatcattaaccaaacacaaaaagaagggtactggaggagcaaaacacttcatggtagaaactaaacaggcatgatggacgtaggtaaggtccttgggtggtataggtttttctggttttcctttttcgggggttggtctggaaacagagtctggctctggtcgctcaggctgggagtgcagggttccattctcggctcactgcagccttggcctcccaagttcaagggatactcagcctcctgagtagctggggatggcaggcgcccaccaccaaagccaggtgatctcggggtcccgggtggagacagggtccactacatgggccaggctacactcaagctccagggctcaggtggcccacttgcctcggcctccaaggtgccgggcccggccatgacccacttgacccggactgtaggggaacggaacaggggcacggggctctgggcccaggtggattgagggaaagcacggtccatggcaaccttggaaacaccgggaaggtccaagggactcaaccggctcaagctcacgaagggcgggagccgaggggtgtcacaccacgggccacatcatacgacgatacgtgaacaaaagcagctagacaggggacaacgcgttaaagcggagcaaaacatcggcacctacaccccagagaagaacagccgcaacaaagag

SEQ ID NO: 650651 - DNA, 827 bp, Homo sapiens
gacttgacccgcgccgccgctggacgcgctccgtgtcctggagctggggctgtgctgggagcggggcccaccctctacctttacccctacttttaccccacactcacatgtgcataagaagctgtaaagacgaatgcctaactaagacagtcgacccacagcggagacacaggccgcaccaagcacccgctaggcagcgcagcagacgccggattcccacgcgacagacactaccacacacacgacgcccaaccaacaaaacaacaccccaacaaccacacacacacccacacccccaacacacccacgcgacccacacaccccccaccccacggaaaccagaaggaaacgacagcacacacaacccagcatccaagcaccgacggatccaccagtcgcatgcacgacacgacgcgcatgcctcagccccgacggacgagcgacggagcacgacgagaatacgcagcgtcgcaacaccacgcaacgtcacacgaaagcgcaaaccgtacacacccacaccaccgatacgccgacgacacaacccaacacagaccatacactacgcccacgaagaaaacggaaagaagcacgagccaaacggcagaaagacagacaggcccgacaccagagcatacagacggtcggagaggcgacgccgactagtcgcagaagcacaagagagagagaaacaaggaccagacggcaggctcggactccgacctagcgcgacgatcacgacacgcactgcaccccaacgcaagacagcccggaacaactcaaacaagacggcttacacaacgacagagacacgactaccgaaactgcac

SEQ ID NO: 650652 - DNA, 1158 bp, Homo sapiens
ggcacagaacttcggtcatgggacttcagcattgagcgattgtttcgcagagtttggacctgcgactcggggtccttgacctgaaggctctgaggcgagatagtgcgcgaaatgtggctgacgctgaggaacattcaggtgtgatcgcgtacatcaagtcagtatcgttgtgacattccaagggacaacagcaatccaggggaccttgcaaaaaacaagctagtcggacacccgtgacaactcctcccaacgaagtattgtccccaacttggtaccaggggcaacaagttaaagtaaccgacattagcacaacttttccaacactacagagtgtaggcaattcaattgggtcctcgtgactccaatacgtcgatgtggcacggggtctggcggcagcatgcggaactgtctggtcaggggcgtcccgggtctcaaaatggaactgggtcgaccctggccacgccttatttccccaagtcaagacctgagcacaaccagacgaatctaacccagaaagttcgggccattgggcccatcgctctcttttcaccgcactactgtgtgagccacttacacagttcattgggccaagtaagaccgtttggttcaccacacgtgaggaacaagcagtacgccaatccgtgtatccctctcacacaacaggaacacttacctgtaagtacaaaatggggttggcgcgagaaatgatggagccagggaggcgaccggtggagcacgtttcatcgggcacacagacataggatgcattaactacaagcccacgttgagtgattaatttcacacagtaatcttcccacatgacaacttgcacgacgaatcagtcactgtccacgcatgttctgtccatcacagattggctccgctcacacaaattttttggctattcccctacagaatctatggccacaaacgtcgcaacaacaacacatgtgatgaagcacaatacatcaacaaacttggcatgcgaacaaaagacagcgacccattcttcagcagaccagttatctagtagcgcaggccaaatatatgagacacgcgttgaaccaaaaactctctaaatagtacttggcgcgtggatcattcatgcgcactccatttgtgtaatcgtgtcaccagcgacacaagcgccatctgtag

SEQ ID NO: 650653 - DNA, 240 bp, Homo sapiens
tcaggagttcgaaaccagcctggctaacgtggtgagaccccgtctctactaaaaatacaaaattagccgggcgtggtggcggctgcctgtaatcccagctacttgggaggctgaggcaggagaatcgcttgaacccaggaggtggaggttgcagtgacgccgagatcgcgccactgcactccagcttgcgggatgggtcgagactttgtctccaaacccaccactcgtccccacaccatg

SEQ ID NO: 650654 - DNA, 995 bp, Homo sapiens
cctggtcatactgttagtttcgtgtgtagtgtcgactggcgcgtactacccctctgttcgaagcgtctccgcctggtaccacagcccgggcactgttgtgaagtatatttgtgtatagcaagatggcccgccccctgtggtctccgcgagtcaacctggcggtggaaagatttgcccgcgcccctagtggcttgtcgtttgctgctaaagggcccccgtgctttttgcaaacactacaaccccggggtggtgtctctggcgcaagagcaacgtgtccgcaggtttcaacagaaagtaccaggacgcgctttggaaagaatgtgtcacgaaaggtgcacgcgtggggacgacacaagtgcttgtgtatgttatcacaaaggtgtagcaagattcttttccctagccgttaactcaccgggattgtcaccagcgtcgctagccccctgctgtatcactatgatgtaaaataggacggccctcccctttgttcaacattggtttttacatgacagtatgcggcgcccgctcacactctgaagattgtctgtctcacacggaacgggtttagtaacttttgttagaccccacacgttgggcggcctgctgttagctctatctgagtagatcaccgaacaaagttgtttgccgagcgatgcctcttttgaagatcccggcattgtctatgaacaatttaaaattttgtgtgggcgattttggctcacatccttcgttttacatggcgttattccccctgatttcaagtgggatacaccccttagtgtacaaacaattaacgccgacgcagatccttcgtcgttccacgctcacgcactcgcgtctattacggacttcaacgtataggcgcctccacacgacttacgagcagacaggccggaacggggcgcgaggcggcatgtcgaggtacaagtagaagtcgatgtgttttcgaccccgcataacaatcggtataagcagtactttacccgaagttatca

SEQ ID NO: 650655 - DNA, 239 bp, Homo sapiens
ggaacacaaaagcgggaggaaatggagatgatggcattgaatctgaatccgtggctggggaagctacttagtgtctatgcgtgcacacaccccattcataagtaaatgtggttaggaattcctgtcgtggctcagtggttaacgaatccaactaggaaccatgaggttgcaggtttgatccctggcctcgctcagtgggttaaggatctggcattgccgtgagctgccgcttttgtgtt

SEQ ID NO: 650656 - DNA, 194 bp, Homo sapiens
ggttactgcaatggcagaccaaaaagaaaccttttttagcaatatcaagaatctggtttaacctaaaaccttctaattagctctaagtcttaacccctattaacctaaggggtttaatttccccttctctccccatctcccctcagtccccataaaaccttcattccacataaggttacacgtgggggtaagtg

SEQ ID NO: 650657 - DNA, 383 bp, Homo sapiens
aaggtcgatctagagatccccaggggggaacaatcacttacttcaccggaaggtgtcaataataccatttcagcctcaactcacggaggcatgcacatcggcttcaactcacggagtggctagggatgagagaactaccctagacgacttcttggtggaccaagacagatccggctataccggtattaaggtctcaggccaaagagataaaagtatggaaggagggaaagagagaagaaaacgtgtaaggctcggctacaataataggtatctaacggaagtcataattttaaaatacgtatacacatctatatacacacacacatccccacagaaccatatcccttagctctactacaagggcctcaaagcaataatactac

SEQ ID NO: 650658 - DNA, 904 bp, Homo sapiens
cgatgggacggcaccctggcaccctggctaccagttttgaggggaaaaaaattagaaatccttggccaaagaggggacaaattgagcctaaaatcaagccttggtgtctcactttttaaatctacttttacctttgtgtattggttgtgtgattttttgtgtactcatgtgtatgattgctgaatacacaatgaatacacaaaagctataaatagatttaaagagagaaagcaaaccaaaacccatcggtaatccactggaaaaacaagcctccaactctattcagaacattgtcaattaaaagaaaagaattaagaatttcccttttaaactatatttcaggataactcaataactctagtggacaacagcaagtattttggttttgttgttggtttcttttttttgagatggagtcttgctgtattgcccaggctggagtgcaatggcacaacctcggctcactgcagcctctgtctcctgggttcgggtgattctcctgcctcagactcctgagtagctgggattacaggcgcccgagacaggctctactaaaaaatacaaaaattagcaggcatggtggcgcatgcctgcagccccgagtagctgggactggggcgcgcacacacagctggtaatgtctatttttgacgagatggggtcttgcatgttgccagcgtgattcgagctctggctttcacctgggccacgaagctctgggttcacgggtgagccccgtgccagcctttgggtggtgtttaacagaacatcagtatcccgggaaggctagcactcgaaaacggttgcccccctgcaaatttcgcaggtggaacgagcacggtcggggtcgtaaccgccggctaacacgggcagggcatgaccgaatgggggagcacgcaatggg

SEQ ID NO: 650659 - DNA, 349 bp, Homo sapiens
atacctggagtttatctcagagcagtgagaagccactggaaagttgtttaattgtttttctgtttttgagacagagtctagctctgtcacccaggcagactgcagtggtgcaatctcggctcactgcaacctccagctcccgggctcaagccattctcctgcctcagcctcccaagtagctgggactacaggtgtgtgccaccgtgcctggctaatttttgtatttttagtagggatgagacttcaccatgttggccaggctggtctcgacctcctgacctcaggtgatccacccaccttggcctcccaaagtgctgggactacaggcacattgcaacacggtctctca

SEQ ID NO: 650660 - DNA, 517 bp, Homo sapiens
  misc_feature (62)..(62): n is a, c, g, or t
ccgcgagcaccgctccgagctgaacctgcgccgcctcttcgctgcctccgtggaccgcttcntccacttcagcttgaccctcatcacccaccatgggcgtatcctggtgggttactcccagaacctggtgacggaggacgtgatgcggatgctggtggtcttggccaagtccaggggcgtggtggccgcccgggagcggttgttcactggtgtgaagatcatcttcgccgagggtcgtgccgtgctgctcgtggctctgcggatccggtctttcgctcccatcctggttgtcggggtgggtgtgctgccagaggtcatcgttgttctggtcctgatgaagtctttctgtcctcgtgtccggcgcggtgcctggatggggttccctggcgtgaccgtcgcggacgtcttcttccttggccttggcggctccgccctgggacccctctgggtgctggtgcccttgtgcctgctcttgcggcggtccccgcgtctggtctgtctcctgctttgatggaac

SEQ ID NO: 650661 - DNA, 313 bp, Homo sapiens
  misc_feature (1)..(1): n is a, c, g, or t
ncgactctagaggagcccggactacatacttccgaggaggagggactctaggaggactttgtggaagaaagcagccaaagaggctggaatgggggtcaaaacaacaatagccagcattccccagaaaaactctggaaaccaaaacctgcacctgaacaacctgcctaatctgccaggggcgattgcccgggctttaaaggcctaaattcctttccaactttaccctgactgtaaagctgggcagtgcatggcaagaaggctgacaaaccagatcaaaacaaatggctttggtgctcccttccccggtcctcct

SEQ ID NO: 650662 - DNA, 883 bp, Homo sapiens
  misc_feature (30)..(31): n is a, c, g, or t
  misc_feature (304)..(304): n is a, c, g, or t
  misc_feature (334)..(334): n is a, c, g, or t
  misc_feature (344)..(344): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (368)..(368): n is a, c, g, or t
  misc_feature (376)..(376): n is a, c, g, or t
  misc_feature (389)..(389): n is a, c, g, or t
  misc_feature (397)..(397): n is a, c, g, or t
  misc_feature (401)..(401): n is a, c, g, or t
  misc_feature (416)..(416): n is a, c, g, or t
  misc_feature (430)..(430): n is a, c, g, or t
  misc_feature (433)..(433): n is a, c, g, or t
  misc_feature (437)..(437): n is a, c, g, or t
  misc_feature (440)..(440): n is a, c, g, or t
  misc_feature (443)..(443): n is a, c, g, or t
  misc_feature (450)..(450): n is a, c, g, or t
  misc_feature (453)..(453): n is a, c, g, or t
  misc_feature (457)..(457): n is a, c, g, or t
  misc_feature (461)..(461): n is a, c, g, or t
  misc_feature (463)..(463): n is a, c, g, or t
  misc_feature (635)..(635): n is a, c, g, or t
  misc_feature (883)..(883): n is a, c, g, or t
caccgggtgaagttgttccatccttatatnnttttcctttaggcctacagtgttcccctggggatttgagtttcaagtttgtgaacaaggctgtattatttctgtgggaaaaatcattcaggtttcacatgatggaaacagaatgatacaatccactgagtttgaagactccaggaagaacaaaaaattatatttgcaattacttatttcaggtcaaattaatagcttctagtatgataactttttttgttttaaaattaaccagttaagagactgggcgtggtggttcatgcctgcaatcccngagctttgggaggccacagtgggtggatcngttgaggtcnggagtttgngnccngcctgggcancgtggtgnaatcctgtctctnctgaaatncagnaattggctggtgtgntggccacgcctgtngtnccanctnctngggaggntanggcncaanantctcgctgctgactccagagtgcagaccacagagcaagatctgtctcaagacaaaacaacaaaaaactgaccaggtagcatggtattcacgttacttgcgaaggaaccctaggctccgctacgcaaggatttgcttataacaaacaacaaaggcggtgggtgcgttactgcnggacaccgaatacggcttgcgaggcaggtagtctaacaggccagcctgttgctgtaaaaacccggggttatgtgcccaataacgagacgggccctcgatgtttactgaacaccatcatcgacacgacaccgcgcaccaggagagtaccaacacctcgcgaagaacctcgaacaacacgtcatcccccgcctacgtacaacgcactacatagcacgcaggcaattactcgctcaatatcaatgagttgn

SEQ ID NO: 650663 - DNA, 431 bp, Homo sapiens
ataacataacttggttccgtgcaagtggatcagcggaatgacagtagttcaattccagaaaacaaaaatcaaaagattaaggatcccaaaatgttcttaggcctgattagatttcacggaactcaagtcattttggagtggggcgttcacaaggaccccattaacccagcacaggaattctcgggagccatgagcgcctgcatcaggcactctgacaatcaatggtaaccaatttgcgatctaaaaattccccttaattttgctctaaagtcatgaggcttttgaaaggcaaccacatcactgcccctgatattttaaactgttttatgtataggttgtgttgacatccttggatatcagagaaagtgcagtttttctggtaccaaaacaaatttgggattgcatcatgtatagagagagacctttaagga

SEQ ID NO: 650664 - DNA, 250 bp, Homo sapiens
tgaactgtgtgcagcagttcaaagaagaggtagagaaaagcgagacacgttaaagtctaccctacaggatagatgtgaagaaaggcaagattgaagacacaggaggcagatggcggcctcctataccatcaaaacccagtataactctaaggagcagtggacaaaagctctcaagtacatgctgacgaatctacagtggggtcttgcttgggtatcctcacaattttataacaaatgacttttttcctta

SEQ ID NO: 650665 - DNA, 736 bp, Homo sapiens
  misc_feature (5)..(5): n is a, c, g, or t
  misc_feature (674)..(674): n is a, c, g, or t
ctcanagtatacaagaaatatctagaaaaaacgaccgtcctaggcctggccaattgggcccattcacaatacaaatttcggggtccgaaatcgagagaggtgatcgtacggtgagcaaagtccaataacggttgcaaaacaaattctggttcaacgttctatgtcatatgacgagtccattctacaagttcttcgtcattttcaggttctattcaacttaagtcttggggttcctatttctttaatagggtctagatatgtttcacttgaaggtttactagctctccgttcctgagttgctccgtaacctaacaagctcgttctccaacagaactgtctccgttcctcactgtctctccggacgacggtgtcatgtctcgaccctattaagctctgacccgtcactcttgtcccatttgtgtacaccgtccgaacaaggacttcttttctgttcgccctgtctgacccttccaaactggaacggctaccagggactttggtttgttacgtcatctgtttccggacaagaggctcccgtcttagttcgtttcactcccaacgcctttcgatttagcggtctgaatctattgattgttaatttatctaacctttttttttctagcgaattgtgcattgtttcaacacatcagaagaaattttccttttgtagtctnatctcacaagattaccggggacgaagagctgattctctaaccaaaaataaaactcgtcggct

SEQ ID NO: 650666 - DNA, 727 bp, Homo sapiens
gctattgccagtgactcgaagctatcacaaagtgccttcggctactttatgacagcctgtgctgttatcattttgaccataatatgttacctggggctgccccgtctggaattataccggtactaccagcagcttaagcttgaaagacccgttgagcaagagaccaaatctcggagtgttcagacatgcaactctcagcccaccaatgaaagtcactctatcaaagccatgctgcaaaatatgtcactcctggctttgactgtctgcttcatctctactatcaccattgagatgattccagacgcgactgttgagcgtaagtccagcatcgcaggcaggagtacctgggaacgacacttcatatctgtgtactgattcttgactttcaatatctatgactgtgtgggccggagactcacagatgtattcatgtggactgggaaggacagccgttggcttgtcagcctggtgctgagccggctagtgatttgccacttgtggtgctgtgcaacactaagcgccgcggtcctgaacttggtctttgagcacgaaggctgggtcattttcttaatggcttgctttggcgtttctaacgagtacctggcagactctgattttcattcggccccagtgaactccgcgcggagacccccgaaccacttggcttttttctttgtcctggcttgggcctggggcttgtttctcctttctcttccggctttggtgg

SEQ ID NO: 650667 - DNA, 379 bp, Homo sapiens
tctttgtgagacagagtctcgctctgtctcccaggctgtattgcagtggcaggatctcagctcactgcaacctccacttcctgggttcaagcaattcttttgcttcagcctcctgagtagccacctggctaatttttgtatttttagtggagacagggtttcaccatgttggcaggctggtctcgaactcctgacctcaagtgattcacctgcctcagcctcccaaagtgctgggattacaggcatgaaacactgcatccaacccaaaataatatttttaaactattagattcgacagacaaaaaaattaccatctgtgattttttttttaagtttcagaatgttcactttcaatttctttagttatctctttgtgggc

SEQ ID NO: 650668 - DNA, 141 bp, Homo sapiens
tattaccagctctcttactccacacacagagttttacttcatattcctcacatcgagccgagctgggccagccaggcaaccttctaggtaacgataaaaccccctgccgagagaagaggtgttgtagcgagctgagatcat

SEQ ID NO: 650669 - DNA, 133 bp, Homo sapiens
gaactaatttgcatgagaaagaggtgcacgagccggattcaggacactcattatagatctaactagacctctaagtaaagtcaggtgtgagagagtaaaggggacaaacaggaggagggaatcaaagaaattg

SEQ ID NO: 650670 - DNA, 1285 bp, Homo sapiens
tgggccaaaaattggttcagttctataaaacccaaagttgtcttccctcctggggtttaatttaagggggtggatagcaaaacagtggaaacaaatgggaaagagtggtcatctccgggggggggtgcgaggggcctccacaaaggtgtgtatctcccgagccactgtggggaaagccgaaagggggcaagaatccaccgtggaggctcgaggagagttccaagacacccaccgcctggtgcacacaacgatgtggggaactctccctatatctgtgtggtcctataaaaaaatatacaaaatattatacccgagggagtgtggtgtggcccgagtgcctatatatatgtctcccgagactatacgatgtgggagagggcgtgagaaggaagaaaaaatatgtcgcttgtgaacaccctctgagaggaggtgtggagaggtgtgtgcagagtgagagacctgtgagagacactcgtgtgtgtccggctgtgcccactctcgcgagcgcccgtgtgtggttcacacccagagagtgtgagagacactctgctgtgtgtctctaacaaacacaaatattcataactataaatatacaatatatacagacatatatacacagagtgttgtgcgagcaagtgtatataacacacacacatatacaaacgcgcgcgggagaaaagcacattctttaatatatatataccccgcgtcgtgtggggtgtctccccacgtcgtgtgtgtggaggcacataacgtgtgtggcatttttatacacaaaagaaacaccctttataaaaatatgcgcggtggcaccacataagagtgtgttctctcccgagaaaaaaatttctccaaatataagacgagagaaacgagagggtgggtggtgttatcccggggggggccacaaaacaagagaggcccagaagggttaagagagggggggccccaaggaggcttaaaaacaacatagaggggagcacgcggggccccacaaaagcccccagggcaacaaactatataggaccccacatatgaagaatgtgggggaaaggctcaatcacccgcgtgaaattataaaaccccccccaaagagtgggggttccctccaagtgatgacgtcttccagaaagacatatgaaagcccccagaaaatgtgtctgccctcgtgaggaccgactactaggggggaaagggggctctccccacaaaaaagagagctccaatgcagtgacaacacagcacacacgggtgtctcaagcataaagaggccccccttaagaga

SEQ ID NO: 650671 - DNA, 395 bp, Homo sapiens
gggataacgagaaatgtgaggccaggactgagaggggtctttcaatgctgcagtgagaagtagcttgagcacttgctccagtgcgcctggacttgatggggcaagcaaggctggacaggaaagatgcctggggcctgtgacttgagttggggtgcctaacatttccggcagttgctgccggtagaccccatacccagggagctgatacctacaggtagcccacgcacgcatgaaccccctccgcaggtggtgttcaattggccgtcagggcgcgcacaggccgtgtgctcaccgctacgttcccgttgcacggagcgctgcagacactgccagtcactggccgggagcctgacacgcagaggtccccgcacacgaccccaccccgtcgggtggag

SEQ ID NO: 650672 - DNA, 882 bp, Homo sapiens
gtcggcacagagtgcctgccagctggcgtaccaggcatgggtgatcaacgcccaggcggtgctgaggcggtggcagaaggagcgggagcaggcgagggaggaacaggcgaggtacatgctacccacaggaggtggtcccagctaggaggtggagcccggagagggccccgagggtaggcagcgtgcaggtcgagagccatgtgtgtgcagaggtgtgctgagcacggcgcagttcctgtggatgctggggcaaggcgcttaggtggatgagctgacacgctggctgcaggagttcacccggcaccaggaagcatgagcgaccgtgctgcggggcaagagcgctacctcctcacacaggagctcctgcagggctggcgatgtgcagcagggggccgtgcctggatcagctgtaccacaaagccagggcgaggccaccgcttgccatggcccccaacgcgaggcccccaaggtgccccaagcacccgtgtccagtgggctgggcgcgagagggagccactcagcaggcattacgagacggatgttgggcttggccccctgaagccccgggtaaccacaagggtcgcatgtggcagtgacggaagggccttacagcctgacccctggggtagccgctgaagggatgtgttgcccctttcgtgctacccagggggtcgtgactgcggaccgggccaaggggagctggtcctggaccagggcggcttgggcaatcccacatggttgaggcagccagaggctgttggcggcaggggggccagggccgagaggctctggggatgtttcgcgcacgtcttccactgtgtgtgtgggggccccatcggagcagtgccgtgttcttctcatagatcttcaaccggttgttcg

SEQ ID NO: 650673 - DNA, 80 bp, Homo sapiens
ttcaacaccacaccccccaccccatcgtgggtgagggtatcccctgtgtgtcacaggccaataaaatttacctggcactg

SEQ ID NO: 650674 - DNA, 136 bp, Homo sapiens
tccctgctcatgtctagtgcccagcgtctatcatgaggctgcatccaatgcccagagccatgtgtcgcactcttcgcgctggtgcctttcctctgaggggctatcaatgtgtagactaagccgtcgtaggccgtga

SEQ ID NO: 650675 - DNA, 387 bp, Homo sapiens
  misc_feature (352)..(352): n is a, c, g, or t
  misc_feature (379)..(380): n is a, c, g, or t
cggcacgaggtttaacaagacattcttagacgtaaaaaactattccggggttcttttacttggcaaccccacctggggcttcagagggtctgcaagccagcctcgactttttaatatgatattggaacgcttagaaaatgcagcaaaacatccactcaaagtcagatgtgttgtgtgctaccttttaggatgttccagtcgaatgcagcttcacggtttggaaatgaaatcatatgacttttttgcttcattgaacaggatacctgatttttttttttgttcctattcctaatttttacacatgtcaagattttctctgaactgtgtgaccaaaacaaaacaagggagtggncgagcctgggcaacatagcgagagccnntctctta

SEQ ID NO: 650676 - DNA, 140 bp, Homo sapiens
  misc_feature (41)..(41): n is a, c, g, or t
  misc_feature (86)..(86): n is a, c, g, or t
  misc_feature (90)..(91): n is a, c, g, or t
ggttttttttttgaggttgatggtattgataagtttgatantaaattttattttcaagattaagcgccgaggattaattttctctngtcnnattcacatttatagtattaagttatcttcaattcaggatttttatatat

SEQ ID NO: 650677 - DNA, 155 bp, Homo sapiens
ccaagagggacaacaccacatccgtgtcccgcccggcgcggggagccgcgctgcaacgcagcgggctacgtggacgacacgcagtgcgtgcggttcgacagcgacgccgcgagccagaggatggagccgcgggcgccgaggatagagcaggaggg

SEQ ID NO: 650678 - DNA, 770 bp, Homo sapiens
gggggggcctttgatgttctattccattcaagatgagcatttgcgggcccacagaggctccctgcaaccttcatattggctgtttttcctgagatgaacgtgtgctgcccccagtgcctgctgcctagccttgtactcgttgccttgatcaatcgcgagctgcattcactgcggcttgctcagttcggccgcttattccgatgctcacttttcttcctacttaggattgttccactgcctatctttgtggagtgcatgcaggacttttgcctcttctcctgcctcattccctgacatgtgctctaggttagatgtcagtcccaaatcaggtatgtccgtcacgtatgcaggcctcgacgccctcacctgtgtttatttgggggctccagggaccaatctggggctggaaatgttaggaggttgccgttggtagctgcccccgagatcgtagtccagcagggggcagtatagtgatctctggtagtatccctggctgctaagcccttagggacaggggtaggtcctttcctacattcccattcacttaacagctcttttgggattgggtgtttcattccatttactgcccactccatctcctctcctctctggtaggtttaattttatgcttttcctgattccagctttctgcttgcctgaggactcccgctccccccaccccaaagtttgtcatgtggcgttatagtggtaactgcagttcctcctctggaatgtagactgtatatgtttaataactcaccttatactcc

SEQ ID NO: 650679 - DNA, 323 bp, Homo sapiens
gaaacctaataacgggatctggtttgcatgagctatgttcaggttgcagatgtggctagggtcccatgttgctgtggctatggtataagacagccgctatagtcttaattgacccctagcctgggaacttccatatgctgcaggtgcaccagtaaaaagacaaaaaaaaatttttaatttgtctaataagcagttgcatttatgacacattcttaagcacatgcttatgactgacaagtcagacatactccttaaccaacatagtggcgtaattaagggttccggggtacgggggctccgaattcgtaaatccatggtccata

SEQ ID NO: 650680 - DNA, 269 bp, Homo sapiens
  misc_feature (218)..(219): n is a, c, g, or t
  misc_feature (222)..(222): n is a, c, g, or t
  misc_feature (233)..(233): n is a, c, g, or t
  misc_feature (237)..(237): n is a, c, g, or t
  misc_feature (248)..(248): n is a, c, g, or t
  misc_feature (253)..(253): n is a, c, g, or t
gccatgggaaaacatgataaaatggtcatttattttgcagttagaattttggaagccccaaaatagacagaccccctgactgttgaagggaggtttaaaaacagatattcaatttaaatgtaaaagagccccccaatttagagcccaggttacgaagacaagcttgcctcgcctgacttttttgtcccttgttttgcaggattagtattttgttacannccnctagtttttanactnttcaattaaanggccnatggttataacctgca

SEQ ID NO: 650681 - DNA, 659 bp, Homo sapiens
tctttcgtatggtggcacgttaatgagatcgttttctataaaataaatacatagtcaatttcaatcaaagcacatgataactcccagatagggacgtgtggaaggggctcagatccatactgtgcgccggtcttacacacttcttttattgtaaattataattttacattttaccttttctgacagttcttattattgatctaagaataattgactgtgccaactatgactcacctttttccaaggtagtttgactacctccaggtggttttaagctatcttggtgtttccagctgtaaaaagtaaagtagctattcctcttcaaagactttcctccccatctaattaggaataaatagtaacttctcttagaagcaaaatttattcaaagacccttgcaaacattcttaaatatctgctagccataatgaagaaatcagtgtactttatgttcttagctcccacaatttagcctaaatatttgccctggcatgcttatactgctccaagcaagcattaggtcatagcttgttcctcttccttatttaaaggtgtattttttttaccttccccagcattccacaggttactttctccttcccttgtgctcctctgcctttgcctcttttaacaagttctaagttgcccgccaatcgaag

SEQ ID NO: 650682 - DNA, 436 bp, Homo sapiens
catttcactttatttctgaatccttggacagccctcttcaccatttcagcatcaggggaggcaggacaaagaaaactaatcaagggtggataagtgtccccttccatactccggaatgaggtcaagcttccccctggcctctgctaaaaaaaacctcagagtgggtactagctgggaacaaagggactcttctactcatcagggtactatacgacttctactgggattgcaaggagagaagcccaccagcgggggggggggctaggttaaaagcacggggctaggagtattatatgagattatgaccaataagacacataggtacgggggtggaccaaggcagcttcggtgggaattcggatgtctggagtgaagggactggctctcaatcagggatcccagacttgtgggccagtattggaaagcacagaccggt

SEQ ID NO: 650683 - DNA, 662 bp, Homo sapiens
  misc_feature (31)..(31): n is a, c, g, or t
  misc_feature (80)..(81): n is a, c, g, or t
  misc_feature (111)..(112): n is a, c, g, or t
  misc_feature (120)..(120): n is a, c, g, or t
  misc_feature (123)..(123): n is a, c, g, or t
  misc_feature (125)..(125): n is a, c, g, or t
  misc_feature (131)..(131): n is a, c, g, or t
  misc_feature (137)..(137): n is a, c, g, or t
  misc_feature (139)..(139): n is a, c, g, or t
  misc_feature (148)..(148): n is a, c, g, or t
  misc_feature (156)..(156): n is a, c, g, or t
  misc_feature (159)..(159): n is a, c, g, or t
  misc_feature (164)..(164): n is a, c, g, or t
  misc_feature (174)..(174): n is a, c, g, or t
  misc_feature (182)..(183): n is a, c, g, or t
  misc_feature (186)..(186): n is a, c, g, or t
  misc_feature (200)..(200): n is a, c, g, or t
  misc_feature (204)..(204): n is a, c, g, or t
  misc_feature (206)..(206): n is a, c, g, or t
  misc_feature (216)..(216): n is a, c, g, or t
  misc_feature (222)..(222): n is a, c, g, or t
  misc_feature (227)..(227): n is a, c, g, or t
  misc_feature (242)..(242): n is a, c, g, or t
  misc_feature (258)..(259): n is a, c, g, or t
  misc_feature (261)..(261): n is a, c, g, or t
  misc_feature (275)..(277): n is a, c, g, or t
  misc_feature (290)..(290): n is a, c, g, or t
  misc_feature (354)..(354): n is a, c, g, or t
  misc_feature (375)..(375): n is a, c, g, or t
  misc_feature (380)..(380): n is a, c, g, or t
  misc_feature (400)..(400): n is a, c, g, or t
  misc_feature (414)..(414): n is a, c, g, or t
  misc_feature (653)..(653): n is a, c, g, or t
tcccagcacccccaccccctgcacgaatgcngcatatgagctgtgtgtgggaaaatggggacagtgccctgggcaggggnnccccaagggggaaagtgcttgtgtccattnntcctaccnctncncagctncccagntnaagggaagntgttattnttnttttntgctattttnttggtaannttnaagttttgctgttnttgntnacgctgtttntttgcngattncaagtttttgttgtntgttttgggaggtaanntnatggttttgatagnnntgttgtggatatntaggcggaaggagatgcgctggtggaaggctagctggggctctcgggtggaatagatgttaatnatctccttgggttggattagntcttnttgtggttgatgctggcgtnagtgtgtctatctnggatggccttggcaacaatgaactctgcatcttcggggctatccaactgcagcttctgggcgatgtcagccaaggagattcgggaataggagaggctgatcatgcgtacacctgtcttaatcacgttgtgccgcagccggataattagggtgtaggtcccatctgcttgaaacttctccccaaactgatccaggacctggttgaacttggctaggtttcctgtcctgacagcttgagtnagaaggaaa

SEQ ID NO: 650684 - DNA, 455 bp, Homo sapiens
  misc_feature (227)..(227): n is a, c, g, or t
  misc_feature (292)..(292): n is a, c, g, or t
  misc_feature (437)..(437): n is a, c, g, or t
ctctggaaatgcagaaagccaataaagaaaagtgaaagttcttaaatggtcgctttgtccataatgccaaaattttagagaccatattctctaatttcaccaagaaaacttgaaaaataaaagtttaaagagatatccgaaaatttaaacagcaatttgtatagtattaaataactttggccaggtgcggtggctcacacctgtaatcccagcactttgggaggctnaggcgggcggatcacgaggtcaggagatcaagaccatcctggctaacacggtgaaaccccgtctntactaaaaatacaaaaaattagccgggcgtgctagtgggcgcctgtcccagctactcgggaggctgaggcaggagaagggcctgaacccaggaggcggagcttgccgtcagcagagatcgtgccactgcactccagcctgggtgncaaagccagactccgtat

SEQ ID NO: 650685 - DNA, 424 bp, Homo sapiens
  misc_feature (160)..(160): n is a, c, g, or t
  misc_feature (172)..(172): n is a, c, g, or t
gcggaaaatacctttcccatccctcccttaagggtgtgggcccaaaatatgctcatgtggtgtttaggaaaacaaccctttccccccccaaaagggggggaaaactcccttaggattaggtggaacgtgtgatcccccttatgcagaatcccccccagtncaagatccccgnctggttttttaacaaacaaaaggatgtaaaggatggaaaatcacccccggtcctaacccatggtttgggcaacaagcttccgtaaaaccctggagccccttaaaaaaattcgggcccataaaggggtgggtcccttttggggcctttgtgtccgaggccagccccccaaaacccctggcccccgtggcccccccgtgggggtgtccaaaaaaaaataagtctgtaggccctgtctgttaataaaaagttttt

SEQ ID NO: 650686 - DNA, 512 bp, Homo sapiens
  misc_feature (241)..(241): n is a, c, g, or t
tgaaagtttatcacctttactggacttttggaacattttgaaatgttttaagtgaatgttttattttcatttttattttatttgtacattgttcctttagagtgttcattcgttgaaatttttgaatctttatagagagaggttaactgatttaagaagggaaatcttgattatatgttaaataataatacaattttaatattgtattattaacttacacttgcaaacctttaatatagtnctgttataggcatattaatattatattattgttataatagtaaccaaaatataatattagccttaacaatagaaaaacagaaaaacaacaatattaacttaccttattagtgatatagcctgtgaagaaagagaagtgttattagagagtgtaaataagattgaggtcattagataagtgtgaaaaaatctagaatttgttttatttatttttatttatttttatatatatttctgtgaacattttacaatacaatcttttattattctta

SEQ ID NO: 650687 - DNA, 338 bp, Homo sapiens
gtaccgaagactttagatggtgcacttgatgcacagagtctcacaacgtcgacaatttcctggccaaaaaaactgaagagtcagctgatgccagaaggcaagccgacatgctacaaaatgaagcacaaactcttttagctcaagcaaatagcaagctgccacctgctccaaagatttcagcacacagcacacatatgaagcacaatcaaagcatacatagaagcataaagctcaagaattcagccagactggaaggcgaagtccgttcactcctgaaaggatatcagccagcaaagtggctgtgtatagcacatgcttgtaacagaggaggttatggg

SEQ ID NO: 650688 - DNA, 605 bp, Homo sapiens
  misc_feature (401)..(401): n is a, c, g, or t
  misc_feature (493)..(493): n is a, c, g, or t
  misc_feature (495)..(495): n is a, c, g, or t
gattacaggcatgagccaccgtgcctggccagaaaattgtaaacacacacaaactctcaagtggactaattccctctcaccaaaccaatcacaatacagataaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcnccgtgttggccatgctggtcttgaactcctgacctcaaccgatccgcctgccttggcctcccaaagttctgggattacaagcgtgagccacngngcccagcctaaaacttaaatgtttttgacggtgtggaatcccaatgttgtttttctaggtggctacccagttgacctaactcatttattgatcacacggattttcctcta

SEQ ID NO: 650689 - DNA, 347 bp, Homo sapiens
gaaaaggaaaagccaagcctctgtaaatcatcactcagcctcctgattggtcccaggccaagctgaatagcccttaggaataaccttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttca

SEQ ID NO: 650690 - DNA, 214 bp, Homo sapiens
ggccttgaagatgtattaaccactgaaaaaatcattcataaattaacatacacaaatgtacaaacacatgagttaataatgtaatgacaaaggactatttttgtgaaaagtgatttttaaaacatatttagatttcagtgcaaaaaagtaccactggcacttattaaaacgtaagagcaagctcaaaaacacgtagtgatggcaataagctagc

SEQ ID NO: 650691 - DNA, 169 bp, Homo sapiens
ggggtgagccatctgcgaggtgatgcttcaggagagctcatctccatgttgggtggaaggctggtagtgaccatatggcccgtgagccaatccagactaaattctatggttctgccaaatttgcactagtataattactggttaaaaacaaaaagttagggccgggtgt

SEQ ID NO: 650692 - DNA, 328 bp, Homo sapiens
tcatgccgtgactataggtaccgattggacttctccagctcatgaacgttcttgcccacgtaatccttggagcggaccagttcttccatttcgactatgagcattttgttggaccgctcgagctcctctttggcttccaaggcctcttcaagggcccgagccaggcacagggccttggtttccttctccctggcttctgcctcagctctgtccctctcatccgcgtatttggaagagatgtttttctcctcggctaacaactgatcaaatttcctctgcttcttttccaggttggacacgagttgccggaagaagggaatcctctaga

SEQ ID NO: 650693 - DNA, 92 bp, Homo sapiens
tctgaggacggggctgattattactgcagctcatatacaaccaccaatagtctcgtcttcggcggagcgaccaaggtgaccggcctaggtca

SEQ ID NO: 650694 - DNA, 969 bp, Homo sapiens
gttctttcgccttcctgccttgggcatgacgtccgaccgggtgcgtccgagcccgttctgtcccccgtctgtcgggccttcccggccctgtacccggccagggagcccccgtttttttccccccccgtgacccctatggcttgtgctctctccccttgattctctgtgccgccgtgttcatcaaggcttttcaaggacatttatctcgcccgggcccggcgcccccctccccacagatggttttccgggatcccttttcggttttaaaaacgcggcggagctgtttccttcccccgcagggcattcacacggcccaatttgtgtttttccgggcatgaaaggccccgcttctgaacattggccgaagtggcctccccctttgggcaccctagcctgagggtacccatctgtgttgcgtccctggaggagaatcccttggtgtccctttgcctaatcgtgtgccccggcatcaggggatttatccccctcgttttcttctccccccacccctgtggactcccaggaggaccccctgttgtaggctttccccttctcgggctctccagggaaggttatcttttctctcgcccaccagagcctgtttgtgttgttttgtgttctgggaggtgtgccgggatatgggccaaacacccatctttgtaaggcgtttcccccggcgttcccaccacaatattaggcccagagggactttctgtgcccccgagtaacgggggtgtggccccttgatccctgtggagctactcccttttgtgaggtggcccacccacccagccacgatcctcggccagccctccccccattccccgaagatatccccctctggcccccaaatgggtttcctttcttcccccccggctgggcagtttccgggggacccagaactttgccgggagaaaaaagaaacttaatgctgggggcccccaataaaagatttttgtttattcccca

SEQ ID NO: 650695 - DNA, 688 bp, Homo sapiens
taaacagttttcaaaagttcttaaaggcaaaagtgaattctctggggatttaacgggtcccagctttaaggtctcttataaaacactaacaggactacataaaggcttttccagcataaactgtgtcgtctccgtgccagatggtggcaagatcaccattagcaaatgtggaaatttacttttgaaagccattagacttacaggtgatgcaagcattctaagagagaggttaatcacactaatagaggcactaaggtggtactcagtttctcaatttttctaatgtgttataacacgtggtgttttataccagcgtgttgcgcaagctaaatggggcgtgttacgcttgtgagcagtggcttacacagggtggtttggcggcgagcgcgcactttcgtgcgctaagtggctcttcggcctgctaacaaaattggtttcccaactcctccgtttgaatatgtgttcgctggaacaaacgctatgcggtgcgctgggtacacaatgttccacaccaaatcccgtgtggggtctgggcgtcatgttctctggcctatcgttataactatctccccactctgaaagccagtgtttacgcctgttcggaaccggtggcgtcattggaaaacacgcccttcgttattgcccttgtgtaccaattccttttgagggtggccttcttccttttccc

SEQ ID NO: 650696 - DNA, 263 bp, Homo sapiens
tctagtcaagtgcttcacatagtactttatatgtcctcgtgtaaaaacaaaaggaactacaaagtaatcgtgaaatctactgtgaaaggaaaataaaaacgcaggacttcaagttcactatgcaaagaggtagaaaagtaagctgaaagctgagtccctgaaagctgagtcccttggttcctaagcagggagctacaaataaaaggtcaaacacctctacaggctactttatgttccattttatcttatgtaaagtgccgact

SEQ ID NO: 650697 - DNA, 1402 bp, Homo sapiens
  misc_feature (416)..(416): n is a, c, g, or t
  misc_feature (866)..(866): n is a, c, g, or t
gcgtgtagtaagactaggcctatgagtctcgatctccaatgcatatgggcctaaagtaacgtagataggctaaaggcctacagcggaatggctgagaaactcaatgcagtgccgaactacctctgagtagttagctgacacactcgaatcatgtaactctctctgatacaaagaacccatccatatagtgtgttgcaattgcgagaccatcagagcgccaaccatagagcactgaagtttcatagagacggatcgatgcgccgtgctgagctcaatgatttgtgtgaaccgcagaacattccactctgagctaagcgcgtcatagtgagaactagttatccacccatatactcttgtacgctggccgtacccggcccttgaagacagaactcgctcgctcgtaccctcagatgagntaacacctgagcgcatagaaccatcgcttcatccgcgcattcaagggaaactcaaatgggtcagagtcccaaaaggggcccaatatataactccacacgctgcaaagccacctaaatcaataggagaaccacaataacacctcttagcacctccgtgcgtcagtcacctttaattatgcatcttcgcaataaactcacacggtacattcggcatagtaaatatcctcactgagaacgaactactacaaagcaatggacgcccagcgaggtccgaaagcgtcagcacatccacatcaactgtggttgtaacctatactcccatatgtcttactcccggggatagaacaccgaaacgaaggttattaaagtccacacacgaacaacattcctgtgggcgagtcactatcgaatccgcacatactcagggagctggatacgcggtggaacgantaaccgaaggacgcccaaagggaaaaatcggggcgcgttcgttacattggggacataggggccaactcgtaggtatcaatttgtgcccccgttaaataattcgataacacaagctctcgcgtaaacgttcaggtggacctttcccgcgttttggccaccctataaaacttacacaattgcaggcagaacaattgcatatgtctcactcactcatccattggagatccattacccacattaagggaggcaaggtccaagcggtagaaatccaaccatgtacttgtacgcataagagtccaaaaacgttcgttctcgacttaggagatccgcaagactgtgcaacgcgctaatatcgatagaaacgcattcgccgttgtatagtaccctaagaaaaagagaaggtactaaacagttaagttggacaccataaggccgttatataaacgatcacacacaattagaggacattaacagaacaatcacggctaaaacaagagacttaaccgcagatcgcgtagtattacatgaggtgacag

SEQ ID NO: 650698 - DNA, 1177 bp, Homo sapiens
cacgcgtcgcggcagctgcagcgggtcgcacggctccggcccatctcgtgggggctgggcggggggaggcgaggtgcgcgagccgagtccggggcacgatgtccgacgcgggcggcggaaagaagccgactgtgtgaccctgcagtgcaggaccctggtccggtggcctggtggctgctgacaggcatggggaaaggggccgtgtcgggggtccttcccccatggtcctgacagaacgctgatggagaaccccccgtgcgaggctgcgcctcgataaggaaaagtgggaacggaaaacgcttggaggatggactgaggcctgaaggccgcacagcacccatggctgtctcagcgctccctcagatgccacgccatcttgggacaagaccatcccactatgatggcgacatcgtttccacctgagatgtaccatgtgaccctgggaatgaaggtttcacttacttgggaagaaatgtgaatacccgcgggcaagaggcaaagaacaaatttggacacacaaggcttgcgttgcgtggattgtaagggaagaagctagaacaaggaaagggaggaccgttgaccaaagcagtccctattacagaagagagcgaattcccgcgcaacgcaaggtaccatcacatacccaaggtttgggcagattcgtttatacaagagaacggtctgtggaaaaacctggttgatccagacggcacaggagacagatcgtacacccttgggcacgcaccggggcacaacgggagccgaacgttccacccaaggagaccacaaaaataggaaagcacgcaaaaaagtaagaggcatggagcacacggaaggggagataggatgaaaacaaagcagagctaacagcgaggaacaccaacggagaccagaaacaaatgggggaatcacatcctatccaaagatagaatcgagcacaagggcgcggttaggttaagaggattcattatataaagacgcaacggtttgtgtggaatgtgcacagcgaacatgtatactggagtggaaggatgaagtggaaccatgttacaagggcacgagaaagagacacatagttgaatattaaagacaaaacgggtgctagaaagcaaaggagtactaaatgatcgacgcgcgcaagggaaacaaaaggatgggtgaattagacaagtggata

SEQ ID NO: 650699 - DNA, 233 bp, Homo sapiens
gggcccccccccccggggtttgggaatttttatgcctggataaaaggccgataatttatttcccaagggggttggttttagtaaaaggccggtaaaatgttaatggggcccatttttcccgcccttataaatatttttttcccctggtagggagcctttgttttggattttttgtttaaaggccccaaaaatgccactttttaaccccaataaaaaagaaattttttttggga

SEQ ID NO: 650700 - DNA, 410 bp, Homo sapiens
  misc_feature (7)..(7): n is a, c, g, or t
  misc_feature (26)..(26): n is a, c, g, or t
  misc_feature (119)..(119): n is a, c, g, or t
  misc_feature (163)..(163): n is a, c, g, or t
  misc_feature (166)..(166): n is a, c, g, or t
  misc_feature (355)..(355): n is a, c, g, or t
ccctgtnatgttttacccattttganggaactgtttagattccttttcccaaaagcaccctgcaccctttttatccttccccaacagcagccatagatgtttcccaatttcctgcatancctagcccaatacttattattgtctaccccaggcccaggtgtgngtnttacgcctgtaatcccagcactttgggaggccgaggtgggcagattgcttgagcccaggagtttgagaccagcctggctaacatggtgaaaccccatccctactaaagatacaaaaatgaggcgggtgtggtggtctgtgtctgtaaccccagctcctcagaggggctgaggcatcaggattgcttganccagggaggcggaggttgcagtgagccgagatggcgcactgcactccagcctggg

SEQ ID NO: 650701 - DNA, 128 bp, Homo sapiens
tggtgactctgaggatccttgtagcagcgcagcccatcaatacggtcgatcaaggccgaaccactgcactggtaggcgatgtgcgttccggcgtatggtgttgggcaaaatgtcgggtcgcggcttag

SEQ ID NO: 650702 - DNA, 458 bp, Homo sapiens
  misc_feature (375)..(375): n is a, c, g, or t
tgccaaagcgtagtacccaagagcgagggagggctgccagcacactcacctctcgccatctactcaggaggctgaggcaggagaatcacttgaacctgggaggcggaggttgcagtgaactgagatcgcaccactgcattccagcctgggcgacaaaatgagactgtctcaaaaaaaaaaagggagagtctagtgctaagtgtggggttcctacaagttggggggtaagggtaaagttgaaatcttacgttggacgagtgctgtagatgggttcctatatggtggtgatggtgattgcatgatggtgtgctggtgtctaagtatgtgaaggagtatgtgtgcctgaaaactttggtgagcaagtgcctgcatggnggggggggtgtgtgtactcggggtgggggtataagagagacagatcaggtggaagtgttggggtactacgctttggcagggta

SEQ ID NO: 650703 - DNA, 193 bp, Homo sapiens
cttacgggcacacagataggggcggggcaggctatgaccccaggccagacaaagccccacgctgtcattcacagccatagctatccctcgaacaaaacagaaagtacgaaacaaaggctgccttttaaattgctatcagatatacggatatcccgtctgatgtcagcaaggcccctgacgcccggctgtatca

SEQ ID NO: 650704 - DNA, 940 bp, Homo sapiens
gctaggactctgtggggtggagtggtgtggctgcatcagctcaggttccttgagaacgtgtccacaaaactggaattccatggtggccctgttgaggagccccgtccctgaggaatgacagagacctcttcagggagcagcaaattccagaaaagcagggaaatgttaagtggtggagccaagattgtacgcgggtcacctggttcctgagcctcttctctcaactgctgtactgctcagcctctgatgacagacagaaagaacatgaggcctcagggagttctgaaggtatcctaacatcttaacagtctccttgctggaaagaaatcttcagtggctcccattacctacggatccagcctggctttttagtccagcattcaagacctgtcaagctcttctgcatcctctcgtatgcatgtgatagacaggcactccacctagcgaagtacaacatcccaaacttattcctattacttttcttccattcattcgttcatacaatcaatcagtcatcattgaggatttattagacgataggttctggagacaaaaaggtagataaatacgacgcagtcttgccttgaggactgtatcccagataacatctgactggttgttcctgctgaaacattttccactccatgctttgatacatacttctcacctggagacctctctgcttctgacatgctttattactgtcccagtgcgtgagctcttctgaaggctttcgagttcgccttaccaccatgtggactggtggagctcaaattccacggactttggctctttgacgacctctttggagaagggggtccgtgggtcccctaacgttggggtccgatgggtacggtctcgaccgacgacgtgtccaaagcacggagagccttttttccgtgtccagagttgtttttttaacacaaaatctgttatttgt

SEQ ID NO: 650705 - DNA, 444 bp, Homo sapiens
gtggaggtgatggtccccaggccatattccccccagccccttcccctgtgggccacctcccgctgccccctgctgggtctcttcttcctttctgggtggcataacaggaagctatctcaggcttactgcctcctggtgtccacttgactcccagaaagtcacactgccctgacctgtagactggaggacattgctgtggtcacctctccccacccaggcacctcttgctagctgcctttctctagtccaggcaggcagcatgaagatcaagcatcacctgccttgggctgggggtggctggaggacaggagtgaacccggaacctgggaaggagatttccctctttttctctccctgctcatggacctcaagtcttctgttggaggtgggatgacatatggagagagtggaacattttgcaacactttttaataagccctgaaa

SEQ ID NO: 650706 - DNA, 286 bp, Homo sapiens
caggaacagcgctcatcttcattacgacgtcgctggacattgcctgaaacttgcaaactcaccctgatatcatcagggaagggtctgttatgctgcagggtgatgtacacacagtaaaaggggggctgaagttgaaccccaacttcctggaggacttcgagaaggagcctcttggcccagctcttgcccatgagctccgctaccctgggggcgattgtagctctgacatctggatttgaactccactctcatcacccacactctatattgtgggccctcacttctt

SEQ ID NO: 650707 - DNA, 476 bp, Homo sapiens
tgcattacctatggattgtgaaacgtgtcagaatctaggatgtgcactcgtgaaaatcagactttgaggcatgtctagagaccatgcagatggatagaattgttgggcagacgttagttactgcatgccttgctttcgactgtggttctaacaacggttggaccctaaggataaacttcaggatttgggaatggaaaccctccttttccctttgccctggacatcccaggtttcagggtatgttttttggggcccttttggtaaccccttggaacatttcccaagggaaaattgggggaaactagggaaaatttgtgttgaggtatttggcccccttttacggggccgaatttttcccaaacacagtcggggggaattcccgggggtgcctttgccccaggacacagggggatctttttgttgacacgggccaggcctgaggatcattgggctctgacatgacgatttgtgctggc

SEQ ID NO: 650708 - DNA, 472 bp, Homo sapiens
gacgacatagactccatccttgttcagtgtggggacagcatccgcccagacccagaagtccttggggccgccagccagctgaaagacatcttgaggcccctgagaacgtgtgactccagatttgcctatcgttacccagattgcaaatataacgataagttctgaagggctggtgtctagctggccttggggacaacacgcttggctctccattctcccagtcgggttgctgcaaggtagaaagaagcagctcttttttaaagatgagaagaaaggcacactcatttcttagggactgagaggggagttgtgagataccacgtggctgtctctgctggctgggacgtcctggcaaagcccgcggtgggcatcagaagacctgggtgtggacgctcactcaatgtctttgagcctcagtttcctctgttctccaccagactctcctgagggtgaaagaagacaccagatggag

SEQ ID NO: 650709 - DNA, 149 bp, Homo sapiens
  misc_feature (3)..(3): n is a, c, g, or t
cgnagtgcatggctggaattggcaccctccttccctttgtcactagttctctctggcagcgacgcagcctttaccagtgcactggtggcgtgctgcaatggacttgtgcgcttctagtatctgctcctccaagttccaggactcatctg

SEQ ID NO: 650710 - DNA, 839 bp, Homo sapiens
gctaaaagcccaactgggaaaggaaaagactcatatcaacatagtcgtcataggacacgtagattctgggcaagtccaccactactggccatctgatctataaatgcggaggcatcgcacaaaagcaaccattgaaaacatttgagaaggcggctgctgagcatgggacaatgggctccttcaagtatgcctgggatcttggataaactgacaagctgagcgtgaacgtggtatcaccattgatatctccttgtggaaataagagacacagcaagtactatgctgactatcatcgaagccccaggcacacaagagcactttatcaaaaacatgataacagggaaccatctcaagggctgactgtgctcgctcctgatagtagacagctggaatgtcgagtgaacttagaagactggatatctccaaagaaatgcgagcaagacacccagagcacgcatggacatctctgtgcaatacaaaaaatgagatgagaaaacaaactaatctgtacgaagattaacaaaaaagaactaccaaccggaaacacacacctacaagcacgacagaacactacgaggaaaaaggaaaacgggcaagaaagcaacacacatcacagcccaacaaggaatagaaagcaccgaaacagaccaaacaaaaacggaaaccccacacagtccactagatcaggaaaaaaggaagacaaacacaaggactagcgccgaccacaaaagcacaaccaccagcactagaggagccaaagcgagaaaagaccacacgaacacacacagcagacaggaaacagcaaaacagacccaccggagacaggacggacagccagg

SEQ ID NO: 650711 - DNA, 855 bp, Homo sapiens
tactataggaacaagacacgaaccaggtataccagtatctctaacggtctatgtatccccagaccataccccttcatgtggtgtcacccaatttgcccaactaaacttggtgtgttctctatcaagcaggtctttagtcccacgcaaaaatgggtgcactacaaccaacaaatcccgggcaatttgcgccaccacttcaccaaactccctgtggttcgttacaaccgtgtgtgtgaaaatatctcttgtgccccgccataaatatacatgttggtgcccccacacgtgtacaataagggcagctgaagttcctcgtgcccaacaatgcgatttcgcgttcatgtttcttccccaacagaaaccctcggggggaagtaaccccggagagatcgcaacccccaaggggggaaaaacacccttaccgtatcagtcgcacctccatgaggaagtctctttgtaatgtgtgtagaacacacacacagggtcgagtgcaacgaaacttagagccccttgcaattctcgcactccaccagatcatccttttgtctgacattcactaaacaaacaattggtgaggagacattaccgcaaaatttgacactagcccaaattttccctttccaatcatagaaatatatataaatccctcgacgttttcagtactgttcatgtacggaggatgtaacccaccactatgattagattacttgggggtaatcttatctcttccttgagtaagacaaaacggtccttccatacagatcaatcaacgcccgtcccccctctttattttaatataccgcggccccccttctaacaaaaaactcccaaggattttctttctcccacaaaaca

SEQ ID NO: 650712 - DNA, 82 bp, Homo sapiens
ctttgctctttggagataccgaagaccacgtgtatgccctggaactgcaattctttcttcccaaataaaacactacatttag

SEQ ID NO: 650713 - DNA, 191 bp, Homo sapiens
caagtcaaattcttagtgagccacgctccagtgctatgggtcgcagcgtgtcggagtggtagcctggtgaggaagcagctactccatggcagtgtcttgggttgaggcggttagttccagcagcggagagcactgggggtgcctcagctctgttggaggcggagttccaccatcaagtacaccacgacctc

SEQ ID NO: 650714 - DNA, 346 bp, Homo sapiens
  misc_feature (32)..(32): n is a, c, g, or t
  misc_feature (94)..(94): n is a, c, g, or t
  misc_feature (224)..(224): n is a, c, g, or t
  misc_feature (271)..(271): n is a, c, g, or t
  misc_feature (280)..(280): n is a, c, g, or t
  misc_feature (303)..(303): n is a, c, g, or t
  misc_feature (307)..(307): n is a, c, g, or t
atgcttaatgcacctgggatatcgactatccngggcgtggttgcggtgatctgaccggaaaacctgcgccgtatgtggggccacaggatgtggngctggctatcattggcgcggtgttcaaaaacggttacgtcaaaaacaaagtcatggtgttcgttggaccgggcgttaggcgctctctaccgatttccgtaacagcgttgacgtgatgaccactgaaacgncctgtttaagttctgtctggcaaaccgatgaagaagtccataactgncttgcgctncacggtcgcggccaggattactnccancttaaccctcaaccgaatggcgtactacgatgtctgcat

SEQ ID NO: 650715 - DNA, 548 bp, Homo sapiens
gcagcacttccccgcgagcggacgcggcagcgcctctgtctcgctttttcttatttttcccccctttcccctttcttttaattaccattaatctttttctcccgtacaccctataaaaaaaagaccaacggaggagattaaaccccgagacaaaggagaaaaaccgacgcggacaaaaccaacgaagaacacaaacagagccaacacaagaaagaacgagacaaaaagacaaacaaacacgacacaggaacaaagaacccaacacaagaacaaaaacaaagaagaagagacaggacaagccacaaagactacacgagacgacacacagcgccagacaaaccgaagcggcagaactcgaaaaagcgcaccaagacaacaaaaagcgaagataagccaaagcaaaccgacaaccacaaaacgacaaacagaacacacaagccgagacacacaaagggagcgagcacacaacccataaagaaagggcacgagccaggagcagagaagaagaacagcaagagcagagagagaaagaacagccaccagaaacg

SEQ ID NO: 650716 - DNA, 279 bp, Homo sapiens
cattcagtcattgttgtgctggttgtatattgagatcctatctgtagtatacctggtgccctagaccgccgaccctcgcttgacaccagtcacaactctgactctctagaacttctgaccaaccagcttcaagttggggtttccacaatcccccctttgggtttgattaatttgctagaatggctcacaaaactcaaggaaacatgtacttccatttactgatttgttataaaggatattacacgacgctatagataaagacatatactgaggaaggag

SEQ ID NO: 650717 - DNA, 249 bp, Homo sapiens
gcgcgctaccatgtgtggctaattttttgtgtttttagtagacatggggtttcaccaatgttggccaggctggtcctgaactcctgacctaaagtaattcacctgactcagcctcccaaagtgctaggattacaagcatgagccactgtgcccggtcacattttaaacatttttttgtagggatgaggtctcactctatttgcccagtctgatctcaaactccaggactccagctatctttccagctta

SEQ ID NO: 650718 - DNA, 109 bp, Homo sapiens
aagaagatttttgctgtctctggcctcatttctgatcgggaagcctcatctagcccagaggatcggaatgacagatgtgattcctgagggaggtgttgtgctctatgga

SEQ ID NO: 650719 - DNA, 498 bp, Homo sapiens
actggttacgagggtatcagacgcttctccactgtgatccgggattggggttaaaggttaacatccggtccagcaggtcaagggctatggagtctgacttggggaagaagcttggaccaagccaccttggacttggagggcagagactgttggtagtttcgggccttcatgttgatgatacaattcaggtcctcctgggatggggagcccaggatgcccagaatgtggtagagctgatccaggtagtgcttgccagggacagatgggccggttagagagcatctcagccagaatgcagcccacagaccagatgtcgatggacttggtatagcccttggagttcagcatgatctctggggcccggtaccagcgcgtagccacatactccgtcaggaagccggtgtggtcatgctcaggatcggcaatccgggccaggctgaaatcacaaatcttaaggtcgcaggtggtgttgatgagcaggttggaggggtttagatc

SEQ ID NO: 650720 - DNA, 162 bp, Homo sapiens
caaaatcagtcgaggttgaggctgcatgggaacaggtgaggccatgaccgctgagctttcccccacttgctggcacactgtatggttcagcagaagcagtcataatccccctgggaatataactccatcggaccagacaccacacccccaaccccgagctgg

SEQ ID NO: 650721 - DNA, 333 bp, Homo sapiens
ttgtgggtagctccccacgacacattctacacagctggttcagtagaggaagaccaaggcagaatggctcagtccttggagctcaagatcatgcagtgactgtgctaccatccgccatcctagaggctccccggtgcaggttctgggcttatgctggggccaggctttgtctttctctccagacttggttgtgtgcctacccgctcagggtgggagcttgtagagtgggcccagccagcaggcatggtcgttccaaggagggagaagcaggatgtgtgccccaggccttgctttctccacatccctggagaacaccctaaccacaatcaactg

SEQ ID NO: 650722 - DNA, 553 bp, Homo sapiens
cacgaggggtgtcagccacagtggaccggggctggttcttcctcagacccacctaaccgtcagaaccttggtactcgcggttgactcgaccgaccttctctcctttgttatgtcctggcttccctcctcggtttaggcctctatcaagtgtcacctcctcagagaaccttcccggaccaccctaaggtgggatttcccatccggatactcttatcggcttctctgatttgataatcaggctttctggtacttgacattattataatatgaattaatgtggcgttgggatatggtcgtgtcttccactgcaatgtaaactacttgaagcccgaggtggatttgtaatattgacggtagtgtcctccatgcctggaatggtacctggtacatggtgggcacttaatacggttgaatgcacgtagacatactgtatgactgacatttggatttctccagaggagggtctgttgtgtagtccaacacggagtgcatctgtggggtaacacgctgggctaactgccccagcagcccctgggacacccctcgtgcgggt

SEQ ID NO: 650723 - DNA, 357 bp, Homo sapiens
actgcggcccaagctactcgctacctcttcccaacaactcccttcgtggggacaaaagtgacaattgtaggcccaggacatcatgtgtcacgacctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaa

SEQ ID NO: 650724 - DNA, 1246 bp, Homo sapiens
  misc_feature (282)..(282): n is a, c, g, or t
  misc_feature (302)..(302): n is a, c, g, or t
gacccgccaacatgggccgcgtgcggaaccaaaagcgtgaagaaggcggcccggggttcatcatagaaaagtactacacgcgcctggggcaacgacttccagacgaacaagcgcgtgtgcgatggtagcatcggcattatcccgcagcaagaaaagctcggcaacaagatagcaggggtgatgtcacgcatctggatgaagcgaattcgagagaggcccagttcagaggtatctctcatcaagctgctgggaggcaggacgagcagaaagggatgaggacanattagtgatctccgtgaggntctcagtaccattggtatcatggagtactgatcgaacgtatatgatcctgcagcaatagaaggataagatgtctgaagactgtctgggagctctacggtcaagttcctggtcacaatcgcgttcagggtcaacatcagcgcatagagtaggagactgacattcttgaaaatggctcgggcgacctggttttgaactgttgtttctgttagtagcgtagtaattaattattgcaaatgaatagtctgggtgacgatagaagataaaaacaccaggaaagacaattgatcaggggggggcactacttgagtgcccgggggagcgacagaaaagaccaagaaaagcgaagggccacatttttgggggcacttctggtgcacttggtacccttgggtgttttccttggaaccgcaagtgtgactctcggcaatcctactgggggagcattacctcttggggaggagttcaaaccctaactaagaataggacgggaatgttggaaattgtgtttaaataaaaagcccagggagtgtggagtcggaggccgatcttgatgaagaaggggcgggcaaaaaaaagggggcgttggaggttgtaggcccccgggaagagggcttgggggggttgggggccgaaagtaattcctacttttcggaaaagggcgtcgcatacttcttttaaaagggcacgggaactttaaggaaagcctttttcgttgaatgaccccaaggcggaatgtttctttgaaaagggggcgccccttttgggtaaaaggtaaattaggggggtttccatgggccataaaagagcatattaccctttccaaggcaaaatagggggaaagtttttctttaaaatatattcttaaacaaaggcctttgggacccaaactgtgggaacattaacagagtattatggattgcaaaaaaaagaataataagtaact

SEQ ID NO: 650725 - DNA, 283 bp, Homo sapiens
cgtaggctgggtgcggcggtcatgcctacttgggaggctgaggtgggtgaatcacgaggtcaggagtttgagaccagcctgtgccaacatggcgaaactcctgtctctactaaaaatacaaaaaattagctgggcatagtggtgggtgcctgtaatcccagctacttgggaggctgaggcgggagaatcgcttgaacccgggaggcaaaggttgcagtgagctgagatcgcgccattgggagtctgagagagaaagagagagagagagagacaaagggaaaca

SEQ ID NO: 650726 - DNA, 447 bp, Homo sapiens
gtactgataagggtgttcactatgtagtccaagctggtctcgaactcctggactgaagggatctcctgccttagactgataaagtgttgagattataggcatgggccactgtgcctggctcaatgtagctttttttttttggggaaataaattctcgtcaggtggcccaggtggtattgcatgggcacaatgtgggctcactaaaatttccacctcgcgggtttcaaccaacccttcctgcctcagcggcccaattagttggggaccacgggctcttgcgacaaggcggggctatttttggctttttatatgggagagggggtttacaccatgtgggccaggcgtgtctcaaactctgtgaccccaggtattctgaccacctcggcgtcccaaagtgctaggataatgggtgtgagacactgcacctttatgcttaaaaaatttggg

SEQ ID NO: 650727 - DNA, 226 bp, Homo sapiens
tcttgagttgagagtcgtcgagaaaagagtagagatcgaatccatgctctcagttcagcagcaagtgcgtttgcagctgtcagctacttgtctcatacatgacgtcgctgcagacacttcggtgcagttcactttgggtccatcagatcgagagagcttgtcagttgaggaaactgtcgctgaaagcaggagaagagacacgtcgactctgagggtaccgagctcg

SEQ ID NO: 650728 - DNA, 150 bp, Homo sapiens
tgtcctggttgtgttgacttcaaattatgtgtcgtttggaaagtcactgtcagatgttagtaatataattgtagggacgattagttttagcattggagtaggtttaggttatgtacgttgtctagagccatatgccaatgttgcgtgtga

SEQ ID NO: 650729 - DNA, 282 bp, Homo sapiens
acccgtattgagcagtattgtgataggccaaggcgggagggtaacgagaatgcatctctacaaaaataaaaataaaaaagttagctggacgtggtggtgcatgcctgtggtcccagctactcgggaggctgaggcaggaggcttgcttaagcccaagagattgaggctgcagtaacctgggattgtgccacttaactccagcctgggcaacacagtgagatcctgtctctcaaaaaaaataataataataacaataacatacacacaagcacaatcctggct

SEQ ID NO: 650730 - DNA, 132 bp, Homo sapiens
ctccctgcttagatacactgacctggcagcgggatggggaggccagacccatgtgacacggtgctcgtggagaccagtgcctgcagggatggaaccttccagaatgtgggcggctgtggtggtgccttctgg

SEQ ID NO: 650731 - DNA, 438 bp, Homo sapiens
cacatgatggttgatccatgtttactgtccacacgaagggctattgaatcattcttattgcttccacgattcctctccagcaactgttgtttcctgactttttattgatcgccatgctaactggtgtgagatggtatctcattgtggttatgattagcatttctctgatggccagtgatggtgagcattttttcatgtgtctttgggctgtataaatgtcttcttttgagaagtgtctgttcatatccttcgcctacttgttgatggggttgtaagttatttccttgtaaatttgttcgcagttcattgtagattctggatattagccctttgtcagatgaatagattgtgaaaattttctcccatcctgtaggttgcttgtacactctgactggtagtttcttttgctgtgcagaagctctttagtttaattagatc

SEQ ID NO: 650732 - DNA, 259 bp, Homo sapiens
  misc_feature (67)..(67): n is a, c, g, or t
  misc_feature (88)..(88): n is a, c, g, or t
  misc_feature (117)..(117): n is a, c, g, or t
  misc_feature (221)..(221): n is a, c, g, or t
  misc_feature (248)..(248): n is a, c, g, or t
attcgcccagatcaattggcaactacggccgcctgttggacacagttcctttggtttatgagttttntggccactgagggcaaaagtntcttttaaaattgcccctttaggccaggntctgctgacataattgctctagtcagtctcttgccttctgctatggtctttcttcccttctaccttttttttctggatagcccaatgtgtccgtctaccaacantggagcctttgggtgtcactgtttttnccctggttttt

SEQ ID NO: 650733 - DNA, 265 bp, Homo sapiens
tggaaagggggtttcccctcctgtgtgtgtggcccagcctctccacccccgggtgggggccagatatagagacctctccactctctctcagaaaaaacacaaacacaaaacacacacaactctctagcacacaaaaaaggagaattttgtgacacagaaatgtgtgtaagagggggttctcattatcaacacacaaggtgtgtgagagagacatgtgggtgtgtgtgtgtgtcgccgtgggggtgtatgcaccttttttatacct

SEQ ID NO: 650734 - DNA, 175 bp, Homo sapiens
gatctgatatgtagtgtataatgacttgttggttgattgtagatttgtgctagttaattgtcagttcagatgttttaatctgacgcatgcttattcggaggacaatgttttcatgttacttatattaactcttgttcttctagtaggttgactagattgctccctgttggggctt

SEQ ID NO: 650735 - DNA, 517 bp, Homo sapiens
cagctatacgcgattgatacctggataactgcaagatcgtcaagatctggacgactgtagaataaagattgcctgtgaggctcacttatgtctgtgaagatgggaaaacaatagaagaacattgttctactacaaggattataggtcatcaatgcattatcatttgagatatggttacactccttacgtgagcaacgatctacacacttaattaaaagatgagagaagagtatgacaaaattcagattgctgacttgatggaagaaaagttccgaggtgatgctggttagggcaaactaataaaaattttcgaagatataccaacgcttgaagacctggctgaaactcttaaaaaagaaaagttcaaagtaaaaggaccagccctatcaagaaagaggaagaaggaagtggatgctacttcacctgcaccctccacaagcagcactgtcaaaactgaaggagcagaggcaactcctggagctcagaaaagacaaaatcaacccaagaaaggctggac

SEQ ID NO: 650736 - DNA, 987 bp, Homo sapiens
gtgaactttagcgtgtcggccttgagtcctcactcttcgattccttgtaagaccctggtgcatgcttatcaagagggcccagtgattttgtaggatcccacatgtcctgtgacaatgggttcctgtcctatgatttcccacctcccaggatttcggactcaaggttcaaggcgaagtcacacgtcctccctgtattgacgaaatgagagtacgacacgatatgggcttgagagcaacagtctccgtagtgcgtccgtttcttaccaagagcctccagttcgcccatcgccctcggtctccctggtcagcgtcattggcgacatccattggagcgtaattacagggtctgggtctcgcctagggtgcttgacgagtcacggccttggacctacccgtagccccatccgccctgtggccttcctagtctcttgaccttcagggggagcctcaggctcgttgaatcgacacgatctctattgtatcagccttagacaagcgcaggcgcatagacgccccttggaagggtgccctggctcaaaggccctcagtgcccaggcgcacacgttggcaagggcccacgtgtttgacagggttcgtttgagtgtgtccagtcaccgtgcaaacgctcttatggcatgggcggcgcagaaacggttccagcaggggcaacttttggacggtcgagaaatcgcgtagcttgacgccaactacttccgaatacctacataagcacctttttcctctcgccttcgcgcccgggtgcgcaatcgcttcaagcatcccatgaaaatttttcagctcaccaacgccagggacgaggaaaacgctcacggttggtattgaacagaagaatttttccgagaggatccccttggggattcggaaatgcccacagtaacaaaagacccggggtacaagacagggaaggcttaagttggccgtaaacagcccggaccaaagcgttgtttaaccaagcctggtgttggt

SEQ ID NO: 650737 - DNA, 642 bp, Homo sapiens
  misc_feature (26)..(26): n is a, c, g, or t
  misc_feature (61)..(61): n is a, c, g, or t
  misc_feature (63)..(63): n is a, c, g, or t
  misc_feature (85)..(85): n is a, c, g, or t
  misc_feature (87)..(87): n is a, c, g, or t
  misc_feature (111)..(111): n is a, c, g, or t
  misc_feature (146)..(146): n is a, c, g, or t
  misc_feature (163)..(163): n is a, c, g, or t
  misc_feature (177)..(177): n is a, c, g, or t
  misc_feature (179)..(179): n is a, c, g, or t
  misc_feature (192)..(192): n is a, c, g, or t
  misc_feature (196)..(196): n is a, c, g, or t
  misc_feature (198)..(199): n is a, c, g, or t
  misc_feature (201)..(202): n is a, c, g, or t
  misc_feature (285)..(285): n is a, c, g, or t
  misc_feature (452)..(452): n is a, c, g, or t
  misc_feature (463)..(463): n is a, c, g, or t
  misc_feature (465)..(465): n is a, c, g, or t
  misc_feature (478)..(478): n is a, c, g, or t
  misc_feature (480)..(480): n is a, c, g, or t
  misc_feature (484)..(484): n is a, c, g, or t
  misc_feature (489)..(489): n is a, c, g, or t
  misc_feature (641)..(641): n is a, c, g, or t
tgagcttgggacctcgacccgttcantttcagctacgaagaagccactgctgagtgtggtntnggggggggcccggaggcagttntnggcacccgggaacgtgctcaggcntcggtggggccgggcaggcagggcgggagctagcntgaaggcgcccgggttntgctgcagcgcatntngcaccacgttttntttntnntnntggcagagggagcacgtggggtagacgagccgctgcagggaagggaaagtgagcgcgtggcacagggttcgctgttggaaccntgccagggcatgcagacgcaccgggctaggtgtgcctgccccgggctcttccagctgtttgttcggcatatccgagccactgcaggaaggatccagcaggatgtagtggacctcatggtagcgtggatccgagggggagaccgccaggaagtcctcctcagccagtncacagcaaganangccagcccgggcnancagngtggncatggatgccagccgcttggcatccaggtcaaaggcaaagatcttcccttggttcttcagaagagcagccaagtgactggtcttattgcctggggcggcacaggcatcgatgacatgggagcctggcggggggtcagcagcatggctgggana

SEQ ID NO: 650738 - DNA, 682 bp, Homo sapiens
gctggaaacattaactaagaggggcgaagtccggacgatttaaaccctcctctccacgtatgggctcatagaactgggccctgccaggaaacgaacctgcaacagctgacaacatgaccaaaaacaccggcacaacaaagaagaaaaggcaccaaaagttttaaaacaagagtaaaaccggcgtttttttcggagggggggcgcccaaaaaaaccaccaacataaaaaaaaatataagaaataattaaataaacatcatacccccccaaccacgagttgtcaacccctcccctcccccccgccccccaacctcttttcatactgtgtaatatcctctatccttccctcacataaccaaatctctccccgcgacccgcccccgccccccgtccccccccccccacccgcccccccttcttccctctgcgcccccctctcctcccgccttcctttctcctgctctcactccccacccggcggcgaccgaattattcgctccttcttccctttcttttcgacctgttatttctactccacacacttcactgcttccttcgtacttctcttcctcccctctgctccccccctcccctccctctcccccccctccccctatccccccccttcttatttcctctatttttttcccctgccgtactgattccgtaacaaaataaaaaaa

SEQ ID NO: 650739 - DNA, 1484 bp, Homo sapiens
  misc_feature (935)..(935): n is a, c, g, or t
ggagagaactagtctcgagttttttgtgttttttttttgtggggaatgaaaaattaactttttttctttgggggggggcgggccgttgtccagccctcgaaaatttcgtggcagcggtgtttctggggtgccggacgtgctgggtgaccttgtgccgtgttgagacgcgcatggttttggctgcaagaggtcgcggaactcgccctctggtgatcgatgtcgccgatctggcctttccgcatgatagcgggggggacggggtgcttcggcacgttgttctcttgtggggcccgcctttctcgagagcgcggattgatcctcttggcgcgatttgtttgtgtgccgaaatgataggtcctgcgggcgcgattgccccggagtgggctcctctcgtgggatcttgtctcgactcttgtggtttccacctcccgcggctccatagatggggggcattctcctacgcgctctcgacagtgtgtggccgactctcttttccccgcgtttgaaacgaggggggccttctttatgtgtgtgtcggcgaggtggttggtgtgtgcccccctcgaaatattaaggcgcctaccctgtggggggggcgtgttgttttgttgtgaacgcgcgcctagacacgcggatgtgtcttccttctggtgtgatggtcccaccccggggtgggggagcactatctctctcactgtttggccgagtgtattgtctctccccccgagggaggagtgggcaccccctctctgtttctgtgtggtgtttgtggggaacagagacaagtgtgtctccgggcctgttgctttatgtggtcgcgtgaggtggcccacccgccttctacgaaggctccgcgtggaaatgtgttctcccggcgccaaggtgtgttgtgccacatgtcttgttggccaaggagtctccgcggtgggagaggncctcctccacagaagagggtgggctgtgttcgcagggcacggcacgaggaaatagccctcacggctggaaagcacgagggtcgagaggaggactcccccgcgaagcagcggcccctccccgggggacgagaagggggggcgcccacacaaaaagaagaagctcggcgagaagatgagaacactcccgcgcggggtggcgtcccaccatccaataaaaagtgagcgagaagagacgatccgccgaggaaaagccgtgggtggacaccccacagagccactggagaggtcacccccccagaggaggggcagcctcttcctccccacaagtgttgttgttccccgccgaggggaggaagagagaaacgcccccccgccaagggtctcgggtggtggaaccaaccaaccaccgagagagctccccctgtgtgaggtgtcttgtgggaccacaagactggtgtggttgacgaacacccccacattcgcgcggcgcgcggcgcggctggattatcccccctccggaaagtgtgtccaccaaaaccctctcccgtt

SEQ ID NO: 650740 - DNA, 253 bp, Homo sapiens
ctaaattgcacaatcttagtcagccttcgatttacttttcctatctactgaatcacagcaatgcccattgcgctatctctgaacgcgtaactcgcatcttagtgtcggtatttctccaaattacgcagctgtttggaattgaacgctcccctttcttttttgtctttataactgaactgcatcttcgtacttcattcacattcaatcaaagcaagtgctaccagcacaggtgcccttcccaatcctgcaacac

SEQ ID NO: 650741 - DNA, 750 bp, Homo sapiens
  misc_feature (482)..(482): n is a, c, g, or t
  misc_feature (535)..(535): n is a, c, g, or t
  misc_feature (538)..(538): n is a, c, g, or t
  misc_feature (557)..(557): n is a, c, g, or t
  misc_feature (570)..(570): n is a, c, g, or t
  misc_feature (582)..(582): n is a, c, g, or t
  misc_feature (587)..(587): n is a, c, g, or t
  misc_feature (590)..(590): n is a, c, g, or t
  misc_feature (595)..(595): n is a, c, g, or t
  misc_feature (610)..(610): n is a, c, g, or t
  misc_feature (637)..(637): n is a, c, g, or t
  misc_feature (646)..(647): n is a, c, g, or t
  misc_feature (651)..(651): n is a, c, g, or t
  misc_feature (666)..(666): n is a, c, g, or t
  misc_feature (670)..(670): n is a, c, g, or t
gctgactgtggatttagacgggagccgaagatcaaaagtctgatatgagagagagctgagctgagatgcgggacacctccaggctgctacaaaattcttccaagaagatagaaattccagagcagaatccaagtaaggctcgcacatgaacggttacgagaagttctcgcgcaggagactagcttgtccagatggaggagctgaaccgagctggcggtgtaaggatcgcatggtgatagatcggcagtcgctggcagcgcatctcccagagccagaaggagcacgtacaagaatagctgggcctgcaggcagtcagccaacaagtcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagnccgaggaggatgatgaagaggatgaggatgacgaggacgaggatgaagaagangangatgatgagaatggggacncctctgaagatgncggcgactcctntgagnccngcagngaggacgagagcgangatggggatgagaatgaagaggatgangaggacgannacgncgacgaggatgacgntgangatgaagataatgagtccgagggcagcagccccaggctcctcctcctcacggcgactcctcagactctgactccaactga

SEQ ID NO: 650742 - DNA, 416 bp, Homo sapiens
tcgtcacgctgtgactacatctgtagtctcagctactctggagtctgaggcaggaggatggctacagttcgtggaggttacggctgcatgaagctgtgatggtgccactgtcctccagtctgggtgacagcaggatccctgtttaagaaagatggtgtcagtaattacatcatcagtcacatcattctgtacaccatcagttcagtacaccatttgtcaccgtctgtctggtagctgttgtactaataaattataaccatacacaacactaaaggatgaacctgatctcttatactaatatccttcctcatgtatattgccacaactttcctcctcggactcctgtctcactcatatacatctagcagccaactatctataaacctagccatggccttccccttatgagcgggctc

SEQ ID NO: 650743 - DNA, 923 bp, Homo sapiens
taaacggtatatacgggttaaatccaggtcaaaggtagtttacaaggggaaaggacaagtaccttggtatagaatatacagacacagcatcacaccacagggcccagcgggagggttcggggagacagacacttttttcccgtgggaaaggcagctctaattcccaggaagtggttctcagcagaggcgtgggttggccaggagcacgtgtcctcatagcccccctaactcagcctcgtgctacagctcggttcccatttccggcctctaaccccccaaactccttataaagagccccatgagctaagaactaaggagaaggatctatgtccctattggggcgtgtgccccaatgtcggggcagaagaatatatcacaccactgacgcaccgagcacagtggcgaaagggaagggaccaccacaaggagaagaagcagaaggcgaggtaccccaagaagggggagtgggccgaagctcccaagccaacccgtgaaaggaggcgcagctaccagggggtcctacacaaaagacgaaagaaacatcgattacaacccaaacgggggcgagggcgcacagcgataaaaggggccagaggcaagatgtggctccgcagtgtacaataccacccaacaacacctagacaaacacacaataccaaccgggccccatacataataccacaagtaatgcctatcagccaaccgagaggcagataagagacaaatgcgacgggaacctagcacagcggaagaggaacacaaaattggaggagcgagagaaatcctaagcaaacgcgcggtggcccccacaacaaagctccgctcccccaggcgacaagtggggtaacaaaaaacaaaacgggggcagcaaaacaaaatcatctacaaacagacagcacggacgacaagacccccacaaagac

SEQ ID NO: 650744 - DNA, 110 bp, Homo sapiens
aggatgtcgatgcgagtgcatgacgccgtcgcgctcggcgctccgtctgccgcgcgggccgtacatgccgaccgcatgcacctcgtcgacataggtcatcgccttgtagc

SEQ ID NO: 650745 - DNA, 648 bp, Homo sapiens
ccagatcttaggatagtccgttgatagccaccttaggacacaggatggtgccattgatggggtggtgtatctaggtgtcccaggcactgggtagagcaacctggtccacgtggagtttcttccagggaagccctgttgaaccccggaggtggatgcccaggcaagggccccatgtggccagaaggcccaagtacacggcccagaatttgggggttggggaaaatggcttccccacctattgggagtgaacgaggcgaagacgggaagcccttgctgcctgccattcccagagcgcccacgccctttgtgctcaaccctggttccaactggtctcgcaaagtcacctgcctaccaatgtaccaaaggcgaaggttctgatggctgccttgctccttggtcccccagccccctgtgaggacttctctaggaagtccttcctgagctacctgtgccccgagtgcccctacactgagactgtatgccctgctatcagatgcccgatctatgtgtctgtctgtgtgtccactcccgccgaccccccacgagctaacctcccggcatggactgaatctggttctcctcttgtacacccctcaaccctatgcaccctggagtgggcatccataaaatgaactcgtcgactgacca

SEQ ID NO: 650746 - DNA, 81 bp, Homo sapiens
ctagaagattcagcaaagtacttttgtgctcttgggtgtccctgggggacattcgtaacctgggacacccgacagatgttt

SEQ ID NO: 650747 - DNA, 855 bp, Homo sapiens
ggcggagcactctgcgcccgcggatgacaccttcgctcgcagtttgttcgcagtttactcgaacaccagtttgccccaacgcgctttggattagtgtgatctcagctcaatggcaacggtgggatatcatggcatctatctggagttggacaccgaggaacagtaagagattatccagactttgagcccatcagtggatgctgaagctgttcagaaagctagtccgaggaattggaacctgatgacgaaaatgctcagtcagcattctgacttggagaggtcaaattgcaccagcggcaagtcgtgaatgcgttcaacggacattatcaacgcacgcgatagtggaaaacggacgctggaaacgatgaacttgacagcggttgatcgtctctggaccaactttgcagcagtctcatgcgtggacccatagttgactttccatccgagcaagtctcctgattgcataacgcaagcctatccgcaacatcccatgcaagcgggcgccggtgacaccaaccacgcacagattgcccttgattcggacccttcttacacctaacccagggaaccaacgcaagggccaccatgcagggcgcattactcgtcctccaaaggcctaattaagtacaccagtcatacgcaagcacgcagctctttgccgagcattgaccattcacgtgtcccggaaacacccattctcggcgttgcaacttttccctgcgacaacagcctccatgctgtggacgcttatgggcccacgcaccgcgcccaagaaagaacacattgaccaacgttcttggcacacggtgcgaattgcagccattcttgcggcccaaaaccacaagcatgccccag

SEQ ID NO: 650748 - DNA, 437 bp, Homo sapiens
  misc_feature (353)..(353): n is a, c, g, or t
  misc_feature (368)..(368): n is a, c, g, or t
  misc_feature (413)..(413): n is a, c, g, or t
acaggacagtttcccagcatgttcctttctcttaagatttggtagattctgcacatgtgcacacatgtgtacacacacacacacacacgcacaatctttcccccaagagtcacagctcagtgactgttaaagtgacgtacacagtgtagctgttaaattaaacttgttgggatgagttcctaggttggcagagtaaagactctgaggtgacctgcagggaagcacactactgaacttgcttaaaccagtgttttccagatttatctgaccacagaacttccttcttttcccatgaaattattggggaaataaaattattgggataatgggcaaacatagtttgagagacactntgaaagctgtttctngaacagctttcaaagtgactggctgaattattcctagcaaatccnactctccatctgctattttattcc

SEQ ID NO: 650749 - DNA, 744 bp, Homo sapiens
  misc_feature (340)..(340): n is a, c, g, or t
  misc_feature (362)..(362): n is a, c, g, or t
  misc_feature (502)..(502): n is a, c, g, or t
ggcggaaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaactaaaatctagggatccaatcagatgcagagaatgtggatacagcaataatgtacaagaaacaggcactaaaagcattggctcgtcttttgatgctcgcatgaatgctgggaattcagcaggaatgtcttcacttatactgtggatttgctctcttcccattttctgactngttgtataggcttctcgatttnggcttacagtagttcccccttatcttcgggagatacattccaaggcccccagtgaactcctgaaacctcaaacagtaccaaacctttatacactggtattttccatatatatatacctatgataaagtataatgtataanttaagcatagcaagagattaagtaataatgtaatagaacaatgattatcttactataatagaagttatgtgaatgtggttggtctctcttgctttcaaatatcttcgttgtacagtactcacctattttagaatgtggttgactacaggtaaccaaaaccacagaaagggaaactttggatgaggggggcactactgtacttaggaataccactatttcctatgatttattttaaagaccat

SEQ ID NO: 650750 - DNA, 835 bp, Homo sapiens
agcgggggtcggatctcggagctgctgcttctggttctcttgtggccgccgtcgctgtcccggtctgccttgtgtcctgccggaagtagacagaggctgtgggccacagcatcctcagtagagccgacgcaggctctgacatcagtgggccagtgcatgcgtacgcggtgaggcgatcagcgtgtcaggagaggcgccgcgcgggcaggctgcggctggtcagccacacgggcgagagacgcgtgggctgcgcggtcacgcctgctgtgtcggtgccggccctgtggacattgtcgattgctctgaccggctgattgccggcttgtccccgtgcggtcgggggactggagctgaccgcgagcgtctgtggcagattcgtagtgatcgcctgatgaagtatctccttcttggctgccgttctgcaaggtggcctcacagaacgtctacatattccactgtttgacatgactgagcatgcatggagtttcaccaatatttccactatcaaagagtggccggaaggatctattgtctcgctcgagtctcatcagttccgtccgacatgtacctattctaacaggtgtccatgcgtgctattccttacagtatgactagccttcttgattgcatgcacggtttacgtccccctgaggagaacgcggtcataaaccaaacttccaaggcgactcgtcgagtgagactttctcgtggtgactgaactttttcagagcagcgtcaggaatctcgggacgccggggagattgagcattgcaggagcgaagaccttgtctgctcctgatttcactcaggaaacgtgctccgggggaagaaggcc

SEQ ID NO: 650751 - DNA, 853 bp, Homo sapiens
ggcgtcaaagtatttagctgactcgccacactccacggaagcatatatgaaatgatctgctgcagatgcctctgagcccctaggattcatctttcttttctaccgtaggtggccctgtagtggaagattgtgattagcaaatctcatccatcggtagacgatcggtactacacggacgacgtactacgataggtaagcatcactgtcccactatgtcctatcaataaggagctgtatttgccatcataggaggcttcattcgactggatttcccctgattctcaaggctataccctagacatagaccttatgccaagaatccatttgactaatcatattcatcggcagtaaagtctaacatttcattcccacaatcatctatactcggcgcgtagtccaggaatgccccgagctgttacctcggacgtaccccggagtgcatacgatcggcaggatgaagagcgatcctatcagtcgtgtaggctcaatcccggatttctctagacagcaagtagtatgaataactttccatgattttgaagaaggccttcgcttcgaagcgaaaagtcctaatagtatgaaagaatccctccataatagcctggggagtgtgactataatggattgcccccaccagccatagcacaagattccgaaagaaaccccggtatacattatgaatctagatcctaaagaagcgaaggagatcggaaaccgcgcgcaaaagctgggttatcaaagccagacccccatgggccttccatggactttgtgtcaaaagaacctaacgggcttggacagcaaaaataggagcggttctttggaccgcctgggccctaaaaaaatttaaaca

SEQ ID NO: 650752 - DNA, 527 bp, Homo sapiens
  misc_feature (77)..(77): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (86)..(86): n is a, c, g, or t
  misc_feature (90)..(90): n is a, c, g, or t
gtaaaagttactgcctatgctttttaccttaggcttacagaattaaataaaaattagccattccagaaatataaaananaanananaaanaaaaaaaaaaaaaaaaaaaaaaaaaaaaaaaaaaaaaaaaaaaagaagggggggcgcgtcacagatacatcagaggaggacgaaaagaaaaagagaggcaaccacaagaatttacttgagacaaaaagagggaggcgccctatcaaggagaggagagcgacaactctaaaaacaaacaaaagagagcagaggaagaaagcagagtgaaacaacaaggcacacgaacaggaggagaaaacaacagcgggagcacaagagagaagagaccctcattggtgagaaaggaggagagcaccgcttataatcagagagggaggcgtggacgcgaaaacaacaggtggagcgaacaacaacacaacacccatcaccgcgagcaaattatgacaagaccttctaggggagagaacaaacaaaaacacacacaactgaaggaaagg

SEQ ID NO: 650753 - DNA, 264 bp, Homo sapiens
tgacgtcacccaatcaacctctatgctttcttcttaaaaaaaaaaaaaaaggaaaaaggaaaaaaaaagggaaacccaaaacccctgttgtctgtttgtgcccaaccccttccaccaaaaaagctattctaggtatgaaaccccactttgtttgtacccatcaaaaatattaataataaccgggacagttaacaatcgtgggtttccttcacaacagggcctttttgggaaacgagaaaagggccagtcacgcgtttcccactg

SEQ ID NO: 650754 - DNA, 379 bp, Homo sapiens
tataggatccccagatatctattgatattgagctggatgaaaagttagtgtttactaaacagagatctgtgcagaatttacatagtatccattcatagaatggtcgatacacgtatatgcctattgtatggaatagttccatttatcaagtaatatacgtcacaaagtcttttgacgttcaccagactgtccattaatacacctctgaaaaagtggcatttaatttcagcgactatattttacagcattaagacgcttatgcatcagggtgcttctctgcacaatggcattgagcagacagagctgagtccattatcccacccagattcacatggtcacatttgagagctttataccagaaagcagggacagttactgc

SEQ ID NO: 650755 - DNA, 121 bp, Homo sapiens
ccactgcgctctgcgatatctacattatttaaagactttaatacgagaatatagtgcagataaatatcttcgttcattttattggtttattttttatggttttgagacggagttttactct

SEQ ID NO: 650756 - DNA, 299 bp, Homo sapiens
aaaaccccccccttttttttttaggggaaagggcccgttcttttcccagttccccccgggggggggaaagccttggttttgggttaaatttttaaagccaaattttttttattttccccccaaaaatttttttttttgtttttttttgaaaaaagggcctttgggcccccccttccccctttttttttcccccactttaaaaggtttaagggtttttgtttccctggggggggggggggggcacccggggtttccttttccctttttttgggcccgttttattaaaggggcccccttta

SEQ ID NO: 650757 - DNA, 273 bp, Homo sapiens
gctcctgtgaggctgcagtgcagagcccagtgggagcatctcgtatagcacagcaatggtatgtccatccccctagtgctccacttgctcccatagaagactttagcccaagaagaactgtctgacctgaattctgcagcacagtcttggccatcggatgggggtgatctgacctgaacactccttggtttactggcctctccagtatcccaactgagccacgcctgcttgcagtgcagccttgggtgccctggtggcccacatcacagctcc

SEQ ID NO: 650758 - DNA, 730 bp, Homo sapiens
gcattgctttcgtgtaaattatgtaatgctatcacctcccctgtgtggacttaatgattgatagttagtttatttagaatgatgagccttcgtgcaccccttcgccttgtcccccaacttgatatgtatgaaggcttgctctccctggagtgggtgaatgtgcatggttactgtcatgactgaacagtgaatagacgtgccccaccttagaaaaaccaccaaaacacaccacacgaccaaaccccaacaacggacggcgcccacgactcacacacccccacagcacggagccgacacgcacacaccagccacacccgcctgcagccacacgccgccccccccgcacccccgcccattcgacactctcaacccccaccccacctcgcgccccacctgcaaacggacaaccacccatcgaccgaaaaacgagcgagaccagcactcgagcacaccacctgagcgcaagccgaaccacaacaccaacacatggaggcagacagccccccacacgcgggtcaacatacacaccacacacgcgcaagcataccagcccctccgcggcacacaaacacaacacgaaccaaaacagaagacaacacaccggcggtaccccacacaccacccacgcactaccagctacccacggctacaccaaccaacgacgcgtcacaactgcgcaactcagacgcccacgacaacaccaccaaaccccacggacctccgcaacaac

SEQ ID NO: 650759 - DNA, 612 bp, Homo sapiens
ctctctctctctctctctctatctgtctctctctgtctctctctggctccataggcttttgattccatctatcctgctatctcttgtgtgctgatgtcaagttctggattggcttcagctgtgctaatatgaagggcgctgtctgttcaagcaatcttaaaaggcggtcaatcaaaaggccacagtctgaatcccttatgcggctgaaataattcgaggatcaagtccagtgtctagttaatccctgttctactgtgccagacactatctggcatgctgtaatatgttcaggttcaaaatcgctctttcataccaggggatgatagtaacgagtcacttgcaatggatcccttcatcttagttacaagatgatcactctagttaggacaaaatatacattgaataaagtaacgtttccaagtttacagaggaaaaatcagcagatctctgcctgctgtcgcgagagttagcactgggcaatagaatatatctactcctacacgagtctgtcagtatgtcatcactgaagaccggatgataggcacaccgaatgtccctcgtcattcattgtgcactacgtgatagagatgaagatcgttttggcctgccccc

SEQ ID NO: 650760 - DNA, 494 bp, Homo sapiens
  misc_feature (22)..(22): n is a, c, g, or t
  misc_feature (48)..(48): n is a, c, g, or t
  misc_feature (87)..(87): n is a, c, g, or t
  misc_feature (94)..(94): n is a, c, g, or t
  misc_feature (118)..(118): n is a, c, g, or t
  misc_feature (126)..(126): n is a, c, g, or t
  misc_feature (145)..(145): n is a, c, g, or t
  misc_feature (147)..(147): n is a, c, g, or t
  misc_feature (198)..(198): n is a, c, g, or t
  misc_feature (220)..(220): n is a, c, g, or t
  misc_feature (228)..(228): n is a, c, g, or t
  misc_feature (237)..(237): n is a, c, g, or t
  misc_feature (256)..(256): n is a, c, g, or t
  misc_feature (260)..(260): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (302)..(302): n is a, c, g, or t
  misc_feature (311)..(311): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (353)..(353): n is a, c, g, or t
  misc_feature (363)..(363): n is a, c, g, or t
  misc_feature (372)..(372): n is a, c, g, or t
  misc_feature (397)..(397): n is a, c, g, or t
  misc_feature (407)..(407): n is a, c, g, or t
  misc_feature (415)..(415): n is a, c, g, or t
tcctgtcccaacactttttaanacagttgaatggataaaaacatgganacaaacacatggatatagggatcattgaagcagtgtganaaaaaanaacatctatatatacaacactccnctgcaaanaacaaatgtaaagtaaaananacccaacaaatcattttgtttatcttgctatcatttcttaatctataacgnctccctcccatgtatccatgcnagggagcngtttcagcngcccgactagaggggagcncccncccttggggtacttttttttttttttttttttgtngngananagtctcacnctgtcgcccaggntanagtgctggggggcaggggggnaatcncagcccaccncaacccccnccccccgagttcaagcaattctccngcctctgccncccaagtngccgggaccccaggggggtgccgccacacctggccaatttcttttttattttagtagagacagggtttcaccatgttgc

SEQ ID NO: 650761 - DNA, 596 bp, Homo sapiens
  misc_feature (29)..(29): n is a, c, g, or t
  misc_feature (157)..(157): n is a, c, g, or t
  misc_feature (184)..(184): n is a, c, g, or t
  misc_feature (270)..(271): n is a, c, g, or t
  misc_feature (493)..(493): n is a, c, g, or t
  misc_feature (583)..(583): n is a, c, g, or t
caggtataaccaataaaattggataagangaatttgggggagaaaagtaaatgaaaatgtgtaaaaccccaagaacagactgtaccataatcccgagtaaaaaagtaacaagagaaacaaacccaagactaaatcaaaaccaatggaaagtaaaaanagcaaaacccgggggggaaggaagacnaaaaaaaaagcaaaaaaaagagtaaggggaaacaacagaaagagggaaaaggggaaacagtaacaaaaaaaaggaaacaagaatcnnaaaaaccccaggaaaaaaagcaacccggggaaacccaagcaagaaaagccagagcccaccagggaaaccgcaggggaaaaagagcccgggcccccgcccggggaaagggaaaagaaacaaaaggaaaagggcaaaagacccaaaaacaaccccccacccagcaaaagaaaccaaaagggaaggggggaagcaaaagaaagagaggcaaaagaaaaacaaaanaggccccacacgcagcaccgggcgcaaccgagagacagggcaagagagaaagaagagccggagagagaaggtgccggaaggccagccgangccaatcccctcc

SEQ ID NO: 650762 - DNA, 266 bp, Homo sapiens
tcaaactgcttaatacatcttaaataacagtacagttcaatatagtatctatcttgcatccagcttcctggcagtacactgagctttgaaattaaagtacataaggtggaaaggggtaagggtgcatagagctctacagagttgttggacggaaagaggagagtgggccacataactgcatactgcacccggaaagaggagagtgggtttttttttgggttttttttttttttttttttttttttttttttttttttttttttttt

SEQ ID NO: 650763 - DNA, 139 bp, Homo sapiens
tgtatatgtgttctttgtctctgcaaactcactgcatctgttatttttgactttttaattatagccattctgactagtgtgagatggtatgtcattgtggtttgattgcatttctctaatgagtacaacctgccggtgg

SEQ ID NO: 650764 - DNA, 443 bp, Homo sapiens
tatttgataaagatgatactgtaagtcactgtggattatttaaagatggtattgcgaagaatggccagctattagcagacaaataaacatgggtttctaattccaccaagtgtaaaggtgaattctagatggaataaagacaaaaatgttaaaataaaaccatgaaattaaagaaacaatatgggagaatatctttgtgactgatgacatgggggaaaattttaaattcacaagctgtaaggtgaaataataaattggattataacaaaattaagaatttatcttacaagagagacatgaatagtaagattaagagacaaatgacagatctgtctctgtcaaataaatatcaaaaatataaatatcaagaggtgatatttataaatgtttattttttttcaaatccgcaggaaaaacaaataaggatcaatagaaaaatggta

SEQ ID NO: 650765 - DNA, 375 bp, Homo sapiens
agtcgaccccaaatggcataattatttgaaagcaaaaggtagttcccatttggttactaggagaaaaaatgaataatctacaggtgcagggtgcccgtgtggttctttgacaggagccagaaatcacaatcctcatgaataaaatatatgaacttgaatgcattaatgcctatggattaaggacttctgttaaataattccatcatggcacgggtcaagactgttttcataataatagtaaggaaacaatgtgcgtttatcacgtttacactcatgaatgtaactttaccatgactcattacaagatatgtgaaacaattaaagctgaggagggaacaacacctcaattataccagaaagctccattaatcatta

SEQ ID NO: 650766 - DNA, 286 bp, Homo sapiens
gggacagtgtctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 650767 - DNA, 334 bp, Homo sapiens
  misc_feature (64)..(64): n is a, c, g, or t
  misc_feature (83)..(84): n is a, c, g, or t
  misc_feature (134)..(134): n is a, c, g, or t
  misc_feature (139)..(139): n is a, c, g, or t
  misc_feature (198)..(198): n is a, c, g, or t
  misc_feature (290)..(290): n is a, c, g, or t
  misc_feature (310)..(310): n is a, c, g, or t
aactttgacaaagagatagaaagtataaaatagtaccaaatagacatcaaagatgtgaaaaatnctgtaactgaactaaaaannttcaattgggaggtatttcaaccaggcagattcaatgaagccagaagaanccggntcgatgaaatcaaagacaggtcactgaaaaaattcaatctgcgcaaaagaaaaagatgnaaggatagtttaagatagtttatgcgacctgtggacacatcaagtgacacaatgcatatgatatgtcagaaagagaataattttcaagatancagaataattttcaagatancagaactcagctagtcagaacctc

SEQ ID NO: 650768 - DNA, 847 bp, Homo sapiens
gagtgtgtgggtttcttcggcggctgctcaaaatgcaaccgactcttcgagtgaaatgctgaacacctcaacgggctccggcgaccagcctgactgactgcataggtacggtgggacagggagagcagaatccattgacaagacagactttctcgattgggaatgctgagcgtagtggaagtactaaggagtcaggatcaagaagcatgagagagggttcctgcatgatgaaatatggatcaatgccagaaataagacctaggcgcgctctattagaagtccacaaggaggatgtatgcagcatgccaagcgtgcgactaacagtcttggcccaaagcaggtgcattcagacaatggaacaagcccatgtatatccactccaggtccttggaaaggactgcgcaagacccacgcgtctgactgctatgaaactgggagtctatggaaagtgaaggacaggcagtatcaagctaacgtgaagatcgatcagatcgaggatgtacagagaccacgcgtagacgcgatatgatggaaagatgcaaaatgaaatccaagaaagccactgagtcgcactctatggcaccccactaattggctgaaccatgaattcaagtaaagcggagttgcgatgccctcaggtggatcagcttctggctgatggacgaccgcctcttcattggactgacggcaggcatctgcacctgcaattcccgaaggtgtcccccctgactaccacgaccccgggtggcctccggcggccctgcattcccgtcgccccgttccgctccctcctcgctctgtcacctttgtgtcccccccctcgggctagggcttctcccccggcctc

SEQ ID NO: 650769 - DNA, 167 bp, Homo sapiens
cgtgtctctctgtggccggggccaccctgggcctctggggtccaatgtccaataatccccgggccctccccgggctcagtctgggagggtcccggggacttaacggggtaccagttttagcctggggtcctggcattgttgtcacaatgtgacaactggttcgaccc

SEQ ID NO: 650770 - DNA, 540 bp, Homo sapiens
  misc_feature (293)..(293): n is a, c, g, or t
ctcaggtctcggggcgcggtccagcttccttcgaaaggtctagggttcacggaaagtcctgtgcaagctcagcttggagggtgatcgactctacatccccaaggtgcgatatgggtctgtgcgaaagcctgatatcgtaactgtagatgctgagcgggatgctttgaacattggaaacagccagtcagagaccaaaggtgtggcatgaggtcatcagtggtgcgaacatttggagccagccggcaggcaagtgcgacagaggacgagggatatggcctgtgcgcctatcctanagaaaggtaccaaataaggcaacttgcgatcagactactgaaagtctagtcttaatctggctcatctggagaatcggtgagtaatctggagcctatattgaagacgaccggcgtcagtatggacgcttctagagattcaataagcttccatgataggggctggggaaccggacgaggatctctctcgagagagatcatctgttccagaacgcaaccaggacgcggtcgggaagttgtcgagagtcta

SEQ ID NO: 650771 - DNA, 156 bp, Homo sapiens
tgacaactcgagctcgttaccccattgagaacatgatggtaatgatggactctttcccaagaaaaatattcaatgcacaaaaagtcaaaatttcgcctacaattttaatgtcttcacaaactccctgaagccgagcgtcatcgaagaaccaattag

SEQ ID NO: 650772 - DNA, 139 bp, Homo sapiens
gaggatgtacatctactgtccccaccaatccaaggctgtgcagcagaactttcaaatcccggttgtctggggtgcttgcatccccttcccctctcccgtgacattagtatgtgctgtctgcgattagacgttgatacag

SEQ ID NO: 650773 - DNA, 296 bp, Homo sapiens
  misc_feature (6)..(6): n is a, c, g, or t
  misc_feature (106)..(106): n is a, c, g, or t
  misc_feature (123)..(123): n is a, c, g, or t
  misc_feature (191)..(191): n is a, c, g, or t
  misc_feature (259)..(259): n is a, c, g, or t
  misc_feature (289)..(289): n is a, c, g, or t
cccctnaacccccaagagagggaggacccggatccgaatgggcctgggtgagcacgaattaccgaggccttccctttgatacagtcccaggatttgtaagggatgnagacccctgggccccantttgttgggggcccatacatactctccggagatagcaacttgcttcaggtcaaagtggacccgagganagaggagaatcactcactactgctcttgccctgggctattcaggaagggcagcccgggtgttccatgntaaatcgtgacagaattgcaccaggcctgntgagttg

SEQ ID NO: 650774 - DNA, 167 bp, Homo sapiens
ggtgattgaggagttggacaccacggaagtacacttgccacatatttatgtcctaggcatacccatagaactcatttgtcatagctcttgtactgatgtgtcatgctgattgttttgctttattttaatttaatgctacatattaagttacggacttgtatattcca

SEQ ID NO: 650775 - DNA, 739 bp, Homo sapiens
  misc_feature (5)..(5): n is a, c, g, or t
  misc_feature (68)..(68): n is a, c, g, or t
  misc_feature (115)..(115): n is a, c, g, or t
  misc_feature (118)..(118): n is a, c, g, or t
  misc_feature (124)..(124): n is a, c, g, or t
  misc_feature (157)..(157): n is a, c, g, or t
  misc_feature (169)..(169): n is a, c, g, or t
  misc_feature (179)..(179): n is a, c, g, or t
  misc_feature (181)..(181): n is a, c, g, or t
  misc_feature (204)..(204): n is a, c, g, or t
  misc_feature (214)..(214): n is a, c, g, or t
  misc_feature (219)..(219): n is a, c, g, or t
  misc_feature (221)..(221): n is a, c, g, or t
  misc_feature (227)..(227): n is a, c, g, or t
  misc_feature (230)..(230): n is a, c, g, or t
  misc_feature (232)..(233): n is a, c, g, or t
  misc_feature (240)..(240): n is a, c, g, or t
  misc_feature (257)..(257): n is a, c, g, or t
  misc_feature (261)..(261): n is a, c, g, or t
  misc_feature (269)..(269): n is a, c, g, or t
  misc_feature (274)..(274): n is a, c, g, or t
  misc_feature (302)..(302): n is a, c, g, or t
  misc_feature (306)..(306): n is a, c, g, or t
  misc_feature (308)..(309): n is a, c, g, or t
  misc_feature (311)..(311): n is a, c, g, or t
  misc_feature (320)..(320): n is a, c, g, or t
  misc_feature (322)..(323): n is a, c, g, or t
  misc_feature (325)..(325): n is a, c, g, or t
  misc_feature (329)..(329): n is a, c, g, or t
  misc_feature (351)..(351): n is a, c, g, or t
  misc_feature (394)..(394): n is a, c, g, or t
  misc_feature (486)..(486): n is a, c, g, or t
  misc_feature (522)..(522): n is a, c, g, or t
  misc_feature (623)..(623): n is a, c, g, or t
  misc_feature (633)..(633): n is a, c, g, or t
  misc_feature (703)..(703): n is a, c, g, or t
tgttntcccagcacgttttggaggttgtggtgtgttcatgacgatggtctggggtttgagatcgtgcntgggccttcatggtgtaaacctccattctgctccttaaatagatatntantgtttnttgggtgtggtgtgctaggcctacctgttatcntagctttttggnatgtttaggngngagtgttgctttgtctcgggagngggtgcttgnggtcntncaagantangnnactacantgcagcctgggcaacanttcntgattccntcgtnataaaaaaaaaaaaaaaaaaattaatanaaananntntataaaaanannanatanaaacaaaaaaaaacacctgganaatgttttcattcagagaccccataggatttcaaaagccagcnaccatcagcagttatttttgcccccaaatcaccctaaaatgcaaatcccatcactgtagctggcaaaggtctgggatatggctcctggagtntagggagcagtccccaccaaggacggtgctggcttntcgggttcctctcccagatctacaatccggatggcgttttccttcttggaaagccagaaggcagcatagactggttctgaaaacttgcaggcaaacttgtnaaccagagtnatggaatcatactctacgccatagaagggaaaggatccctcctgggaagtcaatatagaccccgagcctncagaaaagggccagctttgaagtggggtctccatgt

SEQ ID NO: 650776 - DNA, 135 bp, Homo sapiens
  misc_feature (35)..(35): n is a, c, g, or t
  misc_feature (41)..(41): n is a, c, g, or t
  misc_feature (60)..(61): n is a, c, g, or t
tcgcttatatagccccccgactagcccgacagctnaggcgntcagcagcaccgctctcgnntggccgcagcccacgttcaccactgagttgaagaggtaggcacgcccctgactgccctgtcgggctagtcgggg

SEQ ID NO: 650777 - DNA, 668 bp, Homo sapiens
  misc_feature (346)..(346): n is a, c, g, or t
  misc_feature (351)..(351): n is a, c, g, or t
  misc_feature (358)..(358): n is a, c, g, or t
  misc_feature (365)..(366): n is a, c, g, or t
  misc_feature (368)..(368): n is a, c, g, or t
  misc_feature (372)..(372): n is a, c, g, or t
  misc_feature (387)..(388): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (412)..(412): n is a, c, g, or t
ggcattatgggtcgtcgtcttttggctctctaactttttttatggctgtttgcaaagagcaattccttatgaactgttgtaaggagtgagcggcgaccaaaatgagatatctttaaagaatataaaatgcaatgaacacttcatattatgcgtcttgaaacactcaaagctatgctcaagcctatacgaggtatgcgcttaatcctttcatactgtgtaggagaattagcggccagccataggtatgtaggaatagtcactcactggctgatacatttaaagcagcagtgtgaatagcaaggacagacaccttcaatttgtgaaatcaaagaactgatgcactatntagancgaattngggtttnnanaganatattaaaagtaggnnctgtangngntctaaaaccctgtnaacttcattctgtgggctagtggtgtgggacaaaatattcctaatgaaaggaagccccaatagctgatttgtggtggcattccccttttggaaagcacatgcaggtattgtctgcgtatggtattcacactagggaagcatacccaggcacagggctttaagaacacactgatgccttgataattaaaaagaatacaaccgttcctgggccacatgttaattagccagctagtgactgggccaaccttttttcata

SEQ ID NO: 650778 - DNA, 454 bp, Homo sapiens
tgtcctccaacaaatggggagagcaaattgaaaatgcgtaaattgtaaggcaagttctgaaattaaacgttgacctttggcctgatgttctgacttttaatgaatcaggagtttgtaaccttccaaatattaccaattctgaactgccgtgtaaacttgacgaattcccaggtcaccatcccagtttcccattaggatgtgaataatgtgtgttgaggttaaaccttagccatttgctttggcagtatttgaacgctttcgctttccggagtgagcttcaacaaatttaagagggcccatcacacatgtgacctcgcattaaagaggttttgaaatgtgcgtctttggcaaaaacactgttcttattagcacctgttgaacattatccctgggccttagcaatttgccttccatttttttgtgccaccctccctgggaccatttgttttttttc

SEQ ID NO: 650779 - DNA, 594 bp, Homo sapiens
  misc_feature (272)..(272): n is a, c, g, or t
  misc_feature (277)..(277): n is a, c, g, or t
  misc_feature (284)..(284): n is a, c, g, or t
  misc_feature (291)..(292): n is a, c, g, or t
  misc_feature (294)..(294): n is a, c, g, or t
  misc_feature (298)..(298): n is a, c, g, or t
  misc_feature (313)..(314): n is a, c, g, or t
  misc_feature (320)..(320): n is a, c, g, or t
  misc_feature (322)..(322): n is a, c, g, or t
  misc_feature (324)..(324): n is a, c, g, or t
  misc_feature (338)..(338): n is a, c, g, or t
gtgtagggctgaatgtgatgtggcagacattagagctcttataagaagtgatgatatgatagacaagtcgtattattcggggtgggatgctctatagtatacttgagtgtatgcgaggtaggtgctggatattacctaatgagtacgagactgggcagtcagccataggtatgtaggaatagtcactcactggctgatacatttaaagcagcagtgtgaatagcaaggacagacaccttcaatttgtgaaatcaaagaactgatgcactatntagancgaattngggtttnnanaganatattaaaagtaggnnctgtangngntctaaaaccctgtnaacttcattctgtgggctagtggtgtgggacaaaatattcctaatgaaaggaagccccaatagctgatttgtggtggcattccccttttggaaagcacatgcaggtattgtctgcgtatggtattcacactagggaagcatacccaggcacagggctttaagaacacactgatgccttgataattaaaaagaatacaaccgttcctgggccacatgttaattagccagctagtgactgggccaaccttttttcata

SEQ ID NO: 650780 - DNA, 679 bp, Homo sapiens
  misc_feature (44)..(44): n is a, c, g, or t
  misc_feature (149)..(149): n is a, c, g, or t
  misc_feature (151)..(151): n is a, c, g, or t
  misc_feature (161)..(161): n is a, c, g, or t
  misc_feature (163)..(163): n is a, c, g, or t
  misc_feature (193)..(193): n is a, c, g, or t
  misc_feature (215)..(215): n is a, c, g, or t
  misc_feature (246)..(246): n is a, c, g, or t
  misc_feature (323)..(323): n is a, c, g, or t
  misc_feature (355)..(355): n is a, c, g, or t
  misc_feature (380)..(380): n is a, c, g, or t
  misc_feature (405)..(405): n is a, c, g, or t
  misc_feature (432)..(433): n is a, c, g, or t
  misc_feature (514)..(514): n is a, c, g, or t
  misc_feature (529)..(529): n is a, c, g, or t
  misc_feature (549)..(549): n is a, c, g, or t
  misc_feature (576)..(576): n is a, c, g, or t
  misc_feature (588)..(588): n is a, c, g, or t
  misc_feature (597)..(597): n is a, c, g, or t
  misc_feature (670)..(670): n is a, c, g, or t
aaaaaaaaaaaaaaaaaaaaaaaaaaaaaaaaaaaaaaaaaaancaatataaaaaaaaaaaaaaaaaaataaatcatttacagacacactaaaaatgttattaaaatatcttctttctccaaagagtccaattgcgcatttcttaaagnanagatggggananattccaggcaaggtcacaatggcattttgntgccctcaataaagattttcantgcgtgtgcagatctgctttttttccttatntctgtgaaatttctcatactgttatatccagtcgactgatacccttcttggaggtcgcctgaaacctggatgactcnatttccacattccatttgggcctgaacaacanagtccttgtttgaaggcattggganccattgcacgggcacagaatccagnatctccaggtctaaaagccttctcctnncctgtaagcaccttttccaggtctcttctgggatgtctgaccaccagagcagttcattcttcgatcgttgaggcatctgtnctagatatctctganccctttcttctcttgtcatncctttgtagtttgaggtaagaacaaanataggcctagancactcattnattaatttccctgccaagtacttgttagaccttgactccttggggagtttatagagataaataactgctcgtncaatcccac

SEQ ID NO: 650781 - DNA, 135 bp, Homo sapiens
  misc_feature (42)..(42): n is a, c, g, or t
ctcccggctgaatgctcctcccggctgaatgctcctcccgtnccggctgaatgctccctcccggctgaatgctccctcccggctgaatgctccctcccggctgaatgctctatattttttttttttttttttgtt

SEQ ID NO: 650782 - DNA, 1340 bp, Homo sapiens
  misc_feature (256)..(256): n is a, c, g, or t
tttggttagcgtgttagtcgccgtctcatgcgcggactcacgttttataaaagtcccccgggatgtactgggtcatctatacaatgctctattccttgtgtgatactaacttgttgtggtacctctttgtgtttctagattgccaattttcatgctgtaggtagtcacttggcgcacattttctccctggttaaccctgtatatggtgttagcacttgggcggcggtctcaacattcccctctggggtggcctttnctcttatatacctcttttgggggtctttatcacgttgctcctctccccggcgtggcaacaccccgtggacaatttcaggggcttcactgggctcgccgtttcttttaccctttgcttgacacggtgggcccaatttctgcgcccttcctttttgctggccccctctggcgtttttaaccgttattcggagggtaccgcaggatttgggccggagctatggctctctccgaggtttttagcacaaggcattctcccttggccgtggtcctaacatgtgatgtggcccggtctagtcaccccaatgacgacggtttgggcctatttgcgcgaaccatggttccccaggaggcatcctccggggacacacggtatgatggctcctgagctagcactaactgaagcgggcacttccttggctttcattggggcacttgtcccacggttcaacccttacgcatgtctgtcgcacaacctttgtgtgtcaccggctctctaaacctcgggagggctcaaagctatggaggcctatgaagacggcgtcgagatgcttttccggacgggggcgcaagtttcccttcattcacacaaagccacaagttcgcacggtcttggagagccgtgttcccacaggagacacggtggaacacttctctttgctttccggagaagtgcccgttcctcggaacaaccacgaggagccaataatctgagcgcgaaggagcaccgccgtgccctgccgtgccacatcatgtggcccgaagccattgcgcaattcaactgcagaacgcctggaagagggacaggccgcttccgaagttgcagtcctggcgcagcaccgagctctgccaagcaacccggggagaaggagcaccctcaactcccacaaccccgggagagagacaactagaacatcagcacgaggggcactgcccctcacgcctgcagccgtgaaaggaaggctgggtcatcagcaccagccccgcccaaccccagcccctatgtgtgtttccctcaataaaggaggaatgccttgttcattttcagccactgcaaataaaatgccccgcccaacacttggcgttaa

SEQ ID NO: 650783 - DNA, 223 bp, Homo sapiens
tgcattcgatcaacccaatacaattactctccgcccagcaattcagacatgaatcaaccatcagtacagccattaatacatctcattgtcatcactgcagtgggtttagtatttggtgcacgactgcatggctcatggcagcaacagcctcactcaagcaatgaagccgggcacccggcacaatggctactgtgcaagcaagggtggccagcaagcacccagg

SEQ ID NO: 650784 - DNA, 111 bp, Homo sapiens
acttgaggacgtatctgagcgcatgggggtcaggcgttgaggtcttggtgagtgttttagtggcgttagcgatggacagtacggattggtgcttgccggctgaaatctggc

SEQ ID NO: 650785 - DNA, 245 bp, Homo sapiens
atctgatagaacaaagcatcaagactgacatccaaagatgccactgcaaccacttgcccacacgattagagactcattaatagaaacaaaacagtaagtatatagctttattgacatactaggcttagacctgtgtgtgtaacaagcaagcctaataatagcaccatggttcaactagcctgcttttccaagccatcattttataatttattaagcaaacaaaggatcaaatgtctctccatcca

SEQ ID NO: 650786 - DNA, 240 bp, Homo sapiens
taaatgttttaattttaaactaaaatttctatgaaacccggtatccaccttttaatgagtagggacataaagaaaaccctcctaatgaaaaactttttttaatgaaggacaacattaatctttgaaaaccggcatttttatttgttggttggattggaccctagaccctattttaatttttaaattgttttaaattgaaatgaagattgaaaatccttatatttaactcccccaagtgga

SEQ ID NO: 650787 - DNA, 556 bp, Homo sapiens
tcctcgtttgcggacacacttctgtcggcttctcccgtggcgtctctgtctcggcgaggtggtttgggcagccacctctttccgtgtccacccctgtgggctgcgccgctgcagctcgtgtgtggtttttgcacccccccctcggtgcggtgcctcttctctggcagctcctcccatgtgggtggcctcctcgcggggttgcacgctatcgcggcaccactttggggcacacccctcccttcagcccccgttgcgatctcccgtgcccccctggccctgtgtcccccagttctcgcccgctctacgtggttgatctggcgcccctcgcccaacgccgtcgtcggtgggggcgcgtgccctccgtctcctcctcaccctatggcgcctcccccgtcgcgcctcgcctcgtcgctcgggcgggctctctgaactcccttcctagccattacctccctatttgcttccttgtcgcgaatcgcttttttcttcgagtacgacaggtgatctttcccacgcgggcgtttatcccgagggaaaaccccacccacataacaaa

SEQ ID NO: 650788 - DNA, 528 bp, Homo sapiens
gagaataagagatgccttccgagaaaataagaatgtaaaagaccctgtagaaattcaagccctggtgaataaagccaaaagagaccttgaaataatccgcagacaggtccatattggccaactatactcaactgacaagcttatcattgagaatcaagagaagcccaggacataggaagccagcacaaggaaacagcctccacagcagaactgaccacctccagcatccattctatatggtggaacctcccagtactgggtgaaatagccactgctctgcctgccttgtaggcgctgataaactgagtcccatttgcattctgtcacagctgttatgtgaagaaatggctgtgtatcctcatttcgggtgtaagagtgaagagctggaggtcactcagaataatgctatatgttattgtgtctcctcgccatcctaccccatcttaaagatcacccacatttgtatagagcttttgcagactctgtgtcttggtccttaacagtaaacataattatctctctatcctt

SEQ ID NO: 650789 - DNA, 331 bp, Homo sapiens
aaataatttatgtcttttggacttagcatccagtatttcttttttaatacagaaaataatattctcttgcaatatactatgtttatctgggttttgaaaaatgatgtttcctaatatgagaaagccatttacatttttaaatctacaaaggcaaatggaatggtactaaattatttacataataatgtttagatggtggcccttattaacattctttctatacttcctacagagttggggatatgcaatcctagaatatttctgggagctaatcctttatcttgatgaatgaaacaagacttttaaataaaattaaactttcaaatttaaa

SEQ ID NO: 650790 - DNA, 105 bp, Homo sapiens
gttctgatggaaacacctggtgtgggttctggatgtctcaccacagactctggacccatcaacctgccgacggctgactgcacacagacgtcagacaagtcagta

SEQ ID NO: 650791 - DNA, 243 bp, Homo sapiens
  misc_feature (131)..(131): n is a, c, g, or t
  misc_feature (139)..(139): n is a, c, g, or t
  misc_feature (182)..(182): n is a, c, g, or t
atatgggtgtacgtctgtcacacattcaggaccgctgcgtgggggctcagtggcactgagacaggaaagaggaggtcagggactggggatagctgcctccagtacccctagtacctcgcatagcctcaganacctccanctctcctcacccgagtggacagaccaaatcagcccactaagancctcttcctgctctggcgcaggtgagcaaagggagggctgcagaggtgatgggacctgctc

SEQ ID NO: 650792 - DNA, 771 bp, Homo sapiens
gatgacaaggatggttcctatggagctcccacaaacttaaaaccatgaaagcatctattatgctagctattgtgtgttgttctagttaagtcccaaggtgtcaagacaaatgaggagggtttcttcagatgccccggtggttcatcgatgctcgcgtggacaagagagagagaatgaggctcccagccgtagaggccgtgccgcacgcgcacatcagtgggaggtggcttatcgggcatcgtccagccaaagcagtggcctagtcaaaagaacggagaaagaaataggcccctgagtgctggaggctgtctgtcacgctgaatccagagctgggggtgtgtgtgtccttacatggagtgtcaggcttgcaagaggcattggcatacagacaggaaatggccatttcatgaatatagtgttgatgaggtgaaatatagcaagtgttggaatgatgtgttaccagacactccctcgttcgtgtcgtttcaggaacatgtatttgatgacgaagatgctgtggtaggacagaggcgagaccggcgcaattgcagatgcgaaggacttctcggaaaccctgaaaggacctgttcattgacctggccacggggaactcggaagataagggtctgctttgggacctacttggattgtggtccgggcgactcactggcgtcgcccataccgcggcacggtagggtcaacagtcttatcctcccaagaggagccccggcctgtacaccctgtgcaggggacacccaccaccttaagact

SEQ ID NO: 650793 - DNA, 116 bp, Homo sapiens
cgtcctctctgactgatgcgctgactcctcatcttcctcttcttctgcctcttcctcctcctcttcctcttcttcttcttcctcctcttcctcctcctcctcttcacttagttgtt

SEQ ID NO: 650794 - DNA, 182 bp, Homo sapiens; identical to SEQ ID NO: 550433

SEQ ID NO: 650795 - DNA, 302 bp, Homo sapiens
agtttcgacgtgagactctcattgccaaatggtgatgaccttgtgccgtgaggtcagctcgtagactcttctcgagggaggagctgttaagcagcccgtgtgcctactctcttgcttcgacagctccagggacgatcgtaggcacacgacttctgccttaagtgtcacgtcacgcatttccgcgctcggtctgtggatggtgaatgctgtacccgccagctcggttgaggatcttgcaatgagggtatgtcagtcaaggtgcacgggacagaccaggatgcagaactcagtgatggacatgg

SEQ ID NO: 650796 - DNA, 227 bp, Homo sapiens
atagaaagctgagaggtgcttgggaagacgcttattaaatgatgaattcaagacacagtcaaagagtttccctgggcctgatatagagttttagaagtttcaatagcacctaatcaacatacagtcaaagagtcatgcagagactgagttttacaaattcattccaaagcacgtgacacctttacacctttttttttttttttaactatgctatggaaacttctaaa

SEQ ID NO: 650797 - DNA, 227 bp, Homo sapiens
aagctagtaagtggcagagccccgagattttaaccaggtttgaccccagtgccccctcttttcccccctaccctttgggagtactgtccttccagggcaaggaaggatagtcctttgcttttccccgaattagcaaaggttttgattgacttgataaggtagtttccattgatacggatgatagggcttttaggagggaaaaggtaataaagctttcccttggtcca

SEQ ID NO: 650798 - DNA, 131 bp, Homo sapiens
tatcagcacgttgtcactacagcacggaagtatcttgagggttgggtcaattgagacatttctagcattacttaatgacttgcatatattctggtatctgaatgttggttccttgatccaggaattcaaca

SEQ ID NO: 650799 - DNA, 175 bp, Homo sapiens
cagttgaccagagcaccagcagacacatgtggtagcagctgacaagatggagaagcatgtgcccctgtagagcgtccccccagaacagacccctagccactcgcttcctctgtgctgtgacaacattggtgccaggggagatggtgtttttcaaacgggacctactcgtagccac

SEQ ID NO: 650800 - DNA, 525 bp, Homo sapiens
ggggccataatcttgatcctcaccaaggtctggcagggatctgctcaccaggtggccgagataccggcccacgtgcccccagtcattgctgtgaccctggaatccccagacagcgtcgtcagtgcccatctgtacctgtggcatcgttccctgtgccatgtgcaatggaccctatgtccagtgatggcctgtggctagaaggacggtggaccgtcctgtggaagaacctttgccagtgaatgcttgtgcaacgtgcccgaaggcttctttcagatgaacgggagaatgttggatcatttgtgcatgactctgtgatggctgtcgccttggcctacctgggtcgtttacaacccaaatcgatccaattgctgtttgtttgtatccatagttagcccctgttggagttggatccctcgagatacacgcaactacactcccatggcctgggttctaccacgacctacaacttgcccgcacagaaactacactattgagggaacatagacacactgctttctaggaacc

SEQ ID NO: 650801 - DNA, 620 bp, Homo sapiens
  misc_feature (204)..(204): n is a, c, g, or t
  misc_feature (232)..(232): n is a, c, g, or t
  misc_feature (619)..(619): n is a, c, g, or t
ccccgggtaaagacaaagagatggatgcccatcttcttgctctttgctgcttcaacaagattggacgtttgtgatcgaaagggtcctggtgagctcatcaggaaaacctggcaacggatgacgtcatgcttctggacactgggaccaggtcttttgtctgggttggaaaggattctcaagaagaagaaaagacagaagccttgncttctgctaagcggtacatcgagacggncccagccaatcgggatcggcggacgcccatcccgtggtgaagcaaggctttgagcctccctcctttgtgggctggttccttggctgggataatgattactggtttgtggaccccttggacagggccatggcttaactggctgccttaggaggggcagggcccccccatgtccccggtcagtgccttttggaactgtccttccctcaaaaaggccttaaagcgagcaaaacagctttgctatgagtgtgtgtgggggggtgggttgtttcttttttttttttttacagtatccaaaaatagccctgcaaaaattcagagtccctgcaaaattgtttaaaatgtcagtgtttgggaaattaaatccaataaaaacatttttaagtgtgna

SEQ ID NO: 650802 - DNA, 883 bp, Homo sapiens
atgatttatcaatgtgccatacatacactacaacataacattggcttgttatgcatgattgctctggggacaccattgcactgcagtgcacacatatttataaccattgtatattttggaaacttgctactatttattaagtcatagacttttctggaggacttaaaaattccactaaaaatctgattatgtcttaactgtccagtctatcttggtttatcacaataaacaaaaaaactctacgattacacacagtagatatctctggaggcaattttccaaaatcaacattaaaacttggttggatgcatgagatgcaatccttcacaagaatggaatctgaaatatatttctcaactatttacttaatatccactgaagatatctttatgcaagacaagagtcagccatcagacactgaaatactatatgatagatccatgaagaaattttttctgtagacttatattctttccatggaacctggtagagtagatacagactccaaagggctttttcttccctttcttactcctgttttttccaactcatcttcccaagcagatttcctacagcttcacagcttaatagccttattactggaaactacggaatttctggttactgaagtcttccattcccgacatctttaatggaacttacagcacatttgagtcttggccctgaatcaaacgccagtaaatcaacgattctaattacagatggttgactctttcagtgaggatcggatatatgtaaacatcgggatcgtctggaacctcggatagcacgtttgagcaatataaattatacagacaaacatttcggccggataagcgaagagtaatccttgatacgaacaattaaaaacaaaaatgaagtc

SEQ ID NO: 650803 - DNA, 148 bp, Homo sapiens
ctggcagttaaggaggacctcggagtggacccgagccaggaataacgaatgacccaaggccaaggaagggaggacaaaaaggccccaggagtgggtggaaagtggagtgtgctgggacgttgtgtgcaataaaaaggtttccccccca

SEQ ID NO: 650804 - DNA, 813 bp, Homo sapiens
gcccggcccaggtccacacgtgctcggccgcaggaggcttcagcaccagcgattacgacgttggctgggagagtcctcacaatggctcggggacgtgggcctattcagcgccggtatctgctggggagctgggctcctgtagcctggaggagagccgcagaccggggtgcgcattcctgcgagctgcttcagactggtcgtggactaccaggagcgcgcgctgtgttcctggatgctcatcgcggctatcgagtcccggcgcgtggggctgcactgccgttcgtcatcgctgcgcctcgagttcccggacggccggccgcgccctggccgccctcagtcgtccgcccctttgcgctgcgccgcctcagcgcgggcctcttcgctgcctctgctcacctcggtgtgcctgctgctggttcgccgtgcacttcgccgtggccgatggcccgtacttggcaccaggggacagggcgctggcgcgtgctgtggctcggagccttgggcgcgtgtgtgcttgctggtgcgcgctgatccggtggtcactggttactggtacgcctcgcccatgtgggtgcccggtgtacggccagtggactccgttctcgtgcgtcggcggcgcgcgccgttagctaggcttcgaccatggtggcgctgtgattctccgtagtccgtggcctggtggtctctgctgtcttcctggttatggtcaagggtggccagaggtagggtgtggggcaatggtccgtctttgggaagaattatgcggggtctgccgaggtctggggggttcttgggcctggggtgtcggggtgc

SEQ ID NO: 650805 - DNA, 297 bp, Homo sapiens
ccgggaactagggggacgtgtgaggagcggagtaaaagaggtttcgtgtattgatggtggcgtttttaagtaaacccaacacaaaacaaacaaagcaagtacccatcggtagtcttgacttcaaggtgagcttcaatcattgtctgccttttttggcccagtgcacacttttggtcaggggtacaaatccatgccagggaagttatgtcatccctcttattatttatcatcctagccctaagtcgggcctatgagtgcttacaaaagggataagcctttccgtatggttgcaaaaca

SEQ ID NO: 650806 - DNA, 540 bp, Homo sapiens
gacactgagatcaaagatgacgcagccacaaaggatgattctcctgaaaaaaaacccaagaagatggtggtggaagccgacatagaggacattaaaaaaacgcaacagcgcagtttaatggactggagctttactgaatattttcagccaaaagtcctgcttcaggttcttcaggaggctcaccagcaataccgatgtgttgactcttactaccacacgcaggataactctttacttctggtttttcataatccaatgaatctacagcgtctgcaatgtgaacattggaatattgctcttcactccaacgtcggattcaggaattacttagaacttgttgcaaaatctattgaagactgggtcacacaggaagaagcgaagtaccaggaagccaaaatggctgaggagctcaacaggatcaggattgagttggaactgaaagccactgtcaaaacttctgctagcaaaattcctggccccaaaagatctaaaactaacaaagtatccagcaaaacagagctatcagaccaagaaaaagat

SEQ ID NO: 650807 - DNA, 528 bp, Homo sapiens
gtagtaataacagtactgagttaacaaagagttccagaacaacaggtatgagcgaatgattgacaagggtgaaggcgtctctgatggtcgtatgacaaaccggggcaaagatgctgtgtttagtagtgggtcatgttatctctgatttgaaataccttgcacagtgagtggcataataaatgatcaatcaatgtgtgtggaaaaagttgattaagtgaatgacgagttaatgtaagttacattatatagtacagtgatgcaaaaatagtaaaaatatgctgtgttagcaactgacgtacaataaagttgaattcacccgaatatctaagtcttaaaagataaatgcaagtagctggtagctgatttaggcaccagtaacagaagtgaacacctaaaaagtaaatgctatcacaggtaggaacatgtgagtgaccctgattacttgtcagtaggaaaagatgtggagtgcaggcatattctctttctactttggatcagcaatcagattcactcacagatcatcgattc

SEQ ID NO: 650808 - DNA, 298 bp, Homo sapiens
  misc_feature (148)..(148): n is a, c, g, or t
  misc_feature (167)..(167): n is a, c, g, or t
  misc_feature (185)..(185): n is a, c, g, or t
  misc_feature (187)..(187): n is a, c, g, or t
agcggtatgttctagaagctgcttcatccatccccatgactatcttagtctcggcttccatcatctttttctctctttccagtatctcatcgttttatgttattacttttgtgcattagtctaaactgtgtacaagtatttatgtgtnttccttaaaggcaattaanaaagtgacaatctctttntngtttttttttttgagatggagttttgctctgttgcccaggctagagttcagtgagctgtgatcacaccactgcactccagcctgggtggcagagtgagacctgtctctaat

SEQ ID NO: 650809 - DNA, 458 bp, Homo sapiens
  misc_feature (13)..(13): n is a, c, g, or t
  misc_feature (90)..(90): n is a, c, g, or t
  misc_feature (151)..(151): n is a, c, g, or t
  misc_feature (211)..(211): n is a, c, g, or t
  misc_feature (351)..(351): n is a, c, g, or t
tgagaggaacgtngagtgaaaaggagaagtcccttctggcccccatcccagactctcccgcctgtgggtggatgtgcacacctaccatanggacacacgaaaacacacggttctgcctccctgggtggtctgtgtgcttttaaaatccctnacgtattgttccgcagcttgctttttctcacttcacaatatgtcttggaaattttccatngacgcgtgtactgatctgtttcactggattttgctgttgttgccaacactctcaagaaattttattgaaaacggtgacacacagaaacaccagattctcattttaaagtaaaactgacagcatttttcagaacttccatngttctgaaccatttgtgtcactatctttcaaagcaaaacaaaacaccgagtcccagatcccaacgagcagaggtggccctctgagagccacggggagaggctccggg

SEQ ID NO: 650810 - DNA, 702 bp, Homo sapiens
aaaggcgtccatctccagtcaggaagccccggtgattcatcagtaggtgatcccgcatggaagggtccattagttccaatgaaagtcttaaacgtctaattctcaggagggtatcctctaataacaagcaaagtgccctctggagcctcatcgctggtatcccagtgcctggacagagtgggactcgccgcagcgcatacgcgtggctcagactcgatctcaacacgcagccagtcatcgagcctctgggcccttcctctgggtcctgatacacagctggcagctagggcctctgaagaggttacagtgagctcaagggagtgtcgaggtagcggcagcacggcggtactgaagggacagatgagggatccctagtaatcagctcgtgcacgcacttgactagcagttcgaaagcaaaaacagattcggatcacaagtgacttttcccttgcaaatggaagactgtatttaaatgcacattgctttagctggccagtctccagtaaggagctgattgttagtagagccattgttatgcaaataattttgcctgcagttcatactcttatgctattttctcccatgtaggagaaatagagatgatacctttcctgactgtagtcaagactcagggtcatgtatgattccacaagcaagaattccatggtcttggttcatgtattacagacaggtacatccgag

SEQ ID NO: 650811 - DNA, 676 bp, Homo sapiens
  misc_feature (221)..(221): n is a, c, g, or t
  misc_feature (347)..(348): n is a, c, g, or t
  misc_feature (351)..(351): n is a, c, g, or t
  misc_feature (353)..(353): n is a, c, g, or t
  misc_feature (358)..(359): n is a, c, g, or t
  misc_feature (362)..(363): n is a, c, g, or t
  misc_feature (368)..(368): n is a, c, g, or t
  misc_feature (394)..(395): n is a, c, g, or t
  misc_feature (399)..(399): n is a, c, g, or t
  misc_feature (408)..(408): n is a, c, g, or t
  misc_feature (419)..(420): n is a, c, g, or t
  misc_feature (423)..(423): n is a, c, g, or t
  misc_feature (425)..(425): n is a, c, g, or t
  misc_feature (430)..(431): n is a, c, g, or t
  misc_feature (435)..(435): n is a, c, g, or t
  misc_feature (440)..(440): n is a, c, g, or t
  misc_feature (444)..(444): n is a, c, g, or t
gcacgaggtgaattaccaccgattaaggaaggctgtataaccgaacaggtacgcgagttctatggacttgaatcaaagaaagggaaaaagggccagcatgttggatgctgtggctccaggacagacctgtctgctgacacagtggaactgatagaaagaatggacagattggctgaaaatcaggcgacagcttccatgtcgatcgttgcgttaccgtctancttccaggagagcaatagcagtgacaggtacagaaagtattgcagcagtgatgaggacagcaacacgtgcattcatggtagtgctaatgccagtactaacgtcaggactaatgctactaccactgnnagnancaacnncannactantgctactaccactgaaagtaccaacnncagnactagtgcnactaccactgnnagnancaacnncagnactantgcnactaccactgccagcatcaacgtcaggactagtgctactaccactaaaagtatcaactctagcactaatgctactaccactgaaagtaccaactccaacactaatgctactaccactgaaagaccaactccagcactaatgctactaccactgaaagtaccaactccaacactagtgctactaccaccgaaagtaccaactccaacactagtgctactaccaccgaaagtac

SEQ ID NO: 650812 - DNA, 420 bp, Homo sapiens
  misc_feature (225)..(225): n is a, c, g, or t
tcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacggcaagaccccgtctctacaaaaacttaaaaaattagctggctgtggtgttgctcacccatagttccagctactcgggaagntgaggcagtaagatccctcgcgcgcaggaggccgatgctgcacgggactgtgattgttccactgcagtccagcctgggtgacagagaaaagaaaaagaaaaccttacataaattggctagagcataatacgattgattttatggtttttgactatttgagttgcactcaaaggacatttcagaagtgcgaattca

SEQ ID NO: 650813 - DNA, 365 bp, Homo sapiens
tcaaattgccatgtggtccagccttgaagtacgctctcagatttatctgtaactctaagtaaatgttctaatgtatgtgcacgccatagtcaagattcctttaaagcctatataaagcattcttgaattccctgtcaatgcaaaatgtgaatgttcctcattattaagacctcaaaaaataaggtccagtatagtataacctgtgtttttgtgtgcctataaaaccaatgtgttagacactttctacctatatttctctatccaaaaagcacttactgtcaacacccagagccaaatcacaaaagacgccccagcacagtggcgtcctctgtgtgcagaggctctcgtgccatattcgtacagcc

SEQ ID NO: 650814 - DNA, 410 bp, Homo sapiens
  misc_feature (22)..(22): n is a, c, g, or t
  misc_feature (59)..(59): n is a, c, g, or t
  misc_feature (410)..(410): n is a, c, g, or t
tgggccaccatgcccggctaanctttgtatttttagtagagatggggtttcacccatantgggccaggctggtctcgaactccctgacctcatgatctgcccacctcggccttacaaagtgctaggattataggggtgaggccactgtgcccagtgctgctcctttttttttgcaacatgcggattaccatacctttcctcttttcacctttagcccactttttccctttaaatactgaagccctcagcatcatctctggagaaaaggcacagaccagactgtttctgggattccctatttagttcttccaggcatgtccttaaccttggcaaaattaacttctaaattgttttagacctgtgtcagataatttttggtgtacagtatgtggtcactttcccccaagatn

SEQ ID NO: 650815 - DNA, 654 bp, Homo sapiens
ggtggggctaccaaggactccgcccccccgtctgggcgccgccctgcccccggggaaacgtgtctgtccaaccatcaccgcccaactgaggtgggtgtcctggttggccaaagacccggtccaggttttaccgtgaatgggctgacaccttgggggcccagaaaatagttccggtgatcccggactcactgctgccaggatggggaatttacgcctggatcttcgtacccagagccacccggtggggccccccaccctccaaagtcacctgtcacccagactgaccagacgctagtcctctgatgggccaaaaaggtgtcccccgtggtttgatcaaccagatatgttatgaaatggcctccccaccttcggcgttctcccagatactgacctcgtctgtccccttccccttctacccgctcccccaccagcatttgcaccccctttctctccccaatacaccaccaccaacccttttattttttgggcccttaccccctaccccctattgctgcccaaaccccctgggctgggggcccgggctggatggaccagacccctcccccctacccctatccctcccctgtgtggttggaaaaccttttgttttttggggttttttttttcctgaataaaaaagattcttctaaccca

SEQ ID NO: 650816 - DNA, 559 bp, Homo sapiens
atcagctcggcccccttagatactcaggctctgcgaaggacacaatagtaagactagatccaggattgtccagcagcacattacaataacaggcacatatatccaccccagagagcaagcaagacaattaactggggcctaaaaaggaaataccaaaaaaaaaaattttttttttttaagatggactcgctctgtcgcccaggctggaatgcagtggcatgatcatagtagcctcaacctcccaggctcatgcaaccctcgcatctacgctgggaccacaggtatgtgccatcacactagactatattttttaaatttttgtagagatagggtcttcctatattgcccaggctgatctcaaactcctgggctcaagcattcctcccagaatgttgggattacaggcatgagccactgcaccctgccttgaactgttgaactgtagtttatagtttagataaacaaaagaatggaacagcataaatacagagccaaggatggacagaagggacatgccctaatgcaacttgagaagggaactgtgagaatggagttagta

SEQ ID NO: 650817 - DNA, 277 bp, Homo sapiens
  misc_feature (204)..(204): n is a, c, g, or t
  misc_feature (248)..(248): n is a, c, g, or t
tctctacgatgacaactctcttccaaatgtatagacacaacactgatgttattaataggatatggatcatacacaaagaagcactgaatcccatgatagcaaatcctatgctgatgcatggaagtcttctggaattcttttctatcaggtatagtgcatcttttaaccagccgaatggagtcctttacaaactgccgacttggntcaacaaactgcattacctgatccatgactgcctacccaaccgncacctaaaatgccagggacacgtagcact

SEQ ID NO: 650818 - DNA, 980 bp, Homo sapiens
  misc_feature (4)..(4): n is a, c, g, or t
  misc_feature (66)..(66): n is a, c, g, or t
  misc_feature (68)..(68): n is a, c, g, or t
  misc_feature (78)..(78): n is a, c, g, or t
  misc_feature (418)..(418): n is a, c, g, or t
  misc_feature (518)..(518): n is a, c, g, or t
  misc_feature (525)..(525): n is a, c, g, or t
  misc_feature (586)..(586): n is a, c, g, or t
  misc_feature (591)..(591): n is a, c, g, or t
  misc_feature (611)..(611): n is a, c, g, or t
  misc_feature (788)..(788): n is a, c, g, or t
  misc_feature (792)..(792): n is a, c, g, or t
  misc_feature (872)..(872): n is a, c, g, or t
  misc_feature (900)..(900): n is a, c, g, or t
  misc_feature (915)..(915): n is a, c, g, or t
  misc_feature (918)..(918): n is a, c, g, or t
  misc_feature (973)..(973): n is a, c, g, or t
gggngcggctggtccggtccggtgttcccgggttgaccaggtctaggtctggggtttccgcttggncnctgaaccaancagacaaacaaagccagccggggcgcgccgtcctgccccgggcccggcttctctcctgccttcccccgccatggggggccatctcggcccccccctctgcctggtgccctttttcttgggcctcttgtctgggggtgtgaccccccctccctggtctttggcccggcccccggggtcctgctctctggggggggtggggttcttgggcggctccttccggcttctcccggggggccaggccctggggttcgtgtgtccttctggcttctccccgttccctgtgcgggcccgttcctgcggttcttcggggtcctggggccccctgggggctcagggcccnggggctgtcgggggggcggggtgcggggcgttcccctgtccggggccccgcggcttcggggccgggggttcctggccccggtctcccttcttctttgtgngtgttgngttctctttccgctgctatgacggttgcgctctccggggctctgccattcgctcctgcccngtgtntggccggtggtgtgggcggnctgcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggncggngccttcctgccaagactccttcatgtacgacacccctccagaggtggccggagctttcctgtcttccctgacagagaccntagaaggggtcgatgctgggggtgggcncggcccagggggacnacnggagcgggagatcgtcctgggcccttcaggctccctggacatcttcctggtgctngatgggt

SEQ ID NO: 650819 - DNA, 942 bp, Homo sapiens
  misc_feature (51)..(51): n is a, c, g, or t
  misc_feature (322)..(322): n is a, c, g, or t
  misc_feature (447)..(447): n is a, c, g, or t
  misc_feature (453)..(453): n is a, c, g, or t
  misc_feature (464)..(464): n is a, c, g, or t
  misc_feature (498)..(498): n is a, c, g, or t
  misc_feature (554)..(554): n is a, c, g, or t
  misc_feature (559)..(560): n is a, c, g, or t
  misc_feature (632)..(632): n is a, c, g, or t
  misc_feature (653)..(653): n is a, c, g, or t
  misc_feature (656)..(657): n is a, c, g, or t
  misc_feature (684)..(684): n is a, c, g, or t
  misc_feature (774)..(774): n is a, c, g, or t
gagttctcttaaacacattttaaaattcagaatgtaaaaattgcgtaaatntactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattntgtgttacagtacacttgtagccaaaactggaagacaaaaccaatatataatttggctgctgattggcttacttttagatttaaagttactctgcgtatcctgtaatttagttgtaacatagaanatgaanaaacacgtaanaaaagtgaagtacgtgcaaagtgttttgcactgntgaactaagtaactgtgtaaatctgtgcaaaggtacgtatgtttatcttactcttnctatnnaactaaataacattacagcgttccgaatctacgatgggacatagtcagtgcttgaagtgccacttcatcaangtatgcatgcccttatataantanncatctagctttgaaaggccgtatgtgntgaacaggatggcttcaggggtaaaacttatctcttattaaatgcctatccatcattaaagggtattatcaatgggcaaacactgaatanttgatcgattgcaatcttgtagttcgctactatcagacatctggatctttaaaccaagactgcccagcatgttgggaccactggtatgacccttggtgactttggaaagccctactttaaccgcttaggactatccgtaatctaaggaaagaggcttttctaaataaa

SEQ ID NO: 650820 - DNA, 373 bp, Homo sapiens
gccggccccgcttctacaagtatataaatgggtgtcattttattgttctccttctctagatcttagtaagtttacataataaagcatttaacaatttcctactccgcttctgagctatgggttcccattccaggtgcagtatgtgattcaaggctatcacaaaagacgagagtacattgccgctttcctcagtcactttggcacgtaagttctttgtttaaaccatgctgcctgatgaccctactatgagggctccctcaaaaggagatacaggagttcccgttgtggtgcagtggaaatgaatctgactaggaaccatgaggtggcgggttcgatccctggcctcgctcagtgggttaaggatccggcgttg

SEQ ID NO: 650821 - DNA, 550 bp, Homo sapiens
  misc_feature (77)..(78): n is a, c, g, or t
  misc_feature (88)..(88): n is a, c, g, or t
  misc_feature (91)..(91): n is a, c, g, or t
  misc_feature (96)..(96): n is a, c, g, or t
  misc_feature (109)..(109): n is a, c, g, or t
  misc_feature (249)..(249): n is a, c, g, or t
cacgcgcacgcggttcaacaatcctcctgtctcagacttctgagcagctggaactacagacatgtgccaccccaccnngctaattctnttnaattnatttaattttttngtagatacagggtctcactattgttgcccagtgtggtctcagaactccattgggctcagagtgattctccgcgcctcggcctaaccaagggggctagagattacagtgcgtgagtcaaccacgcccaagccctgcatcantttctatttaaataatggtcaaggcacagcaggttctagtggccctgctacccataagtgggaagtgagagatacagtaatcatctaaatcttagccttaatagttaagatttcagaacttggttttctgaactgaataatctgtgggatgtttgtacccagaaattaggattctcattcatctcttttgcttctatttaatatgttggtttctatgcatttttagattctatgaactctctacccctctctcctgtactgtatatctggcttccaagacttgccatatttatcatcagtg

SEQ ID NO: 650822 - DNA, 436 bp, Homo sapiens
  misc_feature (49)..(50): n is a, c, g, or t
  misc_feature (280)..(280): n is a, c, g, or t
  misc_feature (287)..(287): n is a, c, g, or t
gggtgaaagacgggctgcctggattcagcctctggatcttagaccgggnnctacgaatgtaagatgaatttagtggcgcggctgcctccctgaatccgaacggtaatgatggatttatcaacggggattcgccttcagcccagcgagggaggtttactcagcaaatatgtcggcgagcacccacccaaatgcaatcatttgaccccctgcggacgatagctgccgtgccccttcccaccgctggtcctgcttggccagggtcgctgggggccagaacggncccggantgaccagagaggtggcctcacggatcccttggcctctcgccccctcctctgtttcctcctctcagcttgaggctctcctggcaagggggatcgatctggcgtgtaggtttggtggggagggagagggtggtggcggtgcagagcacaag

SEQ ID NO: 650823 - DNA, 359 bp, Homo sapiens
  misc_feature (8)..(8): n is a, c, g, or t
  misc_feature (327)..(327): n is a, c, g, or t
gttttggnggtacatgtgatactttattagatgcatagattgtaatgaccaagtcagagtatttgttgcatcttatcaccttgaatatttaataggagcggttcaggtcctcctctcaagctattttgaaatatacaattcattgctattggcccggcgcggtggctcacgcctgtaatcccagcactttgggaggcccaaggcggcggatcatgaggtcagaagatcgagaccatcctggctaacatggtgaaaccccgtctctactaaaaaatacaaaaaataagccaggtgtggtggcaggtacctgtagtcccagctgctcgngaggctaaggcaggagaatggcgtgaacccgg

SEQ ID NO: 650824 - DNA, 511 bp, Homo sapiens
attgtccaagaaatggaaatgtcacgcgttgcttcggtgttctggagattttggttttaccaccttttgtgacatgctccaactccacccttccactccattatcattttctggatttctttctggtctttatcttccgacacatcattcttcagctggtggctggagggaaattccacagaagcgccacgttcgggctgctttgcagttcactagctcctgccctgaatcagaggttctgatgaggcaagttctatattcccttttcttgattttccaccatcattcttgtcctcttgactattcggttccgttttctcagtggttgctgcgagctcttggggaacagagtttggcttctttatgttgatctcgatgctaccgttgtcttgtttcagctccagtggagacccgtgcactctggccacaccttcaaacatctgggatttggttaaggagtgggcaggtgccaccgtgggacactctctttccttctcctcctctctatgaa

SEQ ID NO: 650825 - DNA, 106 bp, Homo sapiens
aaggcaaaaaaaaatttcccttaacccctaggttaaaggggaggtaaaacctttttttgcattgatgaattttggatttgcttcccttaaaagcatacccccccta

SEQ ID NO: 650826 - DNA, 2282 bp, Homo sapiens
  misc_feature (2223)..(2223): n is a, c, g, or t
gttctttctgttgctcctctcgttcttggtgcgtgcggggcgcttcattggtgtggttggcctgcgcacttgtgttgttctgatcacgttctgttgttgtcctcttcttgtatctgtgtctttggtgcgtcctgtctttttaggcactttcggtgtggctcgctacataacttctggggtgtgactcaccacccgctgatgttgtgctgtgggtgatcacactggggtgttgttgtcgtcaggtctggttagtggtgtgttctatcctctcgctgtggtggtggagctatcacaactgctgtgtgtgttgggtgctgtttatctcttcgtccttggtttgggttgtggtgtgcccaacctgtgctgcgtgccagtcgctgtctgtggtggcggttgtttcgtccgtctgtcctgctcgccgctgtgtgggttttgtggtggtgcgtgttgctgtcgtgtggttttggtggctttggtagtgtggtggtgtgctggggctacgtcgcttctttggtggtgttgatgctgggcgggccgcgcgttccgtggtggtgcgccatgcatactttgtgtttagtcgagcgccgctgtgcttgtggtggtgtggttgtgcgccactacggtgcgttgtgtgtgttgtgtgttgtcttttcgcctacgctgtgcgtatgagtcgggggtttgcttctattctgtggttgtggtggggtctcctgcgatgtgtggtgcgtcgtcggtgggtgttgtgtgcaggcccccgttggtgttgtgtgtggcgcgcccctcgtgagtgggtagtggtgtccatctgggttgtgtgcttctctttcttcgtgtgggtgcgggctcctccgtcttcgttcttttgtgttggtttggtcgtgcggcctcgcgcgtcggccttcctggtggtgagtatcgtcctcgttgtgctctctccttcgtcggttgtggtttgtatcagtcgctgtcgtccctcctcagctagcttggtgtggtttttggttccgcttcttctctttctgctgggtgtggtgggctcgtcgttggctgcttcttctactgtgtgtggttgtggctgtggttgtgtctacccccagcagcagtggggtgggggctgtggctactagtgtcgtgttgtcttgttgtatatcctcccctgggccgtcggcccttcggtgagggttggtggttgtttgtttttcgttgtggtggttgttttgtgggcgttgcggcctcctctctctcgccttggttgggtgtgtcggtctccctgccgccctctcgctggtgttgtggctgctcctccccccctcttcttctggggtagtacgtaggagggcttcgtcagattcgtggtggtgttgcttctcccccccctccactgtggatgtgtgttgtctcgtcattgtttcttcgacctgctcgctgaggtgttgtgtgttgctgctccgtcatcaggagttgtgtggttgctgtgtgcgtggttgtgttccccccctccgcctgtgttggtggtagtgtcgctccccctctgtgtgtgatgattgtgtcgctgctgtagcggttgttgtggggtcctctcccccccctcgtttgggtgtttgttacagcgcgacgtcttcgcctcccctcactgtttatgttggcgctgctctgttgtcgcgcgttgctctactcgggggcttccaccgcgctgtgtgtctctctctctggtctgtgcgtccctcctctgtgttgtgtgggtgggcgcgacccctctgtggggtcctggggtgtctctctgttcctgcccaccactacagtgtggggagtagtgtgtgtgtgtgtctgtctgtgagtagagtgtgtgtgttacatattgtgggagagagtgtgtgtggattgctcgcgcgctgtgtgaatagatgtgtgttgtgtgtgtgtgtgtgtcgtgtgtgtgtgtgtgtgtgtgtgtgatatagtgtgtgtgtaaccacagacacctcgtgtgtgtgttgacccccatgtgtagtatgtgtgtgtgcgagataatataagtgtgtgaactcgcgtctgtgcattgtgtgtgtgtgtgtatataatagtgtcgcccttgtctcccacacctggtgtgtcccacataagatgtatataatatgtataatatgtgtgtgcgtgtataaaataaaagcaaatagggaaatttaattatacggttcgatggcagtaaaccgtcggggnccgatatagagtagtagtgtgttcgcgtgtggacctgttttgtgttgttttgttggttt

SEQ ID NO: 650827 - DNA, 519 bp, Homo sapiens
  misc_feature (456)..(456): n is a, c, g, or t
cctgttattggtcatcagagactcaacttcttcctggtttagtcttgggagagtgtatgtgtcaaggaatttatccatttcttctagattttctagtttatttgcgtagaggtgttgtagtactctctgatggtagtttgtatttctgtgggatcggtggtgatatcccctttattatttttttattgtgtctatttgattcttctctctttttttctttattagtcttgctagcagtctatcaatttggtggatcctttcaaaaaaccagctcctggattcattaattttttgaaaggttctttgtgtctctatttccttcagttctgctctgatttaagttatttcttgccttctgctagcttttgaatgtgtttgctcttgcttttcgccaagtcaatcctaagccaaaagaacaaagctggaggcatcacgctacctgaatctttcctttgngcttcagtttttattaggctttgcctttgtcctgtatagtttcttggatgcttctcttctcta

SEQ ID NO: 650828 - DNA, 365 bp, Homo sapiens
cagagatcgcgccactgcgctccagcctgggagacagcgagactccgtctcaaaaaaaaaaaaattgggttgcaaaccctgtttttctgtacaacctcaggcccaaagctctgttgctcattgaaaggcaatttttttgtaaggctgtttccgttaagttaggacttgtttttccaaaggggacttgcaagacgggagaggaagagggaattgctagttgccagttccccggttcaggattattttggcacatttgaggatggcgctggccttggttggaccaggggttctcatttctgaaaccacaggattagagagcttggagctaaaatgggccctgactccccacagttctaaaaggccag

SEQ ID NO: 650829 - DNA, 809 bp, Homo sapiens
  misc_feature (7)..(7): n is a, c, g, or t
  misc_feature (72)..(72): n is a, c, g, or t
  misc_feature (76)..(77): n is a, c, g, or t
  misc_feature (109)..(109): n is a, c, g, or t
  misc_feature (172)..(172): n is a, c, g, or t
  misc_feature (188)..(188): n is a, c, g, or t
  misc_feature (201)..(201): n is a, c, g, or t
  misc_feature (211)..(211): n is a, c, g, or t
  misc_feature (219)..(219): n is a, c, g, or t
  misc_feature (222)..(222): n is a, c, g, or t
  misc_feature (229)..(229): n is a, c, g, or t
  misc_feature (239)..(239): n is a, c, g, or t
  misc_feature (283)..(283): n is a, c, g, or t
  misc_feature (292)..(292): n is a, c, g, or t
  misc_feature (296)..(296): n is a, c, g, or t
  misc_feature (314)..(314): n is a, c, g, or t
  misc_feature (322)..(322): n is a, c, g, or t
  misc_feature (332)..(332): n is a, c, g, or t
  misc_feature (343)..(343): n is a, c, g, or t
  misc_feature (364)..(364): n is a, c, g, or t
  misc_feature (369)..(369): n is a, c, g, or t
  misc_feature (389)..(389): n is a, c, g, or t
  misc_feature (569)..(569): n is a, c, g, or t
  misc_feature (689)..(689): n is a, c, g, or t
  misc_feature (693)..(693): n is a, c, g, or t
  misc_feature (697)..(697): n is a, c, g, or t
  misc_feature (700)..(700): n is a, c, g, or t
  misc_feature (706)..(706): n is a, c, g, or t
  misc_feature (709)..(709): n is a, c, g, or t
  misc_feature (722)..(722): n is a, c, g, or t
  misc_feature (726)..(726): n is a, c, g, or t
  misc_feature (732)..(732): n is a, c, g, or t
  misc_feature (741)..(741): n is a, c, g, or t
  misc_feature (788)..(788): n is a, c, g, or t
gtaagangcgggtgtaagttatggggtcattaaattgggcgcagttacagttagttgaagatgttacgtttnatgnnttctcagattttccctgggacacacggctctntgggggggcccggcgaaaccactcggaccaggagccatcgtacacggccacatcaggcttgcngcagaggtaggcagcnaaggccacgtggnagggggtgantcccttgnggnacgtggnaatgagaggntgcgagagatccaccttcttggtctggaacagagcacggagctnttctgggcncttntcgaagccatcctcagtnaggaagtncatgaaaggnatgttgacggnaccacggatatggcccgagtncagtnctactgcatccggctccggntcggtgcccaggaaccgcccttgagaccttgaatccaccagctggaacctcttagattcaaggttctccagcacctgctcgtaggtcttgagcagggagcggtgccagtgtggctttgaagacggccggttctgggcgtgagggctcggatgtcaccgggtggccctccttcagccagtnccggaagccaccattgagcactgatacggtgcggtggccaaacacacggaacatccaccagacccggggagcatagaagctgcccaggtgttcaccatcatacaccaccacgtgcgtttngttnctgntgnccaggnggnccacatactcggngaanaggccntcgctgggnagcatcatctcgtagggcgacgccgtgtcccggcactcttctatgtnaaagaaagaggcggccgggta

SEQ ID NO: 650830 - DNA, 422 bp, Homo sapiens
  misc_feature (13)..(14): n is a, c, g, or t
  misc_feature (177)..(177): n is a, c, g, or t
  misc_feature (368)..(368): n is a, c, g, or t
  misc_feature (422)..(422): n is a, c, g, or t
actgttgctcatnntgcaggactggctgcggcactcgcgggaacctggtgtgggccatgcgaatgtactgtacaaccacatcttcacaatgtccagtagccgagttccaccagttgtcacagattggggtggtagccttccaggttgtacctaagtttggagttagacttgaaatgnaagtgctagcacagttgtgttgtgggtttgctacttccatagtttacttgacatggttcagactgaccaagcatagttttcagtgacagtctgtagcagttgaagctgtgaaatgtgctaggggcgagcatttgtcctcgtgtgtggtgactttgagtgtaacagcgtgatctgaccaatagtacacacangacgcaaggtttaactgggtacttgaaacacaggattatgttaaccaaaaatan

SEQ ID NO: 650831 - DNA, 741 bp, Homo sapiens
  misc_feature (28)..(28): n is a, c, g, or t
  misc_feature (33)..(33): n is a, c, g, or t
  misc_feature (42)..(42): n is a, c, g, or t
  misc_feature (44)..(44): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (88)..(88): n is a, c, g, or t
  misc_feature (90)..(90): n is a, c, g, or t
  misc_feature (99)..(99): n is a, c, g, or t
  misc_feature (101)..(101): n is a, c, g, or t
  misc_feature (112)..(112): n is a, c, g, or t
  misc_feature (129)..(130): n is a, c, g, or t
  misc_feature (550)..(550): n is a, c, g, or t
ctccctaaagggaatttggccctcaagnccaanaattcggcncnagggaccccccacgcctggcccanaanttntatcctaaatttcngngtaaagtananctaaagggttnaagtgtttttttttttnntttttgagacagagtctcactctgcactccagcctgggtaacaagagcgaaactccgcctccaaaaaaaaaaaaaaaaaaaaaaaaaaaaagaaagaaagaaagtgccaggaaggtgattgtagaattattggcttgtgagaatactaaccctgaatgccagtcagctattcacccagtgaaaggaaaggttccggtgggagttgatgtgattaatgaatatatcagggcatgtaatggagttggtggaatcatgcataaggctatgataatggttcaagccacgacagagttaaaagtgggaggtccaattaaaaacttttcaggcaattgttacaattgtgggcaatttggacacacaaaaaaggaacgtaagaacaaatcgaacaaacaggcaagatataatcaaataaaagaaccncctggcttatgtccccaggtgccagaagggtaaacattgggctaatcagtgtcacttcaaatttgacaaaaatggccaaccgttacaaccgcagtcgggaaacaggaagaggggccacctcaggccccgctccaaacgggggcattctcactccagcctgggtaacaagagcgaaactccgcctcaaaaaa

SEQ ID NO: 650832 - DNA, 1523 bp, Homo sapiens
  misc_feature (113)..(113): n is a, c, g, or t
  misc_feature (400)..(400): n is a, c, g, or t
gctgatgctgcctattactcctcttagctatgatgagaccatgctcgcatcctcgcgttgcagatgagttcatcgctctagatcagcaatgatcaagaatgggacctatgcangtgacagccctcaaggagactgcagactcgaaagaggcattacgcacgtagtcgccatacctacccacgggagaataccacgggagtgatgtatatccctcttctcgccaatctatcgacgaataggtatacacttaatgctgatgctaaacctgcaagcgggtggagtgcaaaatcttcagtgactcaggacactaccgacgagttgatgactgcatgtaagcgcctaagtccacttagtatagctcgagttggtaatgatgagttgattcttcacgactacgaantgcgccctcgcccagatcacatacgtctagagactctcagccgtgaagttagatccatgaaactctcaggttggaatcatcaaacaaaataggactacgaaaacagtgagcgtctgaatacagtagtgcgtgcaaatcaccacagagtaatgctgacagtgaacgcctgaaagagcctgtgtgtccattctcagtcatgacacccacacacgtggatgacttattagtccctcttagagaacactctcttcgacagggatttaaaacaatccaatcgaaagaacttgtgtcgaatcaagcaatgggacgttagctggaggcccaacaagtactatcatgaaaccctacggaatgggacgcttcgcgacacggcatgcgaatatctaggtagttcgctccttctgtatagatcgcggaggctcctcatagtgttgtcctggataaaaatcgcgaagtaaagaacccccccctagaatcttccaatacgctatctcatcctaagctcgttcttttggcggatcaaagcgccttatggtatttacccgggtcatattgcgataaccaccgtcggacaattaccctttgactgaaacgggggatatagcaaacaagattacagcccgcagaggtccacccacacgggtacaacaggaccggatacagagtacaaagagggatggtacgtcgccccacaggaagggggggggtcccacggacatacgtggggcctcaacgggtatgtgacctaagcggcctcgggaacaagaggctcacgggataaggcccgcgtattactgcaaaaccgtataaaggggggaatccgaacaccgggttgagcaattctcacgcagataggatcgtaaggaacaggttccaaacgatggcgttcacgctttggagactatgtggcccctgtaaagcggcgtgttataggcatcggggctcggttgaccaccattgcgtccccagggtatatctttacaatcggggcaattttaagcgtgaggaaaaccactacttcgcgttacatatgtagcaggtgagacacaaagagtcgttaaccatgtgccaaggtgttcctgggagcagaggtgccacttcggagtgaacactaccatagata

SEQ ID NO: 650833 - DNA, 130 bp, Homo sapiens
aaaattgtgccactgcactccagcctgggcaatatagtgagactcaatctcaaaaaaaaaataagtttggctttgaagaagaggacatctaagtcattattttctagtcggtaaaagtagctgagacgtc

SEQ ID NO: 650834 - DNA, 176 bp, Homo sapiens
gacagacagtcggggggaaaaaatcaaaacccacattaaaaaaaaagttaacagtggtctggggccacagcagaacccaaatgaacatattcgtataattggaaaaattctaggtgcttcataattggaccgtttggatacaaaatggacctaattaaatttggcaatttggtaat

SEQ ID NO: 650835 - DNA, 906 bp, Homo sapiens
ggactgacggtgacggggcggagaggctgtgcgctgagctgcgtaagatgaatgccatgagtgactttgggatctagagtcttaagacggacgagtgattccagtctcactggaacttttcagcgaagttggagccttttgagaagtcatgatcttcttcggcaaaggtttggtacttgtgtgactatatgaacttttggctagatcatccccttgcacattatcacgatcacaaatttcctatggctcatgcctaagataatatctgagattgttccacgctgcagaatagcgattcggggtctatttgctccgactagagaattacagatggaactgacatgggcagtgcagtcacggtgtgcaagtcgttctttgccacttctctttgacacttgctgcacaatgctttttcaggttggatagtttatcgaaggggtacatcgattgaagatcgagtgtcggtattcgagactgagatgatatcttcaatgagtccaattcggcagaaagccgaaacgttcctggtgcagacgcccacactttagacttgcgtcgtgaccttatctacactcgggcttatacttcgtccatcatgtggtcgcattgttccacttgggaataccctggaggtggcgctggtttctttgggtcgtcattctgtcccatctgttctgtccctggtccactttccaggattggtaacaaccataaccattttcaaagagaagttacctcgactcactccttgaaggatattttcctggcttcctaagttatgttcatccacgattgatccagtgtttagatgacatcatctgggagggggggttctatcgggttttcacaaagtcattggttgaacaaatttaaaataacgcccttagaacggggcaggaatccctg

SEQ ID NO: 650836 - DNA, 346 bp, Homo sapiens
gagatggagtttcactcttttgcccaggctggagtgaagtggtttgatcttggctcactgcaacctccgcctcctgggttcaagcgattctcctgcctcagcctcctgagtagctgggattacaggcgcgtgccaccatgcctggctatttttttttttttttttgtatttttagtagagacggggtttcaccatgttggtcaggctggtctggaactcttgacctcaggtgatccacccacctcggcctcccaaagtgctaggactccttggaaacattctgtgttgagtgtgaagatggctacatgactgtttgtccaaattcacagaatagtacatacatacc

SEQ ID NO: 650837 - DNA, 434 bp, Homo sapiens
cttgaatctgagaatctagaaatcctagaatctgccggtacatctgaatactttggacgtatccagatgatgctcacaagaaatcctactggagcatatcagatttcggattactggctctgggactggtacgtataatgcaacttgtacgtgtagtgcaaatatcattttcaaaaaccctgaaatatgaaacacttctggtcccacgcatttaggataagggctactctgtactaataactacaacaacttacctctatggctatgggccgttcctaacctcaattaacaacagttacagtgtctcctactatggtcccctacgaacaagctaccacagaacacatgcccttttccaacaaaacacgtctcattacgatggcatggtattatagttcgatagatttgttagtaccaatcctatatgtgtgtta

SEQ ID NO: 650838 - DNA, 311 bp, Homo sapiens
cctggacgtatggtcattagctttgggaatagaagagctacacagaagcacactgtctttgaacttgacaacagctctccctttaccctggacttcaacccaagctccgtctttggtctcggtggataaacacacagtgtggagatcccacgtactgcatgatagggatgatcttaggacagcctccctccatgctttcagagttaggagtgagaatgatccatgcactatgtaggtgatggagggagagtgtattgctaacccttccaggactagtgcagcgctcacatttggcgggtctgcatgagtga

SEQ ID NO: 650839 - DNA, 841 bp, Homo sapiens
ggatctcagactgctgtgctagcaatcagcgagactccctgggcgtaggaccctccaagccagatgccggatataatctcttggtgcgccgttttttaagcccatctgaaaagcgcagtattcgtgtgggagtgacccgattttccaggtgtcgtccctcacccctttcttgtgactcagaaagggaactccctgaccccttgcgcttcccaagtgaggcaatgcctcgccctgcttttggtcgtgcacggtgcgcacacccatgacctgcgctcactgtctggcactccctagtgagatgaacccggtaactcagatggaaatgcagaaatcacccgtcttctgcgtcgctcaacgctgggagctgtagactgagctgttcccattcggccatcttggttcctccgaaatccaatttgtgaaataaattatactgtggtaacatgtgtgtcaaacagataacagctacagagaaaatttatgaaaggagagtcaatagttgtagaaaatttgggggttaattttacgaaattatgacagcaactcaaacttagaagcaacaagctggatcagtccaggagaattttaacattgggattctggcattaagaagagctaatcaaggaaatcattctggctgggtaatcttataagaaattcggaattaatgaaggcgaataggagaagttgggactggggagcagaaggttggcagggaggataaatgtgcccagattgaagggtggactaaaggcgatccccggataaataaactccttagaaaagagctgtttcaaagcgtggaacctgtaaagagcgtgatgagcaaccctttgttcgg

SEQ ID NO: 650840 - DNA, 733 bp, Homo sapiens
cttccatcaggagcttagttatggcaggattccttgtagggctcatagcagtacagagaggtaagtcttgcctcagagggcctgtatcttgcggtagtttttaaatagggcatagtgtataggtatagaggacatttgtttgcacatagtttgttgccccgaatgggttttttacccagccttttttctttcagtatttaccagtccggagcaccagattctcttcttttccaaaaaccaaagtaattcgctttactttaccaaccactaaatctgggctcttgaatttccccgtgcattggactgattggattgttgggagttagaggctgttcccaccatccttagtttgggagagtggctccttctgcttgttttctaagcgtaccagtcaacgggtgccctattgtggtatttaacatagttaggatgattgttcccaatagctgagttgttttatattctagaagtgaaatagttcaccttaagtaataattcttctctcagactgactttaaaaaccaagtgtttatcattttccattgtatttgtatttattacagagtgttttagctttgatattctttgtattttcattcatttgttacatgagctttatcagtaacatctgtataaatggtttttaaaaattaactatgtatgtgcccatgccgaagtcgagccatataaatccatgctgtttgcactgtcacagcatcaacgttttttaaga

SEQ ID NO: 650841 - DNA, 545 bp, Homo sapiens
ggataacggaataccagcgcgtacgtcatgtatgggacacagcagcaattatgtggagggagtctgcatgcaagaaatagttgaaggttgtaccggagcccttcacatcctagctcgggatgttcacaaccgaattgttatcagaggactaaataccattccattgtttgtgcagctgctttattctcccattggaaacatcccaagagtagctgcaggggtcctctgtgaacttgctcaggacaaggaagctgcagaagctattggaagcttgagggagccacaggtcctctgacagagttacttcactctaggaatgaagggtgtggcgacatatgcagctgctgtttggttccgaatgtctgaggacaagccacaagattacaagaaacggctttcagtttgagctgaccagctctctcttcagaacagagccaatggcttggaatgagactgctgatcttggacttgatattggtgcccagggagaccccttgatatcgccaggatgatctagctatcgttctttcacgctggtgtatccg

SEQ ID NO: 650842 - DNA, 255 bp, Homo sapiens
gggttcggtgacctgttcggcaatctctatggggctagcggggcacgtcgcacagcgtcccggtcgccacgtcggggagctgacgttgagggggagacgacgatttccttcgacgatgccgtgtctgggaccaccgtcactatggacatggtctctcaggcaccctgccaggcatgtcgggggactggagctcgggctggtaccgttccgcgagtgtcgacgcggccgcgaatttagtagtagtaggcggccgct

SEQ ID NO: 650843 - DNA, 1086 bp, Homo sapiens
ccagcccggattgccacatggctaagtgacaagaaccattggggtgatgagatgattaccttcaacaccttcttcagtgagcacgggcgctgtcaaaactcggtgccccgggctgtgttatgtatacgtatggaacacccacagtcgattgacttgacaacgattcgcactggcaccttaccgtcatcatctctccaccctgcaacgtcaatgcatcattcgacaggcaatgaagatgctgacaataactatgcccgagggtattacaacattggcaagggagataattgaccttgctgtaggagcgaaattccgcaagcctggctgaccacgtggccaccagttctctcaggcgcttctatggctatatccatccacgcgttttgcgtgtcggaacctgcctactggggttcacttccctgatcatgcaacgtcactcaaataattatggactagaaatccgaacactgtatggtgctacatttacccggagacactcaggtttcgccacaagatgttaagataaggccctacaaattgcccatcctacatgcattccgagcacgcatccctgggagtcactcctgattgtgtccttgcatggtaagatcagattgaactgggcatcgtatgaactctctgttcggggataaaaagtcttagcagatacgaagccggcccaagctaacgatctaagcaatgatccggcttaattagccagattgtgtcctccatcactgttccctgaaattgatggaggccctgaagtgttgacctgaacagaatactgagacatacttggtgcctaaccccgattcaatttcctcaggcacgtatgccctgtcctcttgctgggaaagccgacattgagaggttctgtgacaagataacaatggtggtttgaccagcaacacaatgggaatatgaccttcacaggaaagaataggaggagcagtgaccgggagaggacaaagaaggatgggcgacagagcgataaagcgagacaatggtggccccgacgagaggaaaaagcactgggagggaaagaagagcagtataaaccaatggtaccgacaaaagaagaat

SEQ ID NO: 650844 - DNA, 162 bp, Homo sapiens
aactttggtagggagacgggtatgttaacgccataccagttctcagccaggcacggtgcctcacacctgtaatcccagccctttgggaggccgaggtgggtggatcacaaggtcaggagttcctgaccagcctggccaacgtggtgaaagcccatctctact

SEQ ID NO: 650845 - DNA, 139 bp, Homo sapiens
ctccctactctttatcactgttattcccatcgacttcgtgatttacatagtttcacgtgagcacattttcatctttcttgaattctttagacttattcatcaaattcaactgtcatttctcatcttcgtttctctttat

SEQ ID NO: 650846 - DNA, 652 bp, Homo sapiens
agcactctggaaacacgttgtgtgggaggcagggcatttagtactgagtttctgtatgcctgggtggtacagagcattaacctctaacatcttaaacatctcaatttaaattttctcctttctgaaagataaccacctgctgttccatctgtttaatacatcagtaaaaataatgataaatttacaaaacaactgacacaaatgtcaagtcttgttatcgttgtgaaactgttctgactgtgttgccaatttgcaaagctactgagtgtggtggcccgacacagtgaagttctgggaagtgacctcctggtgcatcactttgacactgagaggcttttcacggggctgtttatcattgaacctgtgcagcagacttgtttcagagaattgtatcacaccccttgagcatccttccacagttccttcgaccccctggggtgtttgagggactagaggtaagatcctcgttttgagcactcggtttgagctgccaaaatgtgttgagctacctgcaaccaattctgagtgacattccgagcaccatctctcgtttagttgccctttactttctactctcggactgaaaacttccaggtagtcctcccaccacaaacgtgggatccgtgcacgttaacgatacagcagaaaaaaa

SEQ ID NO: 650847 - DNA, 185 bp, Homo sapiens
gaacttcccgaacgtgacgtgaccgaaggtgccttcggtgaaggtcttgccgccgtgtgactcgaacggcagacagaacgggagcaccgtgctcttcatcgacgcggcgtaggacgcgtcgttcgcatccgccttgaacgccggggcgatcggcgcgtacgaggtcgagatggcctcgctgctcc

SEQ ID NO: 650848 - DNA, 263 bp, Homo sapiens
  misc_feature (110)..(110): n is a, c, g, or t
  misc_feature (137)..(137): n is a, c, g, or t
  misc_feature (152)..(152): n is a, c, g, or t
  misc_feature (176)..(176): n is a, c, g, or t
  misc_feature (233)..(233): n is a, c, g, or t
gagattgcgccactgcattccagcctgggctacagagcgacactccgtctcaaaaataaataaataaaaataaaacaatacctttaaattatgtgcatgtattctagtcntctggtttctgaagactgtaatgccanccttggtaaagctgnacagtctagttagattatttctanggtcttcatttctacattatgtttattacctacatttgcatttatcaatgtagtggnaatatcttttaaataaatcaaacttaactg

SEQ ID NO: 650849 - DNA, 449 bp, Homo sapiens
gttgagagagtctacgggccgtggcatcatctgcatcagcactgaactatcctgctactgcagggaggaagctccttactttgcatatgtggtagtcctctgctcgccgccgtaactcttgcgccgcgttgaaacattttcctatggattacaaccactttcatcatatatagcaccacttgcaggatgattttaattaatctgccatgtttctgtaatcctcacaactgtacccttactcaatctatctctccctagaaaacgtattcccgatggctagaagagtacagtctgagccggtcacggtggctgacgcctgtaatcccagcactctgggagggcggggcggatggctcacgaggtcaggaaattgagaccattgtggctaatatggtgaaaccccttctctactaaaaatacaccaaatcagccgggcgcggtggcgcgtg

SEQ ID NO: 650850 - DNA, 1160 bp, Homo sapiens
  misc_feature (218)..(218): n is a, c, g, or t
  misc_feature (767)..(767): n is a, c, g, or t
gctaggtgaggctgggttgatcggcgaggccacagcctcagctcgaatgtgacagttggccagtgagaagtcagagatgcagcgtcactatgtgatgtagctaccgagcatgtcctacggcttgaacatcgagatgcacaaataggcagagatcggcaaaaggctgaacgggattgtgcccaggtcctgccctacctctcccaagagcaccagcagcnggtcttgggagccattgagagggccaagcaggtcaccgctcccgagctgaactctatcatccgacagcagctccaagcccaccagctgtcccagctgcaggctcgctggctccgtgtcctctttgcactcgcctagtacccgtggggctgcagccggccttcgactgccggcggtcagcgacgaggcactcgggcatccttctcgtctgtccgctgctgggttccccaggtcgcacctctccaaggtaagacaagaacgggcatgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccgcggggccccagccagcttgcaggccacctctagctttcttcctaccccattcccggcttccctcctcctcccctgcagcctggttaggtggatacctgccctgacntgtgaggcaagctaaggcctggagggtcagatgggagaccaggtcccaagggagcaagacctcgcgaagcgcagcagcccggcccttcccccgttttgaacatgtgtaaccgacagtctgcctgggccacagccctctcaccctggtcagctggcatgcacggcaattgctagcatgccccattctcccgtcctgggcacccacgagtcatcccccgaccaccggctcccacggtatgctcccacctccagcctgccccactcagccacctgctgcagattccgagacaccatccactgcgccacctggatcgatctccgcatcgcccacagaaacgggggggcacgagggacgagcttagctgagaatagccacgagcggtagaggtgcgaa

SEQ ID NO: 650851 - DNA, 199 bp, Homo sapiens
ctatcgtgtgaccgcgtggtggcacgaaattgacaaccctgggatagtatagcaagttaactttcgttcattgctaaaggttaatcactgctgtttcccgtgagggtgtggctaggctaagcgtattgagctgcattgttttgtgcttgatgcttgtccttttgatcgtggtgatttagagggtgaccacgacacagtg

SEQ ID NO: 650852 - DNA, 102 bp, Homo sapiens
gatttataaaaccattgtcggtaatcaaaggatgggtgtcattttcccattggccattgtagtctcacttaaaaaacaaacaaaaaggacaaggaaggggaa

SEQ ID NO: 650853 - DNA, 813 bp, Homo sapiens
aggtgaatgactggcaggaggactgggtcgtgtcttatgcccggcagcgcattcagccccagatggacatggtggcgaaggagtctggggacagggcattgccctccatgctttggtctgctctgcagttaacagatcccatgagctgtttccgtgacctggtagatcatcctcagcctttactccactggggacctcatggggtggaaacatagcagaggattcctctgggccggctgatttttgacccagcttctttctacggtcactcggtaatatgagctggcaatacgctggcatgtctgggggctttagccagctccttttactccagctaccacggtaaaagtccccaaggacccaggattcgacgaagcgccttcaggttgtatcagctctttcacgtacttgaaccactggaatcatgttggatcggggctacagaggatcctccctgaacatcatgaggaatctggtcaaggtgagcgtggccttactctggaaaggaggcctcagaggttactccacagtcctcttctgggcaaattcttgtttcttcaccaatgcccggactaagcattacgacctaatgcgcagcagcttatatccaaggccttgcaaaggtatataaactatctacgcaggaaacggcttcacgatcatacccaaacgtagtccactatatgtggggctttgtacggtagaacggaaccatcacatacattgcaaggactgagcagaagggatgtatgacgatagtgctgactctgaccctcacatgcctgctgaaacgcgggtacctgtcatggaccc

SEQ ID NO: 650854 - DNA, 236 bp, Homo sapiens
gtatgaataggatacagtccgctctgggacagttatctacggccagaaagagtaccgctgctatcatgaggctctgagtgagctgttcactgcgcataaagcacgagttgcgagctatcagtgactatgccagtaccttggcgaggatctatctcagacgcgtgaggactcccccagccatacagctgacatacctgacctacaggcagacgagtggggcctatctctagcttggt

SEQ ID NO: 650855 - DNA, 207 bp, Homo sapiens
  misc_feature (82)..(82): n is a, c, g, or t
tctaatcgacggtttctccaaagtgacaaacaatggttccatcactgtgccaacatattttctatttttcaactataattgngcgaacactaaacttctcccagtctgaaaatcttgaaacaacaatattcaatgggtgactagggtatacctcatatgtctgggcttcccaattctccaattccctaggtttcaagttcatgaact

SEQ ID NO: 650856 - DNA, 299 bp, Homo sapiens
ccacggggttttttggggattttttttagacccccccccccctctgcgcccctttggggggtgtgggggggccgggggccccgtttttaaaaccggaccttggttgggtccccgcccggccccccggaaccccccccccccctgttttccccccctttgcctcccccggccccccccccccctctggcctcccccctcgcccccggggcgggtccccctttccccctgttcccccgggggccccttgggcccctttttcccgctgtttgggggtctctcttttgggcctgcccgcgggg

SEQ ID NO: 650857 - DNA, 256 bp, Homo sapiens
accgtgtagaccgcctcagcttccagatgggtcattcagcgacgagtactggtgtccctcttctggagaatatgggacagataggtcccataccaactgtgctttcttagatctgccatcataggaaccagactttaacaaccagcagcagagctacacagcattgaggctttctttttcccttttcaggcttctggctgtaatgagtcggagatccctgatgaagtgcagctgcattggggtttgctcagttgca

SEQ ID NO: 650858 - DNA, 115 bp, Homo sapiens
agtcctcgtgctccatgggcattctctcaggcaaaagaaaacttatcacttcgtgaagaggaccggtcccctgccacagcgaggtcgcaagtcagccacagtaaaaccgtggtgc

SEQ ID NO: 650859 - DNA, 111 bp, Homo sapiens
gcgcgtaccatgaaaagaacaaacaaccctatgtgtcatgcttaatggactgaagaagatgtataaaatcaacatgatgctaccttcacaccttgaatcatgtacgatagt

SEQ ID NO: 650860 - DNA, 425 bp, Homo sapiens
  misc_feature (302)..(302): n is a, c, g, or t
tagaagtcaccaactgcttttcggtgccacacaatgagtcagaagatgaagtggctgttgacatggaatttgctaagaatatgtatgaattacataaaaaagtctccccaaatgagctcatcctaggctggtatgccacaggcatgacatcacagaacactcagtgctgatccatgagtactacagcagggaggccccgaaccccattcacctcacggtggacacaggtctccagcatgggcgcatgagcatcaaggcctatgtcagcactttaatgggtgtccctgggaggaccatgggangtgatgttcacacctctcacagtgaagtacgcgtattatgacacttgaacgcattggagtttgacctcatcatgaagacgtgttttagccccaaccgggtgattggactctcaagtgacttac

SEQ ID NO: 650861 - DNA, 1058 bp, Homo sapiens
  misc_feature (139)..(139): n is a, c, g, or t
  misc_feature (375)..(375): n is a, c, g, or t
  misc_feature (402)..(402): n is a, c, g, or t
  misc_feature (599)..(599): n is a, c, g, or t
  misc_feature (662)..(662): n is a, c, g, or t
  misc_feature (674)..(674): n is a, c, g, or t
  misc_feature (677)..(677): n is a, c, g, or t
  misc_feature (685)..(685): n is a, c, g, or t
  misc_feature (718)..(718): n is a, c, g, or t
  misc_feature (942)..(942): n is a, c, g, or t
cccgtgctgcaggaattcggcacgagttcttatcggtgtgatgaaaatgttctggaattagaaataatgatgatgtttgtttacataattcgtgaatgtactaaaagctatgtaattgtatattttaaagagtgaattntatggtatgtaaattatctcagtaaaagggttataaaaggagaaataaaaagaatttaaacaatgaacagggtattagagaatagtgaaatagcttcaagaatctaatatgtatgaaactggagagaagagcaggaaagaaaaataatttgaagaaataatggctaaaaatttctcatttgtaatgaaaactataacctccagatccaagtgtctcaaaaattccaaggacaaganacatgagaaaaacaagttagtctgttntctgctgctgtaatagaatgccacagatcgtgtaactttacatagaaaagacgcttatttgtttacagttctggaggctgagacagtcaagagcatggcttttgcatctggtgagtgtaattcatgccagaactgcaaaaggtggaacgtcaagagagcccatatgaatgacggtttgctatattacaaaggcactnctctacaactaccccactccgatgacaacacctttcatgagggtcgagcctgtatgaccaatntacctcctactnggnctcacttncaacactctggcataaggagtccacttaggttncaacacatggattttgtgcaaccttaaacctatgtaccaccaaagctattgtagccaatcggtcaaagtagtgatatggattacttaaaagagccagtaaaaaatctttgtcgggaaattaaaagaagcgtttgcttatgtgacctggcctataaatgcgggggcgaactttttaagattaaaccaagcaaaactgaacctggaattttacccggaaaaggatnttgatatttatccttgataatgagggtctacaaaatttaaaggtcaattttccgtggctcctttattaatttaaggaaactttgcgtaggaaattgcacgaaaatggtgacaaaca

SEQ ID NO: 650862 - DNA, 84 bp, Homo sapiens
ctgaggctccagcacagttccgtcattctcgtacctggggaagccccactctgacctgttattaaagttcacattttgaatgcc

SEQ ID NO: 650863 - DNA, 801 bp, Homo sapiens
ggcgctgcgtagtggagcacatgccgtgtagtgcgctgatgccattctcagatacgtgcgcagggttggtgatcccccccagacacttcgctgagcgagccaatggaagttcagtggagcagaaagagcttcctctgagcctctagcgggagatatgcttccccagcccctgggaacaacacgctagaaagagggccatgttcccgaggtccaactcctgctcctgaggtgtggtgcttcccgggatgaactagagactggagcttcagctagagacaagaaatcttgggacaagctagccaagtccgcccccagaatgggtccctgattatccacgcaggagcattcagaatgccagcggggacttgggtgaaagaaccggctagtgccgcacgtcgtgagttgagtgccttacgctcaaggtggtattgcctggccacagtgagacgcgaaagcctccggtctgattataccaaaagagcgacctgcaaggacagaccccaaggtactggttccccagcagcgttccgcgcagttgggtcctagcaggggccgtttgctgtatgcattcctttagcatcttttgcgtctatggcctctttcctcattcaatgggggacccgtgttccccccccttcttccctttcaccaggtacttttaaaggaaaaattcaccaaggttcgggattttttcctgggaaacgaacatacaaagggctcaaaaaatattccggggggcacttaaaagatcttgggcggtgggaggaaaagagggggtggatacgagaagggggtgcccat

SEQ ID NO: 650864 - DNA, 588 bp, Homo sapiens
  misc_feature (165)..(165): n is a, c, g, or t
  misc_feature (276)..(276): n is a, c, g, or t
  misc_feature (369)..(369): n is a, c, g, or t
  misc_feature (378)..(378): n is a, c, g, or t
  misc_feature (412)..(412): n is a, c, g, or t
taccaaagcgtggacgcggttatcgacaaagatctctctaccggtctgctgggccgctgaaattcacgccgacattcttgtgatcaccaacatggcagtcgaagacagtgtgtattcgagcatttggcgaatagccagcaagcaagcgaggtcgcttcgtattcngggatgtgatagttgcgcgaccaagtggaccacgctaatagtgctagagacagggccagtttcaccgcgcgcgtgacagacaatggttagcgcgaaaaagtcccagtcggncacgaggcgcagtgagagaaatgtagtttcaggcacactgaagggcgggccgagagaagagaaaggtggagtgtatcaacgcgacgactcggnaaattgtcnctggcctgtgcgggtcggcctgtcgtgcggtcgnaagacaggcgcactccatcattgattcaatagacggtaagggagcgtagagcatgcaacacgcaagaggcaatgagcgcgccgcgtgcacatttctttgagcccagcagccggtgaagcatcggtcaacccgccgtctctgcgccttggtattgggatgaccggtcgttgttgccg

SEQ ID NO: 650865 - DNA, 1031 bp, Homo sapiens
ggacgcgtgggtcgagccacgcgtccggggcgcaccattggcatagtcatggactctggagacggggtccacccacacggtgcccatctacgagggctacgcgctcccccaggccaatcctgcgtctggacctgggtggccgggacctgaccgactacctcatgaagatcctcactgacgaggcttacaggctttcagccaccacggccgagcgggaaatcgtgcgcgacatcaaaggagaagctgtagcatacgtcgccctgcgtcctttctgagcagagagatggccctccgctcggatcctcctcttctctgtggagaatgagctacgatgctgcccgatggccaggtcatcaccattggctaagtgaggcggttccggttgtccggaggtcagctgttccagccttccttcctgggatatggaatcttgtagtgcattccacgatgaccaacttccattgtccatcactgaagtgttgacggtggatcaatccgccaaagacccttgtatcgccaactagcggtgctgtcggggcgagtacccaccatagtatccgggcattgccgagcgaggcatgcagaatggagatcgccgcctggcgcccagctccatgagagattcaaggatcatcagtgacccccagagcgcaagtactcagggtgaatcgggtggcctccattctgggcctcatggtccacccttccagaagatgttgggattagccaagccgagaagtacgaggaagttggtcccctgccatcgttcagcgctaatgacttctaagggcctcgagagattggctaccatatgcttggcgggggtcatgtgacattgacatttgcgcgtggacatgcaaatgctttgttatctaggagacgggagatgcctgcaaaaactgtcttcggaagtgtttgcaattgggcgatttgacatgtgcatgacgtgtttgacgcgagaccgtttttgtacaacacaaattaaaaactacaggggacatgagaaaaagttggagaagtagaaaccatag

SEQ ID NO: 650866 - DNA, 380 bp, Homo sapiens
attaatggaactaaactttttaacctctcccttatatttacctccctttggagggatttatcataggtgcccatttttattttagggatggccttctctttttgaaagacttcctaaagtttggggggaatttttaaaacctggggttctaatgattggatttttgctaggccccccctttttaaatataccccatgggtttgatggggcctttagggccgaaataacttaaaccccaataacctttgccaaccttccagctggggtatattcccatggtgtttttttttttggatatatacttttatcccgtagggtgttaaacccgtttggccctgttttgtttcccaactttaaattaactttttaaaagctgggga

SEQ ID NO: 650867 - DNA, 966 bp, Homo sapiens
gcttgcccggagggcctcggcccggggctcattgtgtcgggttgcggtgatgcgaatccacggtttgtcgctgtgatgagggacccgtggtagtgtcaggagaatgaatattggctgcagtaatgaactacatgcagatcgtgggtggtcgacatggctgtgtaagcaacatgagatgtgggcttgtaataggaataggctcttatggagaatcattgagaaaatgtggatgtctaaattgagttgatataagaagcagtctcttcagcagggcacgtccacataaattaggtcgcgacacgagatgtaagtccacaggatggtgtgtaccagtgtacgctgggtctccctgacatgggcccttaccttaccagatattcctgacatctggcttagctagcaggaggacgagcactactacgcctatagatcggacgtgttggagatggtcgccggcgtaggacgagccattttcggaggaccatccaagagaactgttgtgtgccgggactggcgtcgtccgggtacgcgcaatgtcaactactggacggaaaatacgccgcaaggtccatgaacaggacccggagtgacttaccgcccgaaaaagtagaaaggtggtcccagagccagattggccgcatcagggccggggaccaaacccacgtgtgcttgaagccccagtgtagtgccccccagatgttgtcgaaaagggcccggggaagggcccgaaccaaggaaaaccgcagtttatcgtgcacaagaggactgggccaccacacctggcgagcgcagtgaacagtgcctgcgcacatcacccggatggcaaacaactattccttgtgccactccacacacacactactaatccagtgtggcacaccatcactatccgcacgaagcgcgactcaccagctcagctcttacctctacgtttttgactctcccgctctctacctccaccactcc

SEQ ID NO: 650868 - DNA, 522 bp, Homo sapiens
ccaaatgattagtcggctgctcgtgagtgtggatccaccagtggtgaggggtccacagaaaagtatatcttaaatctaagttccatgagcatgtgaaaaatacttttccggtgggtgtcaccggaaccggatgagaatcaggttccagatcaagctagttgtatgggcgtatctgcgcaccatagaaaagtccatcattgtgctagccgtccaaagagatgagggacggtgctctgccaatgtgactcgctattatgtgattccaagatacagaaccggtgatgctgtttcacctagtactgggcgtggaggggaaaagcaagaacttggttagcagggaggatagcaaacgtgggtgtgcaaaaagcttagaaaaagaaaaagaagatgccaaagcttcgctttggcagtagaatccgggaaaattcggaagaagcaattttaaacattcttaatatgtcatcttgtttgtctttatggcttatttgcctttatggttgtatctgaagaatatatgacaga

SEQ ID NO: 650869 - DNA, 737 bp, Homo sapiens
agcggatcgtccagtactccttcctcatgaggcctgctaagtcgtcactctcctagcactggttacaacgagatgtcggagggagtggtagtcagaataaacactctgataaataaaaatgctccaatgatatcttgagatgtcagagcgtgaaaatgtacagatttcactggacgaagaagctgccaagtggtgattgctcaaccatagagcagtggaggaaccaaggaggccaaatgtgtgttggaaaaatcacagatgtcatctgggaatgctcagagcctagggctttcacgctgagacagactcgccttccaccggaacctcagccttttaaggctaaatcaaggacgtgacttcctcaggtgaatcaacctgacactgtaccctgagctcactgggatcctattggcagatcgtcagtcccgtacatggaaagaatgcctccaccaggaggactgggttagtccccatccttgaactggatcataaatagccaccttgtcataaagctgctcccccagcccagcatgtgttctgaagttcaccacggaaggctatctcctcatttgctttggggcccgcaggctgctgtgtaacagctgggtcttcccatgaacgaattagacagtaaatgttccaggatgaagaggggcttcggggaacagaatcttgcgcaattttgacttgcttcatttagacacagtgccatcataaccaaaattaaaaaaaagaag

SEQ ID NO: 650870 - DNA, 155 bp, Homo sapiens
  misc_feature (30)..(30): n is a, c, g, or t
  misc_feature (141)..(141): n is a, c, g, or t
gtttctcccttgctcctgcagacatgaatnaacacagctctcggagccacagcatcttcctcatcaacatcaagcaggagaacatggaaacggagcagaagctcagtgggaagctgtatctggtggacctggcagggagtnagaaggtcagcaag

SEQ ID NO: 650871 - DNA, 103 bp, Homo sapiens
gtcaacccaagagctggcaatctggggcttgtaggccctttacttcctcttcgtggttcttcttcatgaagagcagctcctcactctgtacaggtaggagaga

SEQ ID NO: 650872 - DNA, 133 bp, Homo sapiens
tctaaggatccccagtcatgccaatgatatttcctattcggctacataattcgtccgatccggtcccttacaaacgtaggaggcgtgcttgccttattactagtccatcgctcatcctagcaaagagtcgtgg

SEQ ID NO: 650873 - DNA, 445 bp, Homo sapiens
gtttcccctttttggggaggaaaaagttccccatgtcccacactcctgtgcatgcctaaccttgtcaccccatgccgtcagcaaatagtacacggcaggttaatccaaagagaatagcagttagcatcccatattgccaaacctgttcttaggcgaaagggactttaccaatagggactttactgagaggggcctctaaccccctaaatcttagaaaggactctaaccctcctaagttggcctctagcccaaggtcagtcaagcatctttgccttttattaacaggggcctttaacccaccctgtcttaggagagactctaactcccctaagttgggcctctaacccgatcccatactttactggggtatatgcaccccacttacccaaagtcagccaatcagtgctgcagtctacttcctttgagtcaggaagtttcctcagta

SEQ ID NO: 650874 - DNA, 324 bp, Homo sapiens
tctgttgtcaagatacatcggtcctacattcaagtgtctgcagaagagtgaagatgtaaacgtacatctagtggcaacgattcactcctaagcatgttaccaagaacaacaaccaaaacaacaagcaaaaacaaaggaacgaaacgaaaaagctccccgtaccaaccaccagccgatgtagagatgaagtcctcacctccctgccccaaaggggcttcctttcagggatgtctgtgaagaagatggcagccccctggcctgggagtaaactctaggtaataacagcctttccccataccctaaggcttccttgtgccccaaacc

SEQ ID NO: 650875 - DNA, 346 bp, Homo sapiens
  misc_feature (28)..(28): n is a, c, g, or t
  misc_feature (74)..(74): n is a, c, g, or t
  misc_feature (119)..(119): n is a, c, g, or t
  misc_feature (139)..(139): n is a, c, g, or t
  misc_feature (159)..(160): n is a, c, g, or t
  misc_feature (226)..(226): n is a, c, g, or t
  misc_feature (237)..(237): n is a, c, g, or t
  misc_feature (245)..(245): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (286)..(286): n is a, c, g, or t
  misc_feature (330)..(330): n is a, c, g, or t
ttaccaacttttaatttttacttaattntttaatatttttttttgttttattccctactttccatcatgtcctngtctgttatttttctcaattttcttctttcctatataaggtattncctctttatgcatttacgcngtttattctccttttcaccnnctttccttagttccttgtttaacttacttttttggctttgtctaccatggatttttttttattttntgtttttttcntattttangagaatctatgtnggctgngcnttcttctcacttcagtatngcttttctctagaggtttactcactatctcattcatttatgttntctgttttctctattt

SEQ ID NO: 650876 - DNA, 128 bp, Homo sapiens
aacgtcagcacctcctgtttccagaaatttaggttattctaggttgttttttactacttcaaacaatgctgcaataaacattctgtacaccaaaaaaaaaaagggatggctccatcctaaaaaaaaag

SEQ ID NO: 650877 - DNA, 439 bp, Homo sapiens
acgtcgctgggtgactcagtagtattccatcccccggcacaaatgtcatacgtccactccgcgaatcttccctcagttgacacgctcgctgtcgtataatgcagcatcttcctacatgtacattttacattaggacttgtatcaggaagtggtacatccaaggcagacataaaatcaggacttgcaacattttccaaaaaacaatcattcactcattttttggcaaaaacaatagcagttataccagaatctctggcacatagctaaggcagtgttaatggagcaatttatagcactaattacccacatcaaaaaggtagaaagatctcaagttaacaacctagcatcacaaattaaagaactagagaaacaagagctaacaaattccaaagctaacaggagaccagaaataaccaaaatcaggtggcatcgattaaca

SEQ ID NO: 650878 - DNA, 346 bp, Homo sapiens
  misc_feature (25)..(25): n is a, c, g, or t
  misc_feature (35)..(35): n is a, c, g, or t
  misc_feature (223)..(223): n is a, c, g, or t
  misc_feature (271)..(271): n is a, c, g, or t
  misc_feature (287)..(287): n is a, c, g, or t
  misc_feature (330)..(330): n is a, c, g, or t
aggcccacggtctcggcgtagaggntgcctgcagncctgcagccgacgctgagcatgctcgtggccgcatgcaccagcgacttcgtaattcacgggatcatccatggggtcaccatgaccgtggagctgcaggaagtctgtcatcactgtggtggccgccgtgtcctccgccagacaccgccgctgttcaggcggggcgatccggggaccaggggctgacctncattcgtacccactgcgctgtggcgtccacccgggccaggcaccttcntcttcatgggctgganccgctttggggaggcccggctgggtgttgccaaccgattccanggaagttccgccgtgc

SEQ ID NO: 650879 - DNA, 875 bp, Homo sapiens
caagccagatcagaaacagagagataatatccttgcaaggagagccagggaaggtgtctacatcttcacatacttgcatagctacctgacttacatcaatgctatcaacgggcaatcaagctgtaatgatgaacatggccaaaggtctgcagatgggctctgctgcagcagcagccagaggatgacagcaatgcgctcaccccggacccaggacctgatccgactctatgacatcatcttacagaatcttggtggaatttgctccagcttcctggttatagaggaagacaaagccttccagaaatgagatagtgcctcaagcactctgcgtgttcaaagcttacagcgtgtaacatcaacatttgctcagtcctcatgtgctggtgacgcacagttggcacgcgcacacgcccttgtcctgtatgacagagctcctgaactatgcacctgacgtacattctgactgctggccctatcaagcaacacgcctaaaggaactgcctgcagcagtggcacgagctcatcactacaacgtgcggccagcattacacgcatagcctcccactgcatatggacccgcctgcccatcccattgctcttgcacactgcaccagtacgcacaacaccaacaactcaaaccaccaagcaccctccatcccataccacagccaatgtaacactaagcactcatgcgccaaacaactaggcttacgaacgacaaattgccttggcactgaaacccacaccccacacgggcacacccatgaccccaccaaaaagcgctgctatgaccaccattctccaacccagacgcatcaccaagccccacatccaccatgcggaccacgcgtcatgacaccagagtcccgcgtggc

SEQ ID NO: 650880 - DNA, 868 bp, Homo sapiens
  misc_feature (386)..(386): n is a, c, g, or t
gcggagcctgcatgcgcatagatgttgatgcctaagaagaaccgggatagccatttatgaactcctttataagggagggagtcgatggtggccaaggaaggatgtccacaatgcctaatgtcacccaggagcttggtcatgatccaaggacatggtgcccgaacccttcactgtcattgaacggaccaatgcaagtcttcatcctaagtcctcgacggctacctagtgaaggagatcaggatttgcgcttggagatcaatttctatcatggttaccattatccaaatgatgaggtagtccgatgtatctgccggtgattatccattcaatcatagccgcccgagaagattagtgcactagtcgctaccccatagctgccagtagcnccgtccaagaagtacttggtgaggctcttctggcacgtaaatgcgtctggaaaggtgagcggatcttgccgtaagactccatcaagatggtggatacgctgatagtaataattaccataacaagagtgagatgctgcttgttggtcaaactaggctcgaccgatcttagaatagtgccgaagagtctaggtgcgtctggggatcttgtcaatcctgagttgccagttttgagaagggccggactttccgtgtcgagggaacgttggtgcactgccaccttcgagttaaatattcgggtagaagggatgtctgtcttgcgatttgtgattgaatctttaccatggtcaggaaagcttgtgggcttttaaacgatccaatggtggaactaggtggtattatgggaaatattggatactcgcattaaggacaaaattaatttcataggtagaaggggagaaggttcaaatagataggcaaaactg

SEQ ID NO: 650881 - DNA, 730 bp, Homo sapiens
  misc_feature (293)..(293): n is a, c, g, or t
agcgggccacacctagtggagcagccggggaaggcggctcgttgggggctggggcggagagcgccgggggtgggggcggaagggcggcgggcggaaggcaggaggctgccggggcgctggtgctgctgctgggagaaggggctccgaggagtccgcctgcggctcgctctgtcgccggcgcgggattggggcgcgagggccatgtggcgctgcgtcgtccttatagtgctggcagtgtctgcctgggtgctggagacgtgcggacgtgacgtgccactgatgaagactggctngcatgtcgaatgtgcctgctgtggcccagtgacttgggcagctgagtgctggccggctgtgctggctgtgctggcaccatgcaccaccatgtcgctgctcatgtgctgcagcccagtcagcagaagctggcggagcaagctcaccatcctcaacgaccgcgggctgtcgtgcatgctcgacccgcctctacaacatcaacgaagcaatggacaagtttgcgaaggcatgtggccgaccccaaggcaaaaccatcctatcttatcgacaaaaacctggaatctgctgtgaaattcatagtcagaaaattccctgctgtagaaacccgcaaccaacaatcaacagcttgcacaactaccagaccgcaaccatcagagactctgaacaatctggcattatattacttcacactctgtagatgttatggaattaaggacca

SEQ ID NO: 650882 - DNA, 244 bp, Homo sapiens
gacgccgagtcactcggaataccccgatgcatacaccacatgaaacatcctatcatctgtaggctcattcatttctctaacagcagtaatattaataattttcatgatttgagaagccttcgcctttcgaaccgaaaaagtcctatatagtagaagaagcctccataatacctggatgtgactactatgtgatgcccccacacccatacacacgtcagtcgaagaaaccaacttagtggggatc

SEQ ID NO: 650883 - DNA, 129 bp, Homo sapiens
acacatactgcagacacagctagcttcgaggagtcatcatgctgtatgcgaggctaacctgggcctcccacgagaagatgcacgagggtacgagggccctggccaccaccataagccaggcctcgggga

SEQ ID NO: 650884 - DNA, 668 bp, Homo sapiens
ctgaagtctgcgcggtatggagggtggtgtgagttcctctggtgggagggagaacgcacatctcttctggtgcggcacctgaggagtgactccaagaagagttccggcagctttccccaggaaagggtgaccgggtgacactcggctctggctctgagatgaggcagacggacccaggctgtgatctgtcctgggcggggaccaggaggtatcggggtcgggatcacctgccagtgtgctgactctgggactgcgtgctgtctccggaccatcagggtaggcgctggtgtggttagagaccatggaagtcagggaatgatctggaattcagggctgacggtctacggttgtccgcagggctgtggcgcagcctcttcagcttgcggcgagcaaactgcgagtgatgtcacaggtagctcctgggcaagaaatgctcgccattagcgcaggtttacttgcaaagacttccctctctattgtacccagggcagaagagtttctgtgagtcccactgacgaaagtccgcatggggtgagcggtactcctggtcggtcggcaagtggagggtggctggcttggtggtattgtcttcaaggagctctttcgctgctgcatctgcggtgtccctttgtgcttgtcccattgcacccctctgcagaccaccaatg

SEQ ID NO: 650885 - DNA, 356 bp, Homo sapiens
  misc_feature (87)..(87): n is a, c, g, or t
cttggaaggtacccctaggggccggggggaggtcaacaggggagtttgggaaccccttctccccccccgtggccctggagtgtgaantggctcattttggaccccagcatggagccagcccgggaacaggggggcaccctaaagcccaagctctatttgtgtccttcagagctcctgggaaacataatgggcccccatgggaatggccttttgcatatcccccaggctgtcctgggagtcaggcagactggattgtcccgtgcggggggcatccaccagcttgtgccctccaggggacctgtggcccctttttaaaggggccccccaaataataaatgggtccttttttgttttta

SEQ ID NO: 650886 - DNA, 2797 bp, Homo sapiens
aactaacatgttttgggaggaagttttctcccttctgaggcacatgcctgtctctcagtaaacactggcctaaagcaaggttgggaagtgactttctccccgacaatatgtcaggctggtgggaagtctcctctcaggaacgtctgtgagaagaagcaagtgattacaagctggtggatgcataaggagctcttgatcttgggagtgggaaggggccactcccatctgcacatggcctcttgctgtttccctggcttgtagcatggagatttatgggcatgtaacttttacagtcacttttttttttttttgaaacagagtctcgctctgtcagccaagctggagtgcagtggcacaatctcagctcactgcaacctccgcctcccgggttcaagcgattcttctgcctcagcctcctgactagctgggattacaggtgcacgccaccacgccagtctaatttttgtatttttagtggagatggggtttcgccatgttggctaggctggtcttgaactcctgacctcaagtgatctgcccgccttggcctcccaaagtgctgggattacaggtgtgacccaccatgccctgccatgatgtcacttttctagcaagaggtctccttgtctgtattcaagtggggggaggtagaatggggagcaacaggtgtgaccagaaaacagtctccccacccagcccacccatctctttccccatcccaggagggtcctctgtggcctgtggagggtgacagtgccccacactgggagcccttttcctcccagatctgagccccttctgaaggggtgggatgatttgaaggggagctgctctggtatttcaggaggttgaaaaaggaaggtggctgtacgtcttgtgctggatttcctgggcctggagaggacaagggccatggaatctacagggagagatgctggagcccactcagaccctgcattctcgaagcaggaatcccttgggtgtgtttgtgcccagaaggaccggtgaagctggcactgtgtgtggaaccatcctcttctggaagcttacgctgctagtggtgtcactgcaagcaggagggcagcccttagtagcagaacttggtggcccgagctctggtggtctgagatacgctggagttcttacctacacaacaggaaatgttcagagtgctttccttcctccctgcttctctcccatcctccttccctccttccacaaagcatttcacacatacatcaaagaagaacgaagagagcaataaactctcttgtacctatcaggcagctatcagctacctacagtgagcatctcaggaccacttgtttcaccttttttttttttttttgagatggagtctcactctgtcacccaggctggagtgcagtggcatgatctcagttcactgcaacctccgcctacctggttcaagcgattctcgtgcctcagcctctggagtagctgggattacaggcacccgccaccacgcctggctaatttttgcatttttagtagagatggggtttcaccatgttgaccaggctggtctcgaactcctgacctcaagcgatacacccaccttggcctcccaaagtgctgggattacaggcatgagccaccgcacccggcctgtttcaccttttttcttttttttaagttctttttttagttgtagagacgaggtctcactatgttgctcaggctggtctcgaacttctgggttcaagcaatctgcccgctttagcctcccaaagtgctggcattacagatatgagtcactgcgcctggcctcttttttcatctttatgcactcacatccactcacacgatcagattatttaaaagcaaacctcagacattatagtattttacccataaatactttaggctgtatctctaaaggctaaaattttcttcttaagagatgaggtctcactctgttgcccaggctggagtgcggtagtgtgagcttggctcactgcagcctcaaactcctgggctcaagtgatctccctgattcagcctcccaagtagctaagactacaggcacacaccagcatgcctggctaattttttgtgtgtatatatggtcttgctatgttgcccaggctggtcttgaactcctggcctcaagcagtctttccacctcagctgggactacaggcgcatgtcaccaggaggataagaattttttaaaaacccaattgcactatcacactttggcacctttggcatcttttttttttgagacagagtctcgctctgttggccaagctggagtgcagtggcatgatctcggctcactgcaacctccgtctcctgggctcaagtgattctcctgcctcagcctccctagtaactaggattacaggcactcgcaaccatgcccggctaatttttgcatttttagtagagatgggatttcaccatgttggcctggctggtttcaaactcctgacctcaggtgatccacctgcctaggcctcccaaagtgctgggattacagtcttgagccagtgcgcccagccactttggcatcttttaatgcccaatccttatttgccttttcctgattttctcaagaatacatttttatatagctgtacccccttatctgcggggtgtatgttccgagatcctgtggatgccgtgaaaccacagataatgccgagcccttgtatactatattttttcctatacatacacacctataataaagtgtaattataaatgaggcacagtaagagtttaacaacaataattgataatgcactgtaataaaagttatgtgaatgtg

SEQ ID NO: 650887 - DNA, 244 bp, Homo sapiens
gggtcagacggacaagggtgggtcagcggcaagggcgggagatcattctttagaatatgaatcagttccacagctccattgccacatcctaaggcaaagatggttcttcatttctttacagattgtgtttctgtagaaaaaaagaaacaattaagaacttcctttgatatacagtgctagtcagttagcacacagtgccagacccctcatgtgtattagttataggctgaattgtgtcccccaa

SEQ ID NO: 650888 - DNA, 3431 bp, Homo sapiens
caccctatcctacactactaggaacttgcacagtccgcctcgggcagcccaaagctcctctgcccaccctggctcccaaaaccctccaaaacaaaagaccagaaaagcactctccacccagcagccaaacgcctccttcttgacgccagcccccaccctctgtctgctcgagcccaggaaaggcctgaaggaacaggccggggaaggagccctccctctctcccttgtccctccatccacccagcgccggcatctggagaccctatggcccgggctcactggggctgctgcccctggctggtcctcctctgtgcttgtgcctggggccacacaaagccactggaccttggagggcaggatgtgagaaattgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcaaatggactgtaattgggagctccataaggaagttggcaccactcctattgtcacctggctcctcaccgagattcccgctggagggcgtgtgggttttgaccccttcctcttgtccattgacacctgggagagttatgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgataccaagggagaaactcgtgacagacacctactccccagtgatgatgaccaaggcagtgaagaacagcaaggagcaggccctcctcaaggccagccacgtgcgggacgctgtggctgtgatccggtacttggtctggctggagaagaacgtgcccaaaggcacagtggatgagttttcgggggcagagatcgtggacaagttccgaggagaagaacagttctcctccggacccagttttgaaaccatctctgctagtggtttgaatgctgccctggcccactacagcccgaccaaggagctgaaccgcaagctgtcctcagatgagatgtacctgctggactctggggggcagtactgggacgggaccacagacatcaccagaacagtccactggggcaccccctctgcctttcagaaggaggcatatacccgtgtgctgataggaaatattgacctgtccaggctcatctttcccgctgctacatcagggcgaatggtggaggcctttgcccgcagagccttgtgggatgctggtctcaattatggtcatgggacaggccacggcattggcaacttcctgtgtgtgcatgagtggccagtgggattccagtccaacaacatcgctatggccaagggcatgttcacttccattgaacctggttactataaggatggagaatttgggatccgtctcgaagatgtggctctcgtggtagaagcaaagaccaagtacccagggagctacctgacctttgaagtggtatcatttgtgccctatgaccggaacctcatcgatgtcagcctgctgtctcccgagcatctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaaacacagggcttcttggccccagatggcacctccctgcaccccggggttgtataccacaccctgggcccctaatcccaggccccgaaataggaaagccagctagtctcttctcttctgtgatctcagtaggcctaacctataacctaacacagactgctacagctgctcccctcccgccaaacaaagccccaagaaaacaatgcccctaccacccaagggtgccatggtcccgggaaaacccaacctgtcaccgcgtgttgggcgtaaccagaactgttcccccccaccagggcttaaaaatcgcccccactttttaaccatcgtccattaaccacctggtgggcatagccagagctgttcgaacccagccagggatgaaaaatcaacccccgacatggaacccatgattcctaaacccggggtaggttccatgccaagtaacagcagagggagttaagccataggaatttggctgtggagtaagagggaatgcggtgaggcagtgtggaatatgaccctaccagaggttggagaacaaacttgggcagccggaacccgtcactattttagattcctggcattcgaggagccctttgaactttccaaagtgcagccacagctacaatgctgttaaatcctcccacatttcttggatgccccttcaccttgtgtggacagtgtctggtttccccattttacagacaggaaaactgagcttcagacagggggtgggctttgcctaaggacacacaaatttggttgggagttgatggggccagatgagccagcattccagctgtttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctgtgg

SEQ ID NO: 650889 - DNA, 617 bp, Homo sapiens
  misc_feature (338)..(338): n is a, c, g, or t
cgagctcgcacccgtatctctaacattacattacaatttatttgattacatgtagcaggaatattttagacatgttgtattgaaagagtttttaaattgtcacctagttcttttttcttttttttaatgtggctacttgaacattttaaattacatacgtggctcacattagacttctgttggtcggggctggaaggttgcctactgggccaggcgggagatgatgctgcatagatgagagtagagatggagaggggttagatttggcaagtcttttgtaaacagacttgatagaacttgctaatggatttggtttgggagatttaaaaaaaaaaaancagacgtggtggtttacacctgtaatcccagcactttgggagtccgaggtgggcggattgcttcagtctaggagtttgagaccagcctggccaagatagcaaaaacctgtctctactaaaaatacaaaaattagctgggtgtggtggtgcacgcctgtaatcccagcttcttggaaggctgaggcataagaatttcttgaacccaggaggccgaggttgcagtgagccgagattgtgccattgcagtccagcctgggtgacagagtgagactccatctc

SEQ ID NO: 650890 - DNA, 1037 bp, Homo sapiens
  misc_feature (73)..(73): n is a, c, g, or t
  misc_feature (91)..(91): n is a, c, g, or t
  misc_feature (103)..(103): n is a, c, g, or t
  misc_feature (113)..(113): n is a, c, g, or t
  misc_feature (132)..(132): n is a, c, g, or t
  misc_feature (148)..(148): n is a, c, g, or t
  misc_feature (167)..(167): n is a, c, g, or t
  misc_feature (194)..(194): n is a, c, g, or t
  misc_feature (216)..(216): n is a, c, g, or t
  misc_feature (227)..(227): n is a, c, g, or t
  misc_feature (235)..(235): n is a, c, g, or t
  misc_feature (257)..(257): n is a, c, g, or t
  misc_feature (260)..(260): n is a, c, g, or t
  misc_feature (269)..(269): n is a, c, g, or t
  misc_feature (283)..(283): n is a, c, g, or t
  misc_feature (758)..(758): n is a, c, g, or t
ggaggcgatctagaggatccctcacgcccatgtcacaaagtgctgggatacaggcatgagccaattttttttngagacagagtctcgctcngtcacccaggcnggagtgcagnggcacgatctcggctcacngtaacctccgcctccngggttcaagtgattctccngcctcggcctcctgagtggctgggatngcaggcgcacaccaccacgccnggctaagtttngtattatnggtagagacggggtttcgccangtnggccaggcnggtctcaagctccngacctcaagtggttcgcccgcctcggcctcccgaagtgctgggattacacatttctcccatgagccactgtgcctggcacataatcaattttagaatatctttatttcctcagaactaattgagcattggcagagggtagagagaagggcaatgtgttggagccaggggcagggagagaagtacaagcccagggaagttcagattatgctggattttgagggcagggtgaggagctagagttttattctaacagtgtttgaaactgaccactctggaggcaaggagaaccgatggtgcggggctagaggggaagccgggagagcagctggaaggttgcctactgggccaggcgggagatgatgctgcatagatgagagtagagatggagaggggttagatttggcaagtcttttgtaaacagacttgatagaacttgctaatggatttggtttgggagatttaaaaaaaaaaaancagacgtggtggtttacacctgtaatcccagcactttgggagtccgaggtgggcggattgcttcagtctaggagtttgagaccagcctggccaagatagcaaaaacctgtctctactaaaaatacaaaaattagctgggtgtggtggtgcacgcctgtaatcccagcttcttggaaggctgaggcataagaatttcttgaacccaggaggccgaggttgcagtgagccgagattgtgccattgcagtccagcctgggtgacagagtgagactccatctc

SEQ ID NO: 650891 - DNA, 199 bp, Homo sapiens
  misc_feature (145)..(145): n is a, c, g, or t
  misc_feature (173)..(173): n is a, c, g, or t
  misc_feature (182)..(182): n is a, c, g, or t
ggcgagacgcaggaaagtctgaggcatgatacaaaagccctgttgagagaagagagagaccctctgacattgttttatattgttttatagtcagtaaaaacaacaggaagtaaaaccaaagacaggcagccccgcgccaggcccngaaaccaggcctggatccagcctggccnaaacccagnagttaaaaatcaactta

SEQ ID NO: 650892 - DNA, 531 bp, Homo sapiens
  misc_feature (73)..(73): n is a, c, g, or t
  misc_feature (91)..(91): n is a, c, g, or t
  misc_feature (103)..(103): n is a, c, g, or t
  misc_feature (113)..(113): n is a, c, g, or t
  misc_feature (132)..(132): n is a, c, g, or t
  misc_feature (148)..(148): n is a, c, g, or t
  misc_feature (167)..(167): n is a, c, g, or t
  misc_feature (194)..(194): n is a, c, g, or t
  misc_feature (216)..(216): n is a, c, g, or t
  misc_feature (227)..(227): n is a, c, g, or t
  misc_feature (235)..(235): n is a, c, g, or t
  misc_feature (257)..(257): n is a, c, g, or t
  misc_feature (260)..(260): n is a, c, g, or t
  misc_feature (269)..(269): n is a, c, g, or t
  misc_feature (283)..(283): n is a, c, g, or t
  misc_feature (407)..(407): n is a, c, g, or t
  misc_feature (482)..(482): n is a, c, g, or t
  misc_feature (509)..(509): n is a, c, g, or t
ggaggcgatctagaggatccctcacgcccatgtcacaaagtgctgggatacaggcatgagccaattttttttngagacagagtctcgctcngtcacccaggcnggagtgcagnggcacgatctcggctcacngtaacctccgcctccngggttcaagtgattctccngcctcggcctcctgagtggctgggatngcaggcgcacaccaccacgccnggctaagtttngtattatnggtagagacggggtttcgccangtnggccaggcnggtctcaagctccngacctcaagtggttcgcccgcctcggcctcccgaagtgctgggattacacatttctcccatgagccactgtgcctggcacataatcaattttagaatatctttatttcctcagaaagaaacccngtaccccttaatttagatcccccaacccccctgcactctccaggcaaccactaatctacttggtctctctagatnggcctattctagacatttcctattaanggagtcatacaacacgtagcct

SEQ ID NO: 650893 - DNA, 323 bp, Homo sapiens
agtgccgagagatgaaactgtgagtactgcccccacaacatgccgacatcgggcgcctggtagaggacagtggacaataaaatcagaagtacgcttaacgagatctactttggaaaaacaaaggatatcgtcgattgggctgaggtctgtgcagacttttgtctgactagatcaaaatcaagaagctctgaagaatgacctggtgtatgctttgaagagccagcggcaatgctgtacctctgtttcatgcttaccagacacgccgtgcactcgttagatcccttccttagaaaactcgtgggctgctcccttctctctccact

SEQ ID NO: 650894 - DNA, 670 bp, Homo sapiens
  misc_feature (657)..(657): n is a, c, g, or t
ctccgggcccctggtgttaaaaacactcataaaattttttttaataagggttaaggaatagggcccttaaggcttgctgcggatgccgacaaaccgatataaatccccaggttggtttttttcccggggggggaatgtaatgtaactgtaatgttaggccccggctttaaaaacgaggaaactggaaattaaggaacaggttgggcaaaaagaacagcccccaaaaggcctggaattaagacagtggggccaaccccagagagaagtaagtgtttcggtaacagcttttatcgcaccttgtggtcctcaaaaaggggatggaatctacgaatttagttttcccagcctccttaaaaattcattcatgccaggggcagtggctcacacctgaaatcccaccactttgggaggttaaggcaggcttattacttgaggtcaggagtttaagaccagcctagccaacatggtgaaacccggtgtttactcaaagtacaaaaaaaaaaattagtcacacgtggtgtcacgcacaagaaatcccagctttttgggaggttaaggcaggagaatctttttaacccagaagccaaaggttatagtgagccagtattgcgcccccccctcatttgggcaatagagtgaggccctgtctcaagaganatgagaaagagaa

SEQ ID NO: 650895 - DNA, 414 bp, Homo sapiens
cgctatattcaccaccccggcacacagtgcagtcgcttctccaccagctgtggttcttggaccccgagcctgtgaagggggaggtgagtttacaaaatggaaagcttaaaaggagaaaagtggaaccagaggtacgcagaagccctagagtggtagagtaagggctccagcgctgcctctgtgtacagggcagagtggcagaggagagggggagaggcactgggcaccatgggggcccagttcccacttcggggattctctctcgcagaaacgagggtccccttcatggggggtagatgcccagggctaacttgttgccactgtcttgttgtgcgacctgagtcgctggaacatgccctgagttgactcatggagtgggctagctttgggagcgggctcttgtcaaccctaagg

SEQ ID NO: 650896 - DNA, 459 bp, Homo sapiens
atcccatcttccatttcctatgcccggatagtggaaggtgccgttgaatgaacaccatcttgtgcaggggtatctaatcaggaagttgatttcataacgaggtatcatctttccaaaggtctgtggcattttctacaacagggggctgggccgcaagcaagtgttcctttctggcactgtataggtgagagggtcatggcggggaacatcattccacgggccattctcatgccaaatgattacaacacagtcttctccagcaaaaaagaagctgtcgggctggttgggtctccaatactcgtatggcaggtgtgtgccatcagtccaaggagaagtcatgcccaaaaatctggtcatggaggcctatccagggaataatcatggcccacacgattaccacccttttgttcttcgtagagacagagatgcttgtgagatgggcccctgcagacgggattc

SEQ ID NO: 650897 - DNA, 238 bp, Homo sapiens
gaaagggccgggtcggccccgcttcagaccgtgacccgccttcaacggcataggtgagcacggttgaccgtgcccagttgcgacgataatagaaactcagttccaatatacggaccagcccagatcgtcttgacgttagacggctgggcctggaccgtgggcattaggtatcgacaatgacgtcctgctttgacccttccactgtggaaattcccatcggccattcatcggcggtttt

SEQ ID NO: 650898 - DNA, 279 bp, Homo sapiens
  misc_feature (110)..(110): n is a, c, g, or t
  misc_feature (183)..(183): n is a, c, g, or t
  misc_feature (189)..(189): n is a, c, g, or t
  misc_feature (201)..(201): n is a, c, g, or t
  misc_feature (252)..(252): n is a, c, g, or t
  misc_feature (256)..(256): n is a, c, g, or t
gaattcggcagagcaaaaattttaaaaatgaacctgtgtgtgttattcagagaaagagaaccggtaggggagacatacatgctgatgctgtttagttgctaagtcatgtncgattcattgcaaccccatggactgtagcccaacccggctcctctgtccatgggatttcccagacaagaacanggagtnagttgccatttncttccccaggggatcttcccgacccagagatctaacctgcatctcctgcantggnaagcagattcttaccactagcac

SEQ ID NO: 650899 - DNA, 281 bp, Homo sapiens
tgctgggagccctcatcatcagtgggtatatgtaaggatgaacggtgaatgcgcattgcattctggtcaatgaggcagggcctgctcgggctcaggtcagcagggcgggtgtcgcagatcagcatgtctcggaatcctctgagcagcaagttcggaaattaacctttcattgatccagaggtcacagttccaatccctctcaagtacaagagcgattgtcaataatatgagtgtgccagtcaacatagtgtcatgatagtccatctgtagcacagtaggat

SEQ ID NO: 650900 - DNA, 183 bp, Homo sapiens
ccgtaataaacagtgaattgatggatccaaatgcaacagatgataaccaagcgccagatcaccagaacacagattaccgcttaaaccccatgttaagaaaagcctgtaaaggctgacattcctaaaattcttgtcacgggtacacttgaccaacggggtacccgaggctccgaaattccgtta

SEQ ID NO: 650901 - DNA, 868 bp, Homo sapiens
atcttttctaatttgcacaaagttatcacaggactagcagtggtcctatgattagagttggagttgaggtggagatgggaaggggagtttctttagcagaaagtgagattgtgagttcggggatggaggataagggctatggagggaggatcagggagaagtgctgtggttggtgaacgtggaggtggggcagagagcagtgggaatgtgtcaagggaggttggtggtgagaagggcgggttcatgctgacagtggcccctttagctgcgttcagggtacccctgggagtggtggttctcctgccccccagccttgctcactcctgtggtgtaagcagtggcctctttggagtggctccttctgccaagttcccctcttgggagaaatggcaaggggttaggttttctccaggcccctctctgagaggctgcaggctctgtagtgggtgttgccttactaccgtgggcctactagagaggcatggaccctgccctcagggaacttgccatcgaagggagcttttgtgcacaggtctaatgccagtggccttgtctcctggggcagggtctgtgggtattgcagacagtctggtttctgtgtagggctcaagtctggtctgaggcgaaggctcttaccctaggaccaaggactattgagggagtcacaaaactgggcctctcgtgggccttcagaaggtaaaaggatctgtcgggacaaattcttggggcccccaataacacgggagatatggaacgcctgagggggcaaccggaaaaaggtctgcagattaaaggaagtgcaccgaggtttggcaaaaaccctttcttggcggggtgaacaggcctccacggcgagagcctcattcgc

SEQ ID NO: 650902 - DNA, 340 bp, Homo sapiens
tcctctgtggggctcttcccccgtagtgctggctggctccacttcttcctgccggtgtaccctggagcaggatttaccgctactgtcctgtcttcctagcttttggagaaccactggcagaggtgggtgtgaaagcgatagttatacatccatcagggactgaggagcttactgtgaattggacttgaataggatacctcagaaattatccactcacagggcatttatacacgacacctacagtgcatacacaccgctgccgacgtgcttacgaggacggctgtacttctataacatccctctcgcagatgtcggtccgtcgatccaatcactcgctctc

SEQ ID NO: 650903 - DNA, 361 bp, Homo sapiens
tgctactgaggtttggaggtattcctctggagttttcacttataccattctctcatgcccaggaagctgctcatcaccaaaccacaagtcttcctctaactcagtcacaactaagcttctatccagacactgatgatactgtaactgttttgttgtgcttctgattagttgccctgtcaaccataagcagcctataaacagggcctgaatccatccatgttacatccccaatgcactgaattcgatattattccctcaagatagataatagagaagcagcatacctaaaaaaaactagttatatattggcaaaagataaatgtttcattaatataaatacaaccattagaaagcaaaatac

SEQ ID NO: 650904 - DNA, 269 bp, Homo sapiens
tactgtagtatatctcataatgcaatattattcattacctgaaaaagaattacatcctgtcatattcatgcaacatgggtggaactggaggtcattatgtttcgtgaactaagccaagcacaaaaacgaccaatagtctcatgtactcactcatatgtcggagctagaacatgccattgccaccagtccctattcccacccttgtaggaatacgtgatggagacccagaagataatgacataaaagagaaaagggaaaaaattacagag

SEQ ID NO: 650905 - DNA, 142 bp, Homo sapiens
  misc_feature (23)..(23): n is a, c, g, or t
tccccatcgccgcagagatttcnctggtaatcgcggtatggatgagctgagacttcataaccccgcccagtagaccgacggcggggctgtcggcgtcggtgagttcggtctggcgcagaccggtaagggatcctctagatca

SEQ ID NO: 650906 - DNA, 443 bp, Homo sapiens
cgctgttgcagtctcagtctccccgcgtctggaatacagtggtgtgatcgtccgttccaggggaatctccatctcccaggttcaacgtgattctcttgcctccgcctcccgggtagctgggcctccaggtgcctgcctgcacacccgattgtttttgggtttttgagtaccaacggtgttccgccatgtagcccaggctggtctcgaactcccaatctcgattagcattgctcaccttggcctcccaaattgcggcgatcaccggtgtgacgccaccgagcccatgcctgggccgttcatatttaagccatttctatttcccaggttttaagtaaataatcctcataactttctcacatattggtcaaacttgttacggggctattttgccttaaggggcctaaagagaatattcgaataacttaataatccatactgaaact

SEQ ID NO: 650907 - DNA, 374 bp, Homo sapiens
aagcatttgtagcggagaccaaccaaaacactggattctgggagcctctgtctgagaatggaattaactttgtttcatagaagactttataggctttataggggagacggggaaggacctagttgtacatatttcatttcaatgcataaacatatacctatatacctacaagacacaggatctggatccaactctctaagaaccaggacttggactgtgagtcccagaacatccatgaaagtgttcccacttcttatatggaagatgagagtagtagctgccctaataactggagggttgctagagagataaaggagacaagggataggtcactttgtgtagtcactttgcaatgcataaaagctagttcaacc

SEQ ID NO: 650908 - DNA, 755 bp, Homo sapiens
  misc_feature (567)..(567): n is a, c, g, or t
  misc_feature (592)..(592): n is a, c, g, or t
  misc_feature (629)..(629): n is a, c, g, or t
gagagccggcgcgtcattgtcgtcatcgttgcccgaccgctttccgggagactggagtcgaaggccgtgagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgtttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaaatgccctctgggaaccaaaatcgaaaaaatgcatcaaaagttgccaataaaggaaacaagtacaaagttaacttttgggtttggatgtacacatattcaaaaagtacatcttttcccacccccccgcanaataattctgtggcagggcgaagcntaaatgtgtttcttattaatatgtgaattcacacggnatatgtgctatatacttttcttttcgcattatcttattgagtagcactgggagtttacattgtggatatttatattataattaccccctcttgagagaccttattcttatatggagacttgcgggc

SEQ ID NO: 650909 - DNA, 110 bp, Homo sapiens
cctgctccagcaacatccacagcattcaaggcatcaaccatccaaggcaagcagtggtgcagttttcagcagcttggccaacacatgcaggggcatcctctcagcagtct

SEQ ID NO: 650910 - DNA, 758 bp, Homo sapiens
gagagccggcgcgtcattgtcgtcatcgttgcccgaccgctttccgggagactggagtcgaaggccgtgagagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgtttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaaatgccctctgggaaccaaaatcgaaaaaatgcatcaaaagttgccaataaaggaaacaagtacaaagttaacttttgggtttggatgtacacatattcaaaaagtacatcttcccccgccccgggaaaaaaaatttggggaagggcagggtttcaaggggttctttataatatgtaattccgggaattttgtaaggtaaaattttgctttcaaagatcattatcttaagatttgccggggt

SEQ ID NO: 650911 - DNA, 752 bp, Homo sapiens
  misc_feature (564)..(564): n is a, c, g, or t
  misc_feature (589)..(589): n is a, c, g, or t
  misc_feature (626)..(626): n is a, c, g, or t
caggttcacaataaaggtgctaagaaagagaatgtaagacaggaaaacaattaaatattcttaccgagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgtttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaaatgccctctgggaaccaaaatcgaaaaaatgcatcaaaagttgccaataaaggaaacaagtacaaagttaacttttgggtttggatgtacacatattcaaaaagtacatcttttcccacccccccgcanaataattctgtggcagggcgaagcntaaatgtgtttcttattaatatgtgaattcacacggnatatgtgctatatacttttcttttcgcattatcttattgagtagcactgggagtttacattgtggatatttatattataattaccccctcttgagagaccttattcttatatggagacttgcgggc

SEQ ID NO: 650912 - DNA, 215 bp, Homo sapiens
tctacaaaaaattcaaaaattagccaggagtggctggtgtgtgtttgcggtcccagctacctgggaggctgaggtgaaaggactacttgggcccgggaggtcgacgctacagcgagccatgttcacaccactgcactccagcttgggcaacagaatgagaccccgcctaaaaaatagaaactttatttttaaaaataaaaatgtaggccaggcat

SEQ ID NO: 650913 - DNA, 1220 bp, Homo sapiens
  misc_feature (1)..(1): n is a, c, g, or t
  misc_feature (166)..(166): n is a, c, g, or t
  misc_feature (242)..(242): n is a, c, g, or t
  misc_feature (269)..(269): n is a, c, g, or t
  misc_feature (577)..(578): n is a, c, g, or t
nattttctcaacaaactttccctcatcaactatgatgatttaattacttgaaataacgctcatccaagaaaaagagaataaatacttaattcttttcttaaattgtttctaatgtcagagccctagttacttcctagtgggggtagtatccagtgagtcgagtttntgtattttgactttgctttttcttactttacataataaactcatgggatttaataatcagtgtgattcagccaatngcagtcattatttttaatgccctaatngttctttttctgactaccttttaaatggtcttatcccccaggatccgtctatgatatgcttttcttccccctctgcactctttcctgactgacttcagtctttcctataactaccctccacattttaattactctcaaatcactctttcttacatgaatttaccaggcattagacctgtgtttctatttactcacctgcctggccctcccaaaacatattacatgcatgacttcacatctttgaactaaatgtatctttatttgctgttcttttcttatactcccagttatcagcattttcatgcacnntctccaagccagaaaccaggaaatcattttttattccttctctcttttgcataattaggtattctccaaattcgatctcagaattatttcactgttccagcctttcctctgaattaaactgcttaaagtattcagaaaacagtgacctcttacccatactatctgaccacattcctaagtcgattgcctaccacttatgacctcttcccactccaaattgttctctattacccttggagttaccttcttgaaaataagtctagtcatgttagtccagtttcaggacctctgctgcatccttgttacctaatacaatagtgtttccccagatttgtccaagagaatattaattctacaagatattaataggtattctttgacaaaggaggtgctgggaaataatacttacgaacatactgatttcaccataatccagcactttgagaggctgaagtgggaggatcactggagggctaggagtcaaaaccaaggctagtcaaacatggcaaaactccatctctacgaagaaaaacagacacgaacacgaaaaacgccggggggacaaccacgaggtgggccccacaaacggagggagagaccgagaaccccgtggaccaagaagggacaatgacaaccaaatgg

SEQ ID NO: 650914 - DNA, 214 bp, Homo sapiens
  misc_feature (78)..(78): n is a, c, g, or t
  misc_feature (93)..(93): n is a, c, g, or t
  misc_feature (173)..(173): n is a, c, g, or t
caggctacacaggagggctgaggcaggagaattgcttgaacctggggggcggaggttgcaatgagtccaaggtcgcgnccattgcactccagncctgggcgacagagtgacacttctcaaaaaacaaaaacaaaaacaaaagaacagataagcaaatacgtgtgtatatattnctattttgtgtgttttcattcaccttatttcattcagtctt

SEQ ID NO: 650915 - DNA, 105 bp, Homo sapiens
ggaaaagccatctttgcattgttcctcatccgcctccttgcccgccgcagttcgcctccgccgggggccttccttccgcggccgcggacttccggcaagctttat

SEQ ID NO: 650916 - DNA, 114 bp, Homo sapiens
  misc_feature (76)..(76): n is a, c, g, or t
gcacagattgaagtcacctctgagatagatgtgcatggtattctccgagtgacagctgaagacacgggtacagggnccatcgttcagatcacattcaccattgaccagattcgc

SEQ ID NO: 650917 - DNA, 320 bp, Homo sapiens
  misc_feature (95)..(95): n is a, c, g, or t
ggacgatgcagtatgtcatgattatataaaatgcgtcaaccagtaagacgcatttatgcatccatcatttcaggatgtgataacctgggcatatntccccaaataacttgcctccctgtgtcacaaggcccacttcactcacatttacctcagtgacagtctttggtaataacacccaaagttgtatacagcgggaatgacggattcttctttacaccaagtattggtaggcaaaaggtggctttcagttcaggttgtgttacatggactttcttgaaatgcaagcccattggcctgatgaatctttcatatttaggtgg

SEQ ID NO: 650918 - DNA, 269 bp, Homo sapiens
  misc_feature (204)..(204): n is a, c, g, or t
atcgactgatgacaacttaaaactatcacattattatttatttttgctttgcttttgttttttttgagacggagtcttgctttgttatccaggctggagtgcagtggcatgatctcggctcactgcaacctccacctcccaggttcacccgattctcctgcctcagcctcctgggtagcttggactacaggcgcccgacaccgnacccaacaccacacccagctaattttttgtgtttttagaagagacagttttagcccatgcaggcc

SEQ ID NO: 650919 - DNA, 380 bp, Homo sapiens
tgtgtacaagaccgactggtcaaggttcagctgtccaatgactttgacgagtacatcatggcatgagcgacatcaagtcggctcatgaggcaggttgcagagcgcgcatcacccatcaagtgcagagaagcctgaagctgaggagaagaaatactcatgtggggtctctcctccgatttctgggggacgagaagcccaacctcagctacatcatcgggaaggacacttgggtggagcactggcccgaggaggacgaatgccaagacgaagagaaccagaaacaatgccaggacctcgggccttcaccgagagcatggttgtctttgggtgccccaactgaccacacccccattcccccactcccgtaccaggggtaccga

SEQ ID NO: 650920 - DNA, 105 bp, Homo sapiens
gtgtatagcatgattgatgtgtgatgtcccgccccactgatgttcacgcgacttactgtggcatggagctgggcctgaatcccagccctctgcctgaagcaaagc

SEQ ID NO: 650921 - DNA, 269 bp, Homo sapiens
ttcagagtaccaaaatagaatggagatttggctgggcgtggcggctcatgtctgtaatcccagcacttcgagaggccgaggagggtagatcacttgagctcaggaattcgagaccagcatgggcaacatggtgaaatcccatctctacaaaaaaatacaaaaattagctgggtgtggtggtgcatgctgatagtaccagctactcaggaggctgaggcagaagaatcattttgagcccggaagagcaaattgcagtggcgtgatctcgg

SEQ ID NO: 650922 - DNA, 228 bp, Homo sapiens
ggggcggccggattgcccggaggccgcacccgcctccggcggggctctcagacggagtctgctctgtcgcccaggctggagaggagtggcacaatctcggctcgctgcaacctccacttcccgggttcaagtgattctcctgcttcagcctcccgagtagctgggattacaggtgcctgccaccacgcccgcctaatttttgtactttcagtagagatgaggtttcac

SEQ ID NO: 650923 - DNA, 153 bp, Homo sapiens
tcagccactgggtgatgcaatgctaggagtggttacttactatgatatgtaagagagtaagttgatgtacggggaggttgcgtgtgacacggttccacccaggtctggaagtgcagtggtatgatcacagctcactgtagcctcgtagctccc

SEQ ID NO: 650924 - DNA, 171 bp, Homo sapiens
  misc_feature (1)..(1): n is a, c, g, or t
ngatctagaggattcccctggcttgaacttaggcaactggtgttccccgctccgggaggtcacatattgatgcgaacttagtgcggacacccgatcggcatagcgcactacagcccagaactcctgggctcaagcgatcctcccacctcagccctaagttcagagccaggt

SEQ ID NO: 650925 - DNA, 1448 bp, Homo sapiens
cggcacgagcccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagacagcactcaaagccccgtctcttcaatgctacaggggcctggctagtcatgggggagcccagtagagaggagtataaaatccagtcctttgatgcagagacccagcagctgctgaagacagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggcttggcccagccagacagtttgagcaaggaggaggaggtggactgtttgtgtgctgcagctgcaccgggttggggagcagctggagaaatgatgggcagcgcatggatgagctctttgtgctgatccgggatggcttcctgctcccaactggcctcagctccctggccagctgctgctgctggagatcattgagttcgggcggccggctggaagacaacgccagctgcccacaagtattactacagcgaagtctccgactaggcctccagatcagggcttcctcaccagactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaaagtaaaaaaaaaaa

SEQ ID NO: 650926 - DNA, 1256 bp, Homo sapiens
tagaacttgatcacttgaagctcagacctattggtcttgatcaaatcaacactaagaagacctatagaaataagctaccattttgccacagagcagcttataggtaatacactcttctctcagtgcagtgtacatttccacaaatctcacagcaattagccctcatacacaccatcagccaggcattattgggcagcttgcaaaacattttcccatatcattctaggaccatgcacatttctcaaaatgccttcaatcaggtttcatgtcagattgcagtaaacatttcggtgtatatgttcacacttcctatctttgtccacagcgcattcccaacagtttggccattcagcaggcaggtggagtgccacttttattactagggccagcacaattcatccttcaggtccaacaacacaaaaaaggattagtcacacgagtatatccattatacgtaagtatatgggggttggtgaggggaccactacaagttacaacacacggtggcctggccctggctacgcggcatggggaaacctgaaaggatgcactttgatgggtaaattcccattcctcgagagtagcccacctgtgtacgagcacagggcttccacgggcaagggccccaacacagcattcttcgacacatggaatcttactacaataacatctctacccacagccgcgggtacggcatcaaatggttggacaatattctattctgggctccaaggccacctacacttggcgctatcaactaggctaggtaaaggaagtgcccaaataaataggaaggtggttcacagtcagggtcctattgacaagccgttcccagctaaggttgcacgttagaagccttgaatgtgagagcacccagaggtccagccaggcaggtacttggcatcgactaattttaccacgtgcgtcaccacactaaggagactacgggccggactacttcataggcagccagatggagttcagctcaagggaagacaggagagacgacagaaaacaggggaaagagaaggaccgcacccagatgtcaacatcaaagacataataccaataaaatatcaacaaacgtaccctcgataaataataacgaaaaaacacataaaaaactaaaaaatacatccctaccaactacacacaacacaatatttcacaccaataacaacacaatcataccagacaaaataaccatcacaaaaagaaaaaaagagacatagcatataaatatcaaagctaccaca

SEQ ID NO: 650927 - DNA, 386 bp, Homo sapiens
aagtggggaagggcaccccccttgagggatggagggcagtgctttatcaggggttgtccaaaaaagcaaaaaaggacataatgctgaggaagatcgtttaagactggggctgggcgcagtgactcacccatgtaatcccagcattttgggaggccaaggcaggaggattgcttgagcccaggagttcaagaccaggcttgggcaacacggcgaaaccgtctctgcaaaaagtacaaaaaattagccaggagtggtgcttgcctgtactccctactactcaggaggctgaggtgggtggatcacttgcacccaaaaggttaagctacagtgagccatgtttgtaccattgcactccagtttaggtgacatagcgagacctggtctca

SEQ ID NO: 650928 - DNA, 1329 bp, Homo sapiens
cggcacgagcccgcagcgccggacgctggttgcgcgctcccaggcgccgagcggccccgggcacgcgcgcgcgccaccggcccggcaggtgctgtccttattcccagcccagtcaagagctaccggggctggctagtcatgggggagcccagtagagaggagtataaaatccagtcctttgatgcagagacccagcagctgctgaagaagcactcaaagatccgggtgctgtggacttggagaaagtggccaatgtgattgtggaccattctctgcaggactgtgtgttcagcaaggaagcaggacgcatgtgctacgccatcattcaggcagagagtaaacaagcaggccagagtgtcttccgacgtggactcctcaaccggctgcagcaggagtaccaggctcgggagcagctgcgagcacgctccctgcagggctgggtctgctatgtcacctttatctgcaacatctttgactacctgagggtgaacaacatgcccatgatggccctggtgaaccctgtctatgactgcctcttccggcttggcccagccagacagtttgagcaaggaggaggaggtggactgtttgtgtgctgcagctgcaccgggttggggagcagctggagaaatgatgggcagcgcatggatgagctctttgtgctgatccgggatggcttcctgctcccaactggcctcagctccctggccagctgctgctgctggagatcattgagttcgggcggccggctggaagacaacgccagctgcccacaagtattactacagcgaagtctccgactaggcctccagatcagggcttcctcaccagactggcctttcttctacccacctctaaagctggcagtggagtctctgcctcacccaaagacttttcccttccagactttgagtgtcttcccttctagactttcccatctcctggtgagatgtttcccacttatgccgtggtcctgccctgagcccctttccccaccacaacccaccacggccaggcagagaagggcaactcccaagagccactgcactgtgtaaccattagtgcaactactaccttggtgcctcagtttacccatctgtaaaatgggtaagcatagccactggtgggatattttgggatgtcaaggggtggaggcagagcacaagtcacaccagaaactgctttttatacattttgtataaggacaactctggaaacaagcctatttcctccagccagtttcactgaatgctgcaccacatgctacaccagttcagcgtgagaattttctaataaatcttttctgatactaaaaagtaaaaaaaaaaa

SEQ ID NO: 650929 - DNA, 230 bp, Homo sapiens
tcggccacccttgtcaacaccacacccacacactacacagttacacacaccgacatacactcacacacatgcacccacagacacagggcctgactcctagaagggacggcaggtgtgcttacctggacacacacgtattcatccgcaccatcatagccaccatcaccctccttaacctctacttctacctacgcctattttacaccaaccccggtgccgatgaatagcga

SEQ ID NO: 650930 - DNA, 1430 bp, Homo sapiens
gttctgcacagaactgaactgaaagtataattaacaaaaaaagaaaaaaagtcggggtgcgggggcccacgccggtaatcccagctactcgggaggctggaggcaggagaatcactggaacccgggcaggtgggcagactggcagtggggttggagatcatgccactggcactccaggctggggcaacagagctagactcggtctcaaaaaaaagaaagaaaaagcaaaagaaaacagagaagaaagaagctccttccaaattccaccactagcattgtggggggtggccagggttcacggaatttcccaccatttctaagtggggggggttgggggacattcatcatttgggattcccccgtaagtgaaaagtggtggtggacaacattattttccattattgcctatattatggacacacccgtggtattctctctgtgggcggcaacagtgccgcggatacaaggggcttctggggggaccacaaatttatacaaacaaaaggtggcgcagtaggggtgtgataccataaatattgaggggagaggtttataaaaaggggaggtcactatatggggaatatatatcaagtggggagaaataaaatagggtacccttataaaccatcgcgggcgcttattgtgggcagaaattattagttaatcacacaactcccgcaaaagaacataagtgggctgtggcccctatatatacacaatctcctgtggagcacgaagggtgtcatcactcacacaaagagagcgcacgaaaacaatttttcaaacaaccatttgggttacacgatgaaaaggccatccaagacactttaattcaccattatccacaggcgggagtggagctgccccattaggggcagggtaacactaactcgttaacaaaaggagttccatggggtggaaaacaccccagagggccccagggagacaaaaaaaccaccccaaacagacaggttataaaaagataacgggcgcactcaacccattaaagcgacccggagaaccccccatcctggcgcaaaccatcacaggcggcaacagcgactcgccaacgacacccgaggggcaccaaaaaatatcccacttttagggacgaatggaaactcaagcgactaaaatatgtatctcgcagcgccaaccaattggtcaggaaaaaatcttgtgttcaacacctttggcgcaaatgtgccgtgggaccccctttgggccacaagacacggaaaccatacataactacggggagccaaacacagagggcacccaaccaagggtcccaacagcatcgcaacaattggcgacaaaacaacatggacacgaaagagaagacaaaacgaatggagaacgaaacaaaggcgacgaaaacggacaaagagagcagaccacaataaaccgaaacacacagagtcgccaca

SEQ ID NO: 650931 - DNA, 519 bp, Homo sapiens
  misc_feature (90)..(90): n is a, c, g, or t
  misc_feature (92)..(92): n is a, c, g, or t
  misc_feature (109)..(110): n is a, c, g, or t
  misc_feature (118)..(118): n is a, c, g, or t
  misc_feature (124)..(124): n is a, c, g, or t
  misc_feature (138)..(139): n is a, c, g, or t
  misc_feature (175)..(175): n is a, c, g, or t
  misc_feature (184)..(184): n is a, c, g, or t
  misc_feature (187)..(187): n is a, c, g, or t
  misc_feature (192)..(192): n is a, c, g, or t
  misc_feature (451)..(451): n is a, c, g, or t
tctcatcctcgcccccatctcttcccaccaactcagacccttccgagcccacccagccaccaccttattatgtaagcaccaccccttccncnatccaaagaacaagctnnacacatanggcagnggccgcgccccacnnagttggtctgtacatgcgcagttcctagtgcccatngtctgttcnccngcctngcccccgcccgccccgtgccgtggacatttgggcccactcattgccccttcaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcnccgccgggcccgtggccctgcgcggagctgtgtccaataaagttcttggatgtgaaaaaaaaacccca

SEQ ID NO: 650932 - DNA, 410 bp, Homo sapiens
  misc_feature (148)..(148): n is a, c, g, or t
cacgaggctcggaatgtgtggtgtatggacagttacacccacgtttttcacttaatcggggatttaatccccattttggagagatttaaggggtcagttacaaccccaaatcctctataaatagtggattgatcagagagaaccaggnctatcaaaggaggaggagatcataccggagggagggctatcaaaaaaaaagggggagatcaagagatctaggcgtacacgcgtaaaagaggaggcaagtcttcttctcactcgtcccgaagagataaaaggagtccggaagtctcaaaaagaggcaattctacaccttcgctccaagctttggaggtacaggctcgtcaagggaggacaggagtcaacctcaatcgccaaaaaataagaacccggcataacaccacacaatt

SEQ ID NO: 650933 - DNA, 446 bp, Homo sapiens
cgtccgtatctctgtcaggctttggtatcaggatgatgctggcctcatgaaaggagttagggaggattccctctttttctattgtttggaatagtttcagaaggaatggtaccaactcccctttgtacctctggtagaatttggctgtgaatcggtctggtcctggactttttttagttggtaggctattaattactgcctcaatttcagaacttgttattggtttattcaaggattcgacttctttctggtttagacttcggagggtgtatgtgtcaaggaatttatccatttcttctagattttctagtttatttgcatgcaggtgcttaaagtattctctggtggtagtttgtatttctatgggatcagtggtgatctaagaatatcccacaggatatcaccactgatataaggatatcaccactgatcccacagaatcagtg

SEQ ID NO: 650934 - DNA, 791 bp, Homo sapiens
aacccacacaccaagcaccacaacacacatccacacaccacaccaccacaccccaacacaccccaccacctactcagataatactcacacaacctaaacactttatactattactatttgatactactacacaacatcatttctcctcatatatttttatcattacacaccaattctagtcactataacatcatcgcattaataacacatttacatcatatatttctcgagctggggcatgcgagaagataatagcaccctggaagaccagtgaagcgtatgaggatcggacctacaaatgatcgaggcatacctcgagagtgagacgaagaatttgccctcgtcaagccactttagtctgcgcacagcgcacacccgcccagcccgctgtggtgggctggactaactacacatcttcactttttcctaactcaatacttatctctttacacactcacccccttcaaatatgatacccttactctcttagtacacctaattcaccatacactcacttctatctctctcgcagtctcctttctacacaactacatataccaccacctcaccctacattactttatatgacccacctctccacaccacacccacaccacaccgcgtacgatacacttcccaacaaccctcctcaccaaaccaaccatttcttttcacttcatctacaacaccatatactcctaataaccctacaccctatagtattgtacctcactacctcacaacttcttattcttatctctatattctatttcatcatatgcctcccggca

SEQ ID NO: 650935 - DNA, 237 bp, Homo sapiens
  misc_feature (22)..(22): n is a, c, g, or t
  misc_feature (54)..(54): n is a, c, g, or t
aaaaaatcttagttgattatgntttatgtgtcatttaattaaggaatgaatttncttatttttatttcagtagcttttggggtacaagtggtttttggttgcatggatgaaattgtatagtggtgtaagtctgaaattttagtgcacctgtcacctgtaatagtgtgcattggtaccccaatatatagttttttaattccttccccttctgagtctccatagtccattatatcactt

SEQ ID NO: 650936 - DNA, 654 bp, Homo sapiens
tggaaaaagtcatggatggccagggggtgggcttgaaaccagcttgggggggttcgatcccttccctttttggtctaaatttaatgtatacgggtccttcgaatgtgtggtagggtggggggtgcatccatatagtcaccccaggtttatgggaggggttcttctactattaggactttccgcttcgaagcagaaggcttctcaaatcatgaaaattattaatattactggctgttagaagaaatgaatgacgcctacagatgataggatgttccatggtggtgtatgcatcggggtagcccgagtaacgtcggggcatcccggataggccgaaaaatgtgttgtggtggaaagaaatgttagatttacgccgatgaatatgatagtgaaagggatttgggcgtaggtatgggtctagggtgtagccgagagaataggggaaatcagtggaatagaagcctcctatgagggcaaatacagcccctatggataggacataggggaagtgagctacaacgtagtacgtgtcgtgtagcacgatgtcaagagatagagttggctaatacaatgccagtcaggccacctacgggtgaaaagaaagaagaatcctagggctcagagcactgcagcaaccattcaaattgctccgggaaa

SEQ ID NO: 650937 - DNA, 412 bp, Homo sapiens
  misc_feature (100)..(100): n is a, c, g, or t
  misc_feature (107)..(107): n is a, c, g, or t
  misc_feature (243)..(243): n is a, c, g, or t
  misc_feature (328)..(329): n is a, c, g, or t
  misc_feature (331)..(331): n is a, c, g, or t
ttatgtgtggaaaaatgcttggcctaatcctacaacaattataacaagcccttaagtcggtatcatgaaacttctgaagagaatagagcccaacttgtgntttaacnttttaaacttactgtcttctatacctatgttttacacaattataagattattcttatttttaaagagatctagaaatgaaacccctgaaagagacttctccctctacttgcccataaagatcctccagttttccgnacaggctttttcctagacatggaggaagtgcccagaaaaatactggacggatatacaaaaacataatgccacaaaaattttcctnncnagtaaggcagctgcggaaagtcggccagcgtcccgaccccagggacctgcagcctgggacttgtgaaggcccactgtgtag

SEQ ID NO: 650938 - DNA, 178 bp, Homo sapiens
aaaacagtgctgttggagatggagaggagataccaaattctggagacatttctgagttagaatctacagtatttatcagacaagggaaagattagacaaaggagttaagaagtactccaggtttcgattgggcaggtactaggcatagtttgaaagtagttattggatctctacatga

SEQ ID NO: 650939 - DNA, 513 bp, Homo sapiens
ttcacattttacatgaaatttaattttcatattttgtagtaaaagcccagaaaggtgctacttgaatgaagatgcacctgtctctacatagaaatctttttaacatcacagtagcgacgaccacagtcctagtttagaatcattattatgacgataggaatttgtagcagccctcaacccgtggccttctgaaccgtctctccactgtcctataagggagggctaactgtattcctggtcgctcctgggactgggagctcctggggaaggaatcctaaaggagtggttgtcaatgcattttcattaacagccgcgcttctcggcagcctcctagggctggggtggccacgtgctcccttaaactgttttcacaactcgaggctgtgctgtgggtggcaattgaaggtttccaagaacttttcgtttttctttgggccaacatttctgttttctgtcaatcaatagtttagttatttaaaaataagaaggtgaagagggagttatttagggtgg

SEQ ID NO: 650940 - DNA, 113 bp, Homo sapiens
atccatcaggattgttaagcctgggcctggacactggacaacagcaggatgctcaagaattttcaaagctctttatgtctctattggaagatactttgtctaaacaaaagaat

SEQ ID NO: 650941 - DNA, 480 bp, Homo sapiens
ttcacattttacatgaaatttaattttcatattttgtagtaaaagcccagaaaggtgctacttgaatgaagatgcacctgtctctacatagaaatctttttaacatcacagtagcgacgaccacagtcctagtttagaatcattattatgacgataggaatttgtagcagccctcaacccgtggccttctgaaccgtctctccactgtcctataagggagggctaactgtattcctggtcgctcctgggactgggagctcctggggaaggaatcctaaaggagtggttgtcaatgcattttcattaacagccgcgcttctcggcagcctcctagggctggggtggccacgtgctcccttaaactgttttctctattctttttgcgctgcgggggcaacgtgagggttgccaagggcgggggggggggcttgtgggccttcattttgtctcttctgtcaatcaacagcccagcctacctaa

SEQ ID NO: 650942 - DNA, 1408 bp, Homo sapiens
gttgggccggaggaaagcgggaagactcatcggagcgtgtggataagagccgacgcatatagttaaccctagatctcgaaatgcatcgtgattcctgtccattggcactgtaaggtattatgtcaggcacatcttgcgaaaccaatggccaaccaagcacggcacattggacactggagcttattggctcactcatggaaccactccgtacagctgtgtaggacgtaagcctcagcacaaccccacccaggctattgcctattaagtagcacatcttgcaagcatcccgcgcagcatgccagcctgcatagccaagtcctgcagcagcgtcagcatgcgcacagcacacacctcatgttgcgcctggccgcagctacacggaggctgcgcaaacttgtacgacaccatcgcgtcggcacacacaccaccaggcacagctaacacacacttcggttgggacaacataccttacaccttctctcggagggagcacggcacaccatcactatccgcacgcatggacactcaatccggcaactcctgagaacgcgcgcgtcactattccactaccctctcgaggtcctctcgctgatactatttctttaccacacgcacaccaggcggcacaaaacgccctcatcctatctgccgccactctacccgtggggaaccgacagaggtggcttcgcgcatttacgagcactaaggagaggaacttacagcgacaagaaccacgaacggaacgcagcgacttgagccggtgccaccacacgggccgacaaacaaatcacccatcacaacccaccacgccgggtaccacccaggacacccccccaccactacacacagcgccaccccgcaatacctccggaagcacataaagagatttcacaaacaagaacacagggggaaaaccataagccacacgaacacacgcaacgagcccacacaaccaaacggcaggcgacgaaccaaacgcacgcaacaaaaaaacaaacacccacaaccggaacgccagaaccaacaagcgcaacacgcgcaaccagagcccgagacacacccccagggacagcgaccgaaccacctccacaccaccaccaggaccgcgaccacccccaaccagccacagcccaccaccgccatgggccacctcaacatcaagacaaccgtatcctaacactgcaccgaccaacgaggccgaccgacaaaccggacgccaacaccaccgacacaaagaggcacaacagaacaacggagacccacctcaagccacgccaaccagagcgagggaacaacgccatctcggcacgcaaacaaacacaggagcacacgccactaccacaagcacggcaactagcgcacaaacaccgcctcacaacaaaccgccacaaacgagcatcacacaccc

SEQ ID NO: 650943 - DNA, 1258 bp, Homo sapiens
gcttcgggctcctggcagcatcgcagccccaggcggtgcctccatatgcgtcggagaagccagagctgcagggaccatggaaaaggaatactatgagccccgaggcgactctgcagtcgtgctgcgtctccgcgtgccgcggccagggctagcctagtggtctcaggctaaagtgtagccgcatccggtgacgacagttgtgtgccacatgttgtccgcagaattcctactaagcgagcgactggaactacgcatgatccagtcatgccagtctgctgccagcgcccatgtgaacccagttgatcgggcctcattgagggagcattgcacccgctatgcatacgaagcgacataccggagagaagcgccagttgcctgcatgccaagccgggtgaatgttcatgtgcgtgccgtgggaccacatcgaagatgtactacacgtgcagaagcatacttttcgttgcacatgcgccgtccagtggggcacttgcagagcccgcagctccaagagcatgcagagtctgggggaaggggtgaaacaaccgacgtggagtccccgttgcgacagggcaggggactactgtcgcgaggaataaccatccatcgggcccaaggcggtcccgcatgcgcaagtccccgcaacaggcagggtggttgaggtaaacacaaatgagtcttgggttggaagggacagccttccagggggaactggccccgagtacgcggagaaacagaggcctggcagaagaggaatcccagttagaaggaccaactgagccccactaagcacgtatgtccacgagagagccattgtccgtggatgcgcgttgggacacggtgtaccttggcagttaggcccatcttagggggacacgtttcgtttctccattgcatttcgcgttgtggcgcaacccgggactttaccttcggctggaccattcccttgggaagagcaaagcgcggccacttatactttctccctaggcaacgtggaaaaccaagagggaggaatccaggctaggggtccaaacgcaatggccagttacacggcattggggcatgacgggacaccccaccaaagtgcccaagggtttagcacttcaggcccacggacttcgaggcgaggccatctcggagatggtggcgcatgtccccataaatgttaacccttgataaatttgggtgaaccaaggccaactggggttaaccccaatgttacttgggaagcgatggtctacccacgagtaatcgcaagctg

SEQ ID NO: 650944 - DNA, 99 bp, Homo sapiens
gaagcggcgatagctgtcggtagcgaccgtggcgtccgagccgtcctttacgtggccggggaccttctcgaacacgtcccagacgctgggcccgcgccc

SEQ ID NO: 650945 - DNA, 88 bp, Homo sapiens
ggctttccaaattgcacacactcctggtttccctcacgattctctgactgcactttttcatcttcaccagcccttcagtcgtcccctc

SEQ ID NO: 650946 - DNA, 578 bp, Homo sapiens
atgagtgacatgaacttgcccacgaacacaaactctaggttcttcaacaggagaattttactgtgtatcttgtggttccactgtgtggagacattcctgggcacagttggtccgttagaattaaaagtcgaattttttttttttttaaattttttttttccccccaggactggtgtgtctggtcctgcgcacacaccgccaagtgtccccccacagtcagcagcaggtggggcctgaccatgggaacttgattgtcaagtcacgggaggtcttgacttttttatctcagttcatgtcctctcccataatgggaagggaccttggtctggtttccctctggggtgccttccaaaacgcatctcatgtccctggtgagggaataggtgagggcctgctgtgacctgctgtggctgcaagggtcacccagcggggcaaatcacgggagtagacaattggaccggtcacctgaaaaggatggccctcagacggcggggtacagggcctggggcaggctggagagagaaggggggcagagggtgacgggaccacaggggtctgggaaaaggggcaagaggggg

SEQ ID NO: 650947 - DNA, 501 bp, Homo sapiens
  misc_feature (492)..(492): n is a, c, g, or t
tgagatggagtctcgctctgtcacccaggctggagtgtagtggcgtgatctccgctcactgcaagctctgcctcctgggttcacgccattctcctgcctcagcctcccgagtagctgggactacaggtgcccgccaccatgcccggttaatttttttgtattttttaataaagacagggtttcaccatgctagccaggatggtctctatctcctgacctcatgatccacctgcctcggcctaccaaagtattgggattaccggggtgagccaccgagcctggccgacctcctcagcttctaaaggacacagtaccttggaggaatgtgcacggagggatggagtcctacactcctgggatgccgaaatgctgagagtcaagagactgggatttggggggacaaggcttccagggttccgcctgagcaagggagtttttgacttcttagacaggaggttctttcacttcctttggagtgggtctctgacctgngaatgtggg

SEQ ID NO: 650948 - DNA, 537 bp, Homo sapiens
gcaaggatgggggtaccttggagataatgataaatcaacaggttgaaccgtctaacaacagactttaatgtaattgtggaagcattgagcaaatccaaggcagcactcatggaaatcagtgaagataaaacaacaatcagaatgtcaccaagcaaacccctacctgaagtgactgatatgtatagaaatgatgtaaaaaacacataggtatatattaaaggcttcccagctgatgcaactcttgataacataaaagaatggttagaagatagaggtcaagtaataaatattcagataagaagaacgtagcatagagcatataggggatcaatactagttggagaaaatagcattgcatctgctaagaaaatttgaaaagaaccctggccagaagtagaaagaaagagagctggtaatacaaatcgaggacgataactatgccaaaaagaatgaagaaagaaagaataaaaggtggaagctaaataagaactaaagaggaaaagaagaaaacaaagtagaagagcatctgaaagaact

SEQ ID NO: 650949 - DNA, 213 bp, Homo sapiens
gtactggtgatatactggtctatatgagcgatttatacgaattgcattcttccccagattttgtttattcttgttgcgtaaataatcaaagatcaggtacctttaaaggacgaaagtaagtactggggtatcttacaccctaatctaaaattgttgcattatacatacatataacttggataaaaatgagtaacttggataagagtgcgtaca

SEQ ID NO: 650950 - DNA, 392 bp, Homo sapiens
  misc_feature (61)..(61): n is a, c, g, or t
  misc_feature (63)..(63): n is a, c, g, or t
  misc_feature (392)..(392): n is a, c, g, or t
atgtaatcagtaatctggaaaataaagaaaaattaaaatgcttatcaaatctaccaccagnangtaattagtgttaacatttgggtatattttcgtttagttttgttttttttttttaaaggcagtctcactctgttgcccaggctggagtgcagtggcgcaatcttggctcactgcaacctccacctcctgggttcaagcagttctcctgcctcagcctcccaggtagctgggactacaggcacatgccgccacgcccggataatttcttttgtgttttagtagagatggggtttcaccgtgttgcccaggctgatctccaactcctgagctcaggtaatccgcctgcctcggcctcccaaaatgctaggatcacaggcgtgagccacccn

SEQ ID NO: 650951 - DNA, 192 bp, Homo sapiens
tagggctcgatgttacatgatggggggtctggaccaagaggccccagaaagacaagggccagacgtaggcggggccatgggggtggaaggtatgtgatccttggacagctaatcatcaccagagctcccttcgttcgcggaacacgattcagccaggccatacctgcctgtccagccctcacctccacacac

SEQ ID NO: 650952 - DNA, 473 bp, Homo sapiens
catgtgcacagaacacatcagtctccagagcctctgggtctatactggcagcaaagtcacacaggggtgcacgggaactgttcccacaccagagtgtgaggctttgggcactcgtgggtgtggccacagctcttgccaggttggggaacttgcaggccacagggtatgtgcggcgaggctgaaaggtggccaacggtcgactgcaatgccctcaatgaccataaggcaccagcccgggcgtctcacagcatgttgatggactcgatcatgttggtgtccaggtcggtccagtaaaggctctggtcagcgtagtaacacggtaaggccgttgcaccgtcacaccttgtccaccagcagtcatacagttggtcctgtccatcaaggtcgacgcgattcgtgacatcgcgcctcactcggtacagtatatgtagcccttggtcagatccaggcccaaccctctcgggttgctcgcg

SEQ ID NO: 650953 - DNA, 1559 bp, Homo sapiens
  misc_feature (5)..(6): n is a, c, g, or t
gtcanntcgtcgaacccacggcgctctgcacactcaaagagaccgagaagattactgtatgtggggaggggggatggtccagttctatgacctcctcaacatatacgagctcaacggtttaccctcggagaccaacacccgtatatatttaatggtgactttgtggaccgaggctccttctctgtagaagatgatccctcacccattaatcgagacttcaaggctgcgctgtacccagttatcacatttcaccatccttcgaggcaaccacagagacagacaacatgaaccagaatctacaggtattcagagggtgcaggtgaaggccaagtacaacagcccagaatggtacgagacatcatattagacgaggatgattacgagagtggcgtcccgaatatggaaccagatgcactcacagcggcacaacgactgcttgaatcaatgacacagagaggaccttgatctcccgctgaacagagacaggcactgtcacaccatgagcaatgacaaatcacaggcaaagacacatacgacacgccggcaacaatcgacacgacacgacccacccagaggcactacacacagcggagccccccaaccggatgactcaaccacagtgcacaaacatgggactaccgagcacatccgcaggccagccaacacaagaaaaaccacggacggacgccataccgaactacgaagagacacaagccgcgacccgacaccaccgagcagcaccaggcaacaaagacaaagaacggcgaacgacactaggagacacaacaagacggaggcaaaagcgagaccggtagaccaacaggcgcacccacaagagagaaccacaccacaccacacacgtcagcagaccagacaaacatagcaagagacacacaagccacacggcataccgaagagagcaacagcaagagcgagaaagcgagaacaacgacagcacgcagcggcaaaccgcgacagagcacgagacgaccacgacacgagaacgagacagacggagcgaagaagccacgagaaggagaacagcgaatagcagagagcagagaacgagagccaagcaagcgccgaccagcagaggaacgagagcgacacgaggacacgagcgaacaaggtcagccgcgaggacaggggagagcaagaacacgtgacgaagggcgatcacacgacaaccgagccaagacgcagaagcagccaaggaacgaacagcaccaacgaacacccaccaccacgccacacaccatagcacacaacgcacgacgacacgagcgcagcaggcaagcaatgagacaacacaccaaccccacaaagcaaccggcgacacaaccaacacgagcccgaacacgcaccaaccaaccacgacaacgccaggagcacaggccacacacagaccacagacgaagacgagcaatcgcacgcaggcgaaccagacaatcaagacgcacgacaagcccgagaacggagagcagcaccgaaccaccacacacccacacacagcaacacacaggagcacgcacaaacgcgcaggcacgcacacgaccagc

SEQ ID NO: 650954 - DNA, 202 bp, Homo sapiens
attagccctgatgcggaagcgatcattcaggaggttctgacaggaacagcatggattccgtggactgctgttgcagtctcaagaagactgagagcttccaaaatgctcaggcaggctccaaccctaagaaggtcgacctctatcatctggagagatcgcaggtgccaacagcacttagctcggtcggctacattggcatcca

SEQ ID NO: 650955 - DNA, 316 bp, Homo sapiens
caaaccatgaagtagtgccttcagtgctcagtataggtctggcattcatcagcattcccattgcaaaggggtatgagaaaatgacttcttattatggtcccagttttttttcttgattcctaaaaaagacaagtacagtgttactaagggtacctactaagcttctgagtggtagatgaatatctaaaaaaaaaaatggtttgtaggcgttggatttgctcaatgttatgcccacccagaatgttataaaccttctgttgtttcaggcagccttctgttcatcctataaacttttaatgagtgcctgtttgtaaac

SEQ ID NO: 650956 - DNA, 202 bp, Homo sapiens
caggtcatcactgtgataaatcatgctcatatgaattttcccttgataggatgtgacatgaatgacactacctctgtagtcttcctctaagatacgtaagctcagtctcatactgagtgaagagagttgacaaatatcaactgcgggacattctaccaaacagctgtacttgaacccctcaataagtgtcaggggagaatga

SEQ ID NO: 650957 - DNA, 1011 bp, Homo sapiens
gacaatggcggagtgatgcctggtgcagcgggggggccgggggccctggtggccctgggatggggaatcgcggtggctaccgcggacgtgtttcggcatgtgcatccggggccgaatgtcgcgaggccgtgtgatggaggccggggcctgaggccgcggagcgtcggcggcaggcaacggcccgaggaataacggaggtggactgccgcgtcgaccggagagtagggccggcgtatgaatcgaatcggaacgtgacaccgatcataccgtccgctggtaggatgatcgtatcgtccttctcgctcgtgccccattagcggaatcagagactcatggatttcttccgtgtgggggatcgtcgtcgtccaaggatgacggtttggcaaggattcatgcacaaggtgctgagcaatcatcagccgtgtgtccggccaagcagccaacgaggttcaaggtcgatttgtggcttatccggggcactaacgaatggccaacgtcggggctggagtctgtgaaggttgttctcaaggacggtgggccagacgcacagtcgcagttgggggccaatcattccttggtccaagctttctcgcgagtcgctctcccgttgctgcagggagagcatacatggtgggaacaatgagtcggcaaatgcaccaccatgtgtcccattgcaaagggttaacaagagaccgccttgacgagaatcttgatgcatgagtaactgggcgtccataccgcttgatgccccatgggagtaaactgggaaaatacggtctgccggatatacatggtggcgcttaagaaaagcatagcttcgatgaatgggctcgggatatcgggataacgtgtgtaccccgtcatccccggaggctgaactgtcggcgctggggaaagcttcggtcagagcgcacctatggaatgcccctttcctaagaacgtaagataactgaacccccgaactctgaagagagactgattcaccaaagattcgtattagaattcatgacc

SEQ ID NO: 650958 - DNA, 160 bp, Homo sapiens
cataaaacaaaggtttatttagctactgggttctgctggctgtccattaagcacggtgccagtatctgcttctggtgagggcctcaggctgcttccagtcatggtggaaggtgaagaagagctcgcatatgcatagatcacatggcacgcgatatcgcca

SEQ ID NO: 650959 - DNA, 1323 bp, Homo sapiens
taaaaggttcagcttttaattggaacctggttataaaaaaggtttagtcaaaaaaaccaaagcccaggtcttcatcaaacctcctctcggatttcttcttttctttgtgcttctccacttttctttctctcctctcagctgtgagcagcagcagtgtgggagggggcgaggaccctccttgcgtggtgtgcagccaccgagcttgcttggaccaggttccaaccggcccctaaacattgtgacaaatgtaaaggctctcccaatgtgtgtgtgaccgttgtgcgccaggggcccttgttgcaaaacaagccacagggcacaaaaagggctctcaaacatttaacacccgggttgctttacatatagagggcgctattgtgactcttatattcctctccgtgtacatgtgtgtcaccctcatctcggctcgggtcgacaagaaattagaagtgcgcccagagatataaaaattcgcagggcgagaacctctcgggaaaaccaaaaggcgcacagtgggcgcgcgggcgcgcacagtgtgtcatagagagttcttgtgagcgatctgccccggaaagcgccgaggggcctattaatctcgccgcgcgaatgtgaaaaagtgtgaagggcgcctctacaacccccaaaaacggcacaaccacattatagatttctccctcgagaaaaagggaaacccgaaaagaacaacgcggggaaagtttgtgccacacgaagagaagcgttacaaccacaggaaagagggccgaaaaaggcgggcccaaggggggaaaagggggggggcgcccccgcgtggacacatttttgggcgcccaagaaagtcggaatggtctgtgtcccagggggtgcctttccggggccctgtggagggtgaacccccccgggtctccccccaacagaaaggtgccatctgtgggtggtgcccccagaggggcctctttggtgttgcgggaaagaggggtggccccccacgagggtgggcactttttgtgttcgaacccgcttgtttttttttgcccccaccaaaccagggtattcaagacccccctgtaggggcctatgtgttttgtggacaaacacacgatcacaacgcacattccaggggggaacgccccagggggccttgttggggggaagtaaacccagaccttaaggcaaaaggacggcgtcgtgtgagagtaaatgtaaattgagagtcctcacaaggagaggcaccgcatttgttctccacgcacagggagatttaagaaaccccacaacgagtgtagtcgtcacaactgacaaggcacgtggtgtcccacaaaaacc

SEQ ID NO: 650960 - DNA, 106 bp, Homo sapiens
atacctggaaaggctttctaccttcagctgttgaaatcaaaggaaatactgagattgcttcaccacagacaccaccttgctcaggtgaggtggcatctgataaaca

SEQ ID NO: 650961 - DNA, 539 bp, Homo sapiens
cattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttaaaaa

SEQ ID NO: 650962 - DNA, 791 bp, Homo sapiens
  misc_feature (45)..(45): n is a, c, g, or t
  misc_feature (74)..(74): n is a, c, g, or t
  misc_feature (147)..(147): n is a, c, g, or t
  misc_feature (159)..(159): n is a, c, g, or t
  misc_feature (205)..(205): n is a, c, g, or t
  misc_feature (215)..(215): n is a, c, g, or t
  misc_feature (230)..(230): n is a, c, g, or t
  misc_feature (284)..(284): n is a, c, g, or t
gggttcatcccaagcaaacggcggtttgagcgagagagtggtcanggttaaggccaagaactgggctcagctcntggtcgcagggtcgagaagactcgtttctgagctacgagcaagtgacgcagatggaagtgcactatgctcgcnccatcatcatcntggggccaacaaggaccgcgccaacgatgatctctctcgagtttcnccgacaagtntggatctgtgtttcnccatacgacacggcccaagcgggagtatgagatagatggcgggatttaccactntgtgtcgtcccgggagaaaatggagaaggacattcaggcgcacaagttcattgaggccggccagtacaacagccacctctatgggaccagcgtccagtccgtgcgagaggtggcagagcagagcagagcttgcagtgagccaagatcgtgccactgcactccagcctgggcgacagagcgagactctgtctcaaaaaaaaaaaaaaaaaaaaaatacaaaaattggccaggcgcagtgttctcaggcctataatcccagcactttggaaggccgaggtgggcggatcacgaggtcaagagatcgagaccatcatagacaacatggtgaacccccatctctactaaaaatacagaaaaattagccaggcgtggtggcacatgtcctgttatcccagctactcgggaggctgaggcaggagaatcgcttgaaccctttaggcggaggttgcagtgagctgagattgtgccactgcactccagcctggcaacagagtgagactccatctc

SEQ ID NO: 650963 - DNA, 267 bp, Homo sapiens
ctaattcgcggccgcgtcgacgattactccagagctgagagtaggaaggcaggcaggcagagagggaggcagagaggcagagagggaggcagagaggcagagagggaggcagagaggcagagagggaggcagagaggcagagagggaggcagagaggcagagagggaggcagagaggcagagagggaggcagagagggaggcagagagggaggcagagaggcagagagggaggcagggaggcagagagggaggcagagaggcagaga

SEQ ID NO: 650964 - DNA, 135 bp, Homo sapiens
attcgcggccgcgtcgactgtgttttctagttcgacgcctacctttagggacataacttcactttgtaacccaagccatactttattaaattaaccctagctgaatgaattgtgaaaatgtaagtgaccaatgat

SEQ ID NO: 650965 - DNA, 825 bp, Homo sapiens
cgttgtctggatttcccgtcgtaagttagagggaaattttcagcaatgtccggagccctgtatgtcctgcaaatgaaggaggaggatgtccttaagttccttgcagcaaggaacccacttaggtggcgccaatcttgatcttccagatggaacagtacatctataaagaggaaaagtgaagtggcatctatatcataaatcgtcgaatgaggaccgtggggagaagcttcgtgcgtggcgagtctcgtgcaattgttgccattgaaaacgccttgctgatgtcagtgttatatcctccaggaatactggccagagggctgtgctgaagtttgctgctgccactgggagccagtccaattgctggccgcgttcgactcctggaaccgttcactaaccagtatccaaggcagacctattccgggagccacgagattctctgtgggttactgaccccaggcgctgactcgatcgaagcactctcacggaggccctctgatgtggaacctagctacaacattgcgctgcgtaacacagattctcctctgcgctatgtggacatcgccatcccatgcaacaacgagggagctcactcagctgggtttgatgtggtggatgctggctcgggaagttctgtgcatgcgtggcagcatttcccgttgaacacccatgggaggtcctgcctgctccgtccttctagcggaactcctgactgagattgcccccgactcagccggctgctgttgcagaaggccgtgagcacggaaggcattccggctgcccggctgctcccgctcctgagttcactgctactcagcctgcgctgca

SEQ ID NO: 650966 - DNA, 168 bp, Homo sapiens
gtgcttcacataatatatagaagcatattatttatctcaatattccctagagcctgggctgcggacagatggctcatggctttaaccctagcacgttgtggtggccaatgcgtggcagatccacgttgagcgtcatggagttcgtagaccagtctgtgccgggagatc

SEQ ID NO: 650967 - DNA, 785 bp, Homo sapiens
ccgaggaaaaacgtgtactattagccatggtcaaccaccacacgtgttacttcgacattgccgtcgacggcgagcccttgaggccgcagtctcctttgagctgtacgcagacaaggtcccaaacgacagcagaacaattgttcgtgctcatgagcactggagagacaaggattaggttataagggttccatgcatttcacagaatatataccagggtttatgtgtcagggtggagacattcacacagaccataatggcactggatggcaacgtccatctatggcggagaaatcctgaagactgataacttcatcctaacagcataccggagtccaggaaatctatgatacagtggcccacaaatgctggaaccaatcacacaactggttcccaagtcctatcactcatgcaactgaccaagcactgacatgactatgcgcatggctagccactgtggctagacaggggcaacagcagacaacacagcgccatgaactacatcggcggacagcgcccactgcaaaaccgacccagagcatccaaagagcaatggccaaggaaccacgcaccccacagaatcaccaatcagcagcaacgatgaacaaaaatacgcaacataaacgtctgggacatggacggacgaaaaacgtacaaacaacaaggacacacacaacataaccaggaaagcacaacggcagaagacaccaccaaccaagccccccaaacaggatcacgccaacaacaactacaaaatctaggagaacccacgccagccaccacaacca

SEQ ID NO: 650968 - DNA, 116 bp, Homo sapiens
gtcaaaaaaaaaccagagtcttgtttaagtaacccggttcgaaattgggctttgaaaccccccttcccacgttgttttttcctttctcaataaaaaacaccggggggacgttttcc

SEQ ID NO: 650969 - DNA, 151 bp, Homo sapiens
tgagtgtctagaggatcactgaagtcaccgcgtggcttggccaagtgcatacgcacaacctatggtgaacaataacgagctggtactacgcattgcttcggacagcagatacttgaacttcgccaggtttgcagctacatctgctgatcaa

SEQ ID NO: 650970 - DNA, 350 bp, Homo sapiens
  misc_feature (3)..(3): n is a, c, g, or t
ggntcgacgtacaacatttggaggccccagcgagaaagccatgaggagagagccgggctcccccggaaggacggccggcttgtggggggtgccacctaaaaaaaaaccttcaggtcctcgaaaagtgaccgtcttccagaggagagcggatcgactacccggtgggtgcccataaaaattccacctctgagtcctcgacttctgaccctgaggtcacgtaggtcagatttgacttcagttctaggaagagggaagcggccctgatgagggtgtccctctttcgactctgcatgtttccctaggacgctagaaggtagagccctggttttctgttaggcacctctgtgtct

SEQ ID NO: 650971 - DNA, 1109 bp, Homo sapiens
ggcactgctctggtctagttacaaacaggctgcgtggcatggagggacggagtctccagctcctggcctcggagacagtcctcctgatgtaggtctgcccaaaggtgctagtgtgtccggagattgatgggttctgtggtctcactgagcttcacacggaagtgcaagccgggggaccctcggcagctcgtgcgtacatggtgctgcatgtctgcggcagagactgatgggtccgtcagggctccaaacgaggagcttgcaaactcaaaggtcaagtcctcatcagaggtatctgacaattccaggccgtgttccaccagaagagtgatttcactggtttcatgccaccgaggcgaaccctgaggccgtccgacctttctctggggtgaataaagctgcacagacagccgcagggagtggaaaagtcagtggggagactcccgtagttaaggatcttcgagctgcagtgtggtgtggaacgtgaatcaagggactcaatcgagatgttacgggggaccatggctgcaagggaaggtccaaacgaacagcattgtagtacgcaactacatcggacgtgaccacggtgaaggtatacgccaaacagccaagtacccgtggaagaccatcggggagttcttgggggatgagcttcatggggggcatctgaaggggttcctttagaattaggctccaacatcgacactggtgggctgggacgcataaggagttccccaaggtgggcgggcctcgtttatccaaaaagggcttgaatggcgttaggacaagggcttgggggaggattccacgcttaagaaagtcgccgttatgcttggggggccaccattcttactggactaggtgtcaacaaaaggcaaagtgttccgcaattgagtggccggtgaacgatttacagtgggcccttccaagggtacacaaaaggacaattgggggcgacggcttggagactcccttggagaagatcgaaacggggttaggaaccctccaccaacacgggggggacagagaaccgtacgtgaaccccgttttatggccgtcgatagtggaagtccatggggagcaggattacacccgcgaaggacccgtggaac

SEQ ID NO: 650972 - DNA, 102 bp, Homo sapiens
acggccgtgtattactgtgcgagagatttggacgatattgtagtggtggtagctgctaacgataagaggtttgactactggggccagggaaccctggtcacc

SEQ ID NO: 650973 - DNA, 135 bp, Homo sapiens
caccctaaatttattactgtatcttttcaaaagttgtaaaatttattcaaccgcctacgaccaactggagggagtatagagcggaattccatgaagtagagatgcattaagttcataataaatttagggttgatg

SEQ ID NO: 650974 - DNA, 198 bp, Homo sapiens
gcgcggaggccgcaacgatgcctggagttactgtaaaagacgtgaaccagcaggagttcgtaagagtctctggcggccttcctcaaaaagtccgggacgctgaaagtccccctatggtgggataccaacaagctcgccaatcacaaagatctttctccctacgatgagacttgttctacaagcgagcttcttacacag

SEQ ID NO: 650975 - DNA, 795 bp, Homo sapiens
  misc_feature (549)..(549): n is a, c, g, or t
gttctttcacttctaaaatgcatttaagatcatctatggctgtgttgttacatgattcaatggctcattccttcttgttgctgagtaatattccattgtatggatataccacagcttatctatttccttgttgaagacattttagttgctttcagtttttagtgactatgaataaaactggtatagacgttgtatatagattttgtgtggacatgttttaaaatcacctgggtaaatacttagaaatatgattgctggctatatggttaagttttatacttagttttataagaaactgccacactgtcttccagagtggctgtatcattttgcattcccaccaacaatgattgagagtttgctattctgcatccttgccagcatttattattgtcagtcttttggattttagccattttaatggggtgtgtagtggcaattcattgtagttttaatttattgctttaatgacatgatgttgagcatcttctcatgtgtttattgccgtttgtatattacagtatgttcaccaaactccgtgacatgcangtactattttacaaccgttatgtacctgaactaaataattaaataaatagcgtgcttttcaacaatggtttgcagacggggcgccacggagacatccggttacacaaaaaaaattccgcccgaattacatttcgcggagaaatgtgcacagggtcgcaccgcgctaggctcgtgtgtcgacagcacggagacgcgcaaaccaacacgcaagcaacaagcacacacacacgagccagcaacaacagg

SEQ ID NO: 650976 - DNA, 107 bp, Homo sapiens
attctgagattcagtttggttctcctggatgttatgctctgtattggtacctgtaatatagggaaacacaacttttttggggaaagccctttgaccccagccgatcg

SEQ ID NO: 650977 - DNA, 203 bp, Homo sapiens
acttctgacttcaaaataataaatcccacaggctgctggtattggatacgtactcgaacctgacgcggcatctatttggggttaagccaagacctgcatagaaacaggcaggaacacagacagtcacatgagatattcactgaaagatgacaaccttaaacacttcaggaacatatagagtcaaaggaacgatgtattatttc

SEQ ID NO: 650978 - DNA, 576 bp, Homo sapiens
gggtatttcagcacggtttttgaagggataaggtgtttttgacagcgggtgttatagcgcccgttgagctgaacaatgcttgacgcccagttgttttgagggccaccacagaaaaaataaggggcgacacccgcgcccaatgggtgttcccccccctggaaggtagcacgcgttatacccgtactatcgtgcgaaagaagcgcccgggtaaaaaagtgaggtaagaggaaaaaactgtagtgcacaccccgttgtcgccaacccctagaggcgagtttaccacctgctggttctcttttggacgtaaatgaaggagagaaaccacgccactggagcagcactattactctcttccgcacacctggggctgttccccaatctcgtgtgggcccccacccttggcacacgaggtgtaggggggaatatacaatatcaccatgtttctatattctgttaaaataatattctatcagccccccggggccgcctagaattgaaagtatagatccatgctggattccccgtgtgaagataacaagttcgacaccatactgtccccacaattagtcgagacaa

SEQ ID NO: 650979 - DNA, 149 bp, Homo sapiens
ttgcaatcctccaggtgcaggtctggctcagggcccaggggcccatccaccatccacacttccttggttttccttcccaccactcttgcaggcaagcaggctttccaacagtcacaggtcagcagcagccgggccagggtgtcacggca

SEQ ID NO: 650980 - DNA, 123 bp, Homo sapiens
ctgggtggcgactggaccgctcttctactggtgcctgtggatttcctgggcgccttcgtgggttcattcatcgcgcgcatctcgcgcgggcgcagtgtgcgcgagttcgtgatcggcgtggtg

SEQ ID NO: 650981 - DNA, 170 bp, Homo sapiens
tcactacgtgacctgacgtggtcacgtggttccctgagattcaagggccaatgccttcagaacaccatgcagtttttccgagcaattactgttctccatgcacacacaccatttgtctgtgtagagcacactgaggcgtacttacttaatttccgtcttgtcttttgacc

SEQ ID NO: 650982 - DNA, 111 bp, Homo sapiens
ctgtagtcaatatgttaagccactttcgtagtctatttgtgtccactggagtatttacaactcagtgagtatagcttattggggaggggtgatctaaacatctttacgcgg

SEQ ID NO: 650983 - DNA, 894 bp, Homo sapiens
accccaggcctgggtcagacatggcacatggcaggtgacacagtgacagaggggtccccagctgccacctcacccaccgcaattcatttagtagcatggcacatgggtgcagctcctggcacggctttctcagtgcctatgcctgtgatgcctcgatggtgcttggatgatgctggtgaatgacatggcatgtgctctggtgtgagtttgcatgcatgtgactgtcaccatgtgagtgtgctgaacgctgtgccactgtgtgatgtgtgtgtgtgcccctgtgtgtacatttgctgcatgcaagtgatgtgcttgcatgtggtgctctgttgcctgctgtggctgcctgtggtcccactgatggctacttgctgtgcccatgtggtcttgtgtgctgtgagatgtggcccgacagttgtgactttgtgtttgagctgcttgtatttgcccatcagcctgactcaggcctccttgggtgcctaggtgctttgtgcaatgaacattgtactatggcagtctcaaggggtgaatgtcaatgggtgacattgtgtgtgctgatgacgcagaacataggcagatgtgcgtggctgtggggctggaggttggaatagcagcttctccagtgacgtggactggattgtgttgcatgtggcagtgggtgttgacgcgagctgcacgcgtgggctgtgcctgaatgctgtggatggcacgttgtgccttccaagaagccctgttgcgccaaaggggcaggggcactctgctgggcgtgatgacgggaggcctgggaatcggttgccctcaggcgtatcgggcctggaggacagagtggcagtgtctccaagctgtgggtttgtgacgtgcccacgcatgtggccgaagggcaagacagccatg

SEQ ID NO: 650984 - DNA, 361 bp, Homo sapiens
  misc_feature (1)..(1): n is a, c, g, or t
nggattattttacaagataccaccagaggaagctcccctggtcttaaatcaacaaagtgaaacaacgtggttaggagcagtcctcctcacacttgaacatggctgagaacggcagtgagatcttattaagaagcaggttctgattcaaccagtgtgggaaagagtttgagaatcaacacttttttttttttagggccacatccttggcattgggaagttgccaggcagctagggggtcgaatgggagctgcagctgccagccacagccacagcaatatggaatccaagctgggtctgcgacctccattgcagctcacaggtgatgcgagcaaggtcagggacggagcccaaatcctcatga

SEQ ID NO: 650985 - DNA, 1053 bp, Homo sapiens
gtgctctgcgcttgctgtgctggtgtgtggctgttttgtgcgctttgttggtggttgtcgccgtgcgggtgtgcgtgcgtgtccaggtttcggctgttccgattttgctcgcccggtgttttcgcctgtgcgccctgggacccgcggaggccccgcgcggctgggcaccttacccctggtgagccaagtgtgcagcgctctttgcccggggagttgggtccagacttaccgttgttgcgcctgacccgggggttcgttgcgcgtcaagtgccgtggttttggtgggagcccccgctgggcccctaaggatcctctgcgcccgcatcgcctcccgaggggagattgaagcttctgaggaatcatgttctagagaccttgtgaccccctgtcacccctcatcgatgcttcatgaaagccagatttatgatgtggaaaatgacaccggattcccggaaggctatccgacccctatccccctgccctgtacttactggcccaagcccattttcgacccaccccgccttccacccagatcagcttcgggcccagatgatcctgtttgcttttggccagtgccctggctcaggcccggctcctctatgggaatgagtgcccacggttcttggaggccgcccctggtggttccgaggcgctgggcccggagtggaacgtgtctgtccctttcctagtgtttcacactggatatccaccacgacctggaactctaaacgagggtgtcacagaaatttggcctcgggtggaactcacgaccacgctccttctatcacgcactttttggtgttctccccgtgatccacaaagagagtggttgttggaacctcgttggccccggttggtttcacagcccgagacacttcagaaagtttttagctctatatttgcactggtgctgcgtgagcgcgaggaccccttctgaatcctgaaacccctcttgcctcttctttccaccggaagagggcctgggccccctggagcctccgtgcccctttggcctgctgctttcgctgaccataaagagcccctgcgttgcca

SEQ ID NO: 650986 - DNA, 907 bp, Homo sapiens
  misc_feature (38)..(38): n is a, c, g, or t
  misc_feature (72)..(72): n is a, c, g, or t
  misc_feature (78)..(78): n is a, c, g, or t
  misc_feature (85)..(85): n is a, c, g, or t
  misc_feature (98)..(98): n is a, c, g, or t
  misc_feature (102)..(102): n is a, c, g, or t
  misc_feature (110)..(112): n is a, c, g, or t
  misc_feature (118)..(118): n is a, c, g, or t
  misc_feature (142)..(142): n is a, c, g, or t
  misc_feature (157)..(157): n is a, c, g, or t
  misc_feature (159)..(159): n is a, c, g, or t
  misc_feature (181)..(181): n is a, c, g, or t
  misc_feature (193)..(193): n is a, c, g, or t
  misc_feature (198)..(198): n is a, c, g, or t
  misc_feature (226)..(234): n is a, c, g, or t
  misc_feature (246)..(246): n is a, c, g, or t
  misc_feature (262)..(262): n is a, c, g, or t
  misc_feature (264)..(266): n is a, c, g, or t
  misc_feature (271)..(271): n is a, c, g, or t
  misc_feature (277)..(277): n is a, c, g, or t
  misc_feature (279)..(279): n is a, c, g, or t
  misc_feature (305)..(305): n is a, c, g, or t
  misc_feature (368)..(368): n is a, c, g, or t
  misc_feature (444)..(444): n is a, c, g, or t
  misc_feature (755)..(755): n is a, c, g, or t
  misc_feature (759)..(759): n is a, c, g, or t
  misc_feature (780)..(780): n is a, c, g, or t
  misc_feature (801)..(801): n is a, c, g, or t
  misc_feature (819)..(819): n is a, c, g, or t
  misc_feature (906)..(906): n is a, c, g, or t
tcgaggctcacatgactctagacacttggtggaaagtnaggcgagaaaaacatattgacttgggccaattanacaaanacaaagntagaactgccaanaagnctcaaaannncttggnttctgtagaagttctaaggaagcngtacgaactccacgnangtggggcgctaactagcagggncccctgcaagtnttggnagggggcctcgagctgcctgggctgacnnnnnnnnnggggtctgtgtngccaacaggtgaccgntnnnttgcntgcccncngcttacttggccaaggggtttctgangttcctgccggcaaacttagccttgctgcccagctcctcttcaattctgaggagctggttgtncttggccaagcgctcagatcggcaaggggcaccagtcttgatctgcccagtgcacagccccacaaccaggtcagcnatgaaggtatcttcagtctcccccgaacgatgagacaccatgacgccccaaccattggcctgggccagcttgcacgcctgaagagactcggtcacggagccaatctggttgactttgagcaggaggcagttgcaggacttctcgttcacggccttggcgatcctctttgggttggtcactgtgagatcatcccccactacctggattcctgcactggctgtgaacttctgccaagctccccagtcatcctggtcaaagggatcttcgatagacaccactgggtagtccttgatgaaggacttgtacaggtnagcnagctggtcaggcgagatgtanctgctggggtcatcgggaganttgaagtccaggtcatanttcccagacctgaataactcggagccgctacgtccatgccgatgaccacttatcagtgtagcagctttcccatagcagtttcagcant

SEQ ID NO: 650987 - DNA, 1225 bp, Homo sapiens
agcaatggtggatactgaaggcggaggtggttgcccgaagaagggaactctggcggtgaaagctgacggcgtcgggggtggagcgcatgtaattgctgtgaccgacgcctatggcctgcctgatcatattcctccaagacgaaggcaggacggacagagtgtcggatcagcgatcgtacgagacaaactttctccgacggaaggaggtgaccctatgctgcacgtcgcacgacaagctgaacgggtggagtcaggggccagagtggtaggaacgaccgatgcgtgaggcaggtgacaacagagtcgatgtccagggaacacgaaccttgcggacgacttcggagagaggaatgagagcgagaggcgtagattcatctgagtaggaagcgcaatgaggggatggtagagaaagatgagtgaccaggaaattgctgggagagaaacaccgcacaggtggcgttgggtaggtgacttttcagtatcttgggaacgaagcgtcttggaatggttggcaccgaattgaaagataatgatgtgcatcgtagcgacacgaaggctgtttgcagggcatgcgaaagtctagcaagggaaccagtttcataggaaaagaaagggtatccaggatcgattcccgtgaaggcggatgccaaaagttattcggaagtaagaataggtccggtcgcttggggcattagatacgaactcaggtggtacgttgagcgggacctccaggtctggaggccttggcacaaaaaagcaccttcgtggcgcattggggggtccccgaaggacggatgaaacaataatggtagaccggttgtggggtttacgataagtgaaggaatcgaaagagataagaattcttgcgtcgaaaaggatcagtgcgtaagctcggatgaagaagatcgggagattgtgaatgcggagtggggactactgtcgaactcgaaggcgctccattctgtgaacaggaattgaatttcaaccaggggagagtaacaggaagtgttgcggtccggccaagtggtgtaaattctgccgggaaattcacacaacaatcattggtgccgcaccgtagagccaccaatgagtaaagagttggggttggatggaatggtatgacacaaaggttattatatgatagcgtatgcacttgaggaaaagggttgcttgtagacacgtaaggcaatttggacgaaaagtagggcagcacctgtagggatta

SEQ ID NO: 650988 - DNA, 1104 bp, Homo sapiens
ggctacgatacacagagcgtcaccagcaatgccatcctcttcgtgcagacagctatgggacttccaggagacggcaggcgccatgctggacctcccaagagaccagctcttcgggcaccagctacagctctgagttcagcaagcggctgctaagcacctatatctgtaaaggtgctgggcaacctgcagttgaacttgctgtgcaagtccaaggtgtacgaggacaccagactctgagacgccatacttccatgcacagacaactacaattacatcctacaagtccactggagaatacccctacacccgacccaggtctgaactgactccagcatggtggcagctgcacacagaagactgcatgagcgcgtcctaccgggcagcacatagagcacgcagatccagaccataccagcgcagcatggtcaaaggtgaaagataacatcgccagagacgaatctaccaatgtgataccagccagggagctcaagactccgaggcacacaggccgcgagcagcacaaatccacaggagccgtaccacacagggcaccaaccccactgggcctacgacaccacacccagacgcgaaatccccccaaagcgcctgggccactaccaagcacaccagaccccacaggagacaggactcagcccaggaccaagcacagacaccaaaagatccacagcacgcacccaacaggaaagacacgaactaccagaaaacgcgggggcacgcccgtggcccccctcaaccacaggaacacccgagagaaacgtacaatacacaaacaccagcgcgtgcacgccaggccgagacgcacaaaatggacacccgacaaagagcccaaaagcagaccacaacacacacgcgcagcgccggcacaaccacagagcaccagcacagagccgccaccgggcacggggaaccgcccaacacgaagtggccccgagtgccaacagcagcgacaaacggaacacaacacaccagcgacaaaccgcacaaccacacagcgccaaggagacagagcgcaaccacgcccaccgccgcaccacagcagaaacggcaacaaaacgcagcacccagggaagacaggaagacacc

SEQ ID NO: 650989 - DNA, 217 bp, Homo sapiens
acgggtgtcatgggagtcgaggcatgaaagagatgtatgcagtgatcccgttcctgagatccaaacagcaagtatacagcagtgaaatgtccagtcgtaacgtgggattatgtcttataagtcctttctttctttttttttttttattttaaggaaaggaattcgcaacaggtggccaaggttgaagtgcgggggtcaaattctcgattcccaatat

SEQ ID NO: 650990 - DNA, 156 bp, Homo sapiens
  misc_feature (152)..(152): n is a, c, g, or t
atactgtttgtggcggccaagcgctcattgcgacgttcgctttgatccttcgcactgctccgctcttcctcactgattgtgacagcaaacacttcaccacgcgttggattgttcacctcactacctaggcgaacgtgcagctgcgggttagntacc

SEQ ID NO: 650991 - DNA, 286 bp, Homo sapiens
ctactatggaagctgcatgaaggagaatctacttgtactcgggaggcagaggttgcaatgagccgagattgtgccacgtgtactccagcccagatgacagagactccatctctataaaaaagtgggggcgtaacagaacgggagaaaacatttgcaattttatagtcgttggactgaagattcatatagatttcctagctgtgtgattgctcaggagctgaactgtaagcatatgcactaagactccccaaacgagcggggagccttctctgaccacatgggcctc

SEQ ID NO: 650992 - DNA, 644 bp, Homo sapiens
  misc_feature (242)..(242): n is a, c, g, or t
gaatctgggccccaaaaattgtttttaaaaaaccgtggggttaaaagggcccgttttatcccaatgtaaccggccacgggccaaactttgagggtgcattttaaaagtcagtgcaaaccccctccgttttaacaacatgttttgccacccaaaggttacggttctttggacaaaagcacacatttggggcaggaacattaacagttctttcttggcaagggatccgttctggctcttgtganagacatcaacactaaaaggggtttaattggcccggaccttttgagtctgcacagttagtacccagctgtgtcttatgcaggaaaaaggcaaaggctttatctcagtttccaggtggacaatcggttcggcacgccaaatagtaatctgtagctaacaaaatggctcacagttgggaacaatgtccccccgctctctatctaaccaagggtccagagttttgcctagagcccgtgcactaaccaagaaaagccctagtaaggccatcaccattttaaccttgatcttgtacgaaaacccgtgtctgctaagtaaggtagggccagccccacgatcgtgatctcgtgttctctcacgagccatccctctcagcagtgttggatactaataaaatataagcagtc

SEQ ID NO: 650993 - DNA, 599 bp, Homo sapiens
  misc_feature (384)..(384): n is a, c, g, or t
  misc_feature (523)..(523): n is a, c, g, or t
acagcgataactccctcctgcacttcagctgactaagcgtggagttcacatgtataccttggcaaagctgccattcacaactggtttgggaactttagggttatcagtataaagcctgagtaacaaaacttagtcatccaatgtccaggctggatggtatttttatttggtgatcagtaattcagcacagggctggaacacattactcacattggtcttatgaccctgttctgtaatcaggggaatcttgaagtggataaagcaagtctagggggagagacatttttttaaaggcactagagggccattctggcatgtcgtgccttccctctttcagccggcatttcagatacatcaatctttgtctagcgctttcaagaaggnccaggctccttcactaaattagggcctgatcaccctggagagttagggacatatccacaagcctcgatggactccccattctacatcagctccttgggtacaggctttcatagaatgatgttcctttccaccataggtngcttgctcagtgtgaaatacacagcatgtagtgtgttatgtgatgaaccctcattcttatgcagaatggcgtctgg

SEQ ID NO: 650994 - DNA, 838 bp, Homo sapiens
  misc_feature (220)..(220): n is a, c, g, or t
gggaacgcggagagcacagcgcatgaaggccgtcgggcacggctaaggagagtacgaaaggtaggtgggtcaagcggcacgcccgatcgccaaagtgccacactgccgcccctctaccggatgcgaattcttatgcagcctaagtcatggtcgtcgcctaagtccctgctgtctgtgctactgtgtggtatcgtcaggtttacatagacccgactgaagnacagtcgttcatgagggagatggtgtacgtgctgcggcatgtggtttgagtcagaagtcccccctggcggtgtgacggaactgtcggggcatctggcttgtcctctgaatgcactccctcgtggagcctggatagctccactagatgattgtgaccccgcgtgtacactaaccgaggaaatcctgaaggcacgcggtagagacgacttggtttgaacacccatgtgggctcagcccggagaacccattggggtgctccgggtaaacacggcagttgcgcagaagcactcgagttcccagtatcgggatacagctggataagggtagggactgcgctgaatccagcgaaggggcacagccaaggggtgtctcaggctcgggagacggagcatggatactcaggcctagtggttcaacaccggaagatcgcaagaggaactccgcaagtttacgccggtgcttactcgccaaacgaagttgccttgttgggctcgttgcatttgccactttaatcccaaaggccatgtttacccaaccaaagagacgggcctcgaaggaaacccgtgcatttcgatagagatgccacgggggcccttttgattccggaggtggttgctcc

SEQ ID NO: 650995 - DNA, 132 bp, Homo sapiens
tacctgggactacgacccgtcgtgacgaccggttagttttaccctacctgatgcatcgtgttgttagccatggtcaatcctgctccagtaacgagaaggagaacctgcagggtccagacatttggtgtatgt

SEQ ID NO: 650996 - DNA, 404 bp, Homo sapiens
aagcggctatgggggtaggcatgagggtctgtggctttggtaggaggggctggtagtagtataacggtggaggctttggagggggcgtaggtgggggtttaggaggtggctttggtggtggcgatggaggtctcctctctggcaatgagaaaattaccatgcagaacctcactgaccgcctggactcctacctggacaaggtacgtgccctggaggaggccaatgctgccctggaggtgacgctccatgaatggtaacagaagcagaaccaaaacagcccagaaatgcgactacagacaatactatcaagaacattgaagagctccgaggaaaagatcatggacaacaaacaacgacaaatccagagtcatcctggaagatcgcacaatgccaggatggataga

SEQ ID NO: 650997 - DNA, 1089 bp, Homo sapiens
  misc_feature (1080)..(1080): n is a, c, g, or t
tggccgggcgctggtggcgcgtgcctgtagtcccgagtagctgtgcaattacagacgcctgccaccatacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctctattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataanaaaaaaaaa

SEQ ID NO: 650998 - DNA, 1031 bp, Homo sapiens
  misc_feature (1022)..(1022): n is a, c, g, or t
tggccgggcgctggtggcgcgtgcctgtagtcccgagtagctgtgcaattacagacgcctgccaccatacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctctattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatcctttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataanaaaaaaaaa

SEQ ID NO: 650999 - DNA, 608 bp, Homo sapiens
  misc_feature (85)..(85): n is a, c, g, or t
  misc_feature (156)..(156): n is a, c, g, or t
  misc_feature (266)..(266): n is a, c, g, or t
cccttcttcctgccgcgggggggggggggttctcccggttcttaattttccccgcgggcgccctccgggtgtgggggggaattcntggggcgggggggggccgcccattttccctctcctctttcttccccgcgtgttggggggagccccaaaaantgagggtgcgcccccccccccccccccccgggggggggtgttttttgtgtggtgttggggagaagccccctcccacaccaccccccccggtttttttcgcgagttttttnccccccctaagggggggggcgcccccccccttttttttttgtgggtgaaaaaaaagaggggttgggcccccccccccccccccccccccgagggggttttttttatggggggggggggggttttttttccccggcctttttttttttttggcccccccccccttttttttttttttttaaaggggggggaaaaacttttttgggcccgggggggggggggggaaaaaaatttttttttttttcccccccgggggggggggccgggggcccccccccccccggggggtttttttttttcccccccccccgggggttttttttttttttttcccgggcccccca

SEQ ID NO: 651000 - DNA, 282 bp, Homo sapiens
gcaggctcgatcggcgggcacttaccatgaatagacgtgcctggatgagtcaatgagtgtgaatgactgtgaagggcctaggacattactgcacactgtagacattataaatactacattgaggctaaacactatgctgaggctacactaaatttattttaaaattttttcttcctcaataataaattaaccttagtttatggtaacatttttttctttataaacttttttttttttttttttttttttaagggacagagtctaagtggcccgccaatcgag

SEQ ID NO: 651001 - DNA, 143 bp, Homo sapiens
agctcggtaccccgccgtgcagcagggcgaggcgctgctggcggcggtgcatgccgggcgacggcggtggcctggtggttgtcaagagcttggccgtcacggacctttttgtcgacatcaatgagcgatatacgcgagaagag

SEQ ID NO: 651002 - DNA, 208 bp, Homo sapiens
gtaaccatcccatggcttgaattgggaatgaaatcttctaaaatatcagaacagaaagctttttgttcaacatggaggacaaaagacggcgagcccgcgtacagggagcctgggctgctcctgccaagagccagcctactgcccagccaggtactgctgctaggaaccatctttcccagacaccagggcaggcctggaggacgaagcg

SEQ ID NO: 651003 - DNA, 175 bp, Homo sapiens
  misc_feature (58)..(59): n is a, c, g, or t
acagcggggctcaggtccgcgtgctctccgcaccaccccacttccattttgcaaccannccagcattgagggtgatgatggatctgtgtgtctggattgcctactatgagagctatgaggagctgcggggaagtactacagaggcagcagccaggtggtacagtgggtgagcttt

SEQ ID NO: 651004 - DNA, 116 bp, Homo sapiens
  misc_feature (33)..(33): n is a, c, g, or t
  misc_feature (101)..(101): n is a, c, g, or t
ccgatgggaggtggaagaggactggtgtctgtntgtcctccgctcctaccaggcagaacacgggcctgacttcccctggagcgtgggggaggacatgagtncagatggacggcggc

SEQ ID NO: 651005 - DNA, 824 bp, Homo sapiens
tctcgagttttattttatttttttggggcttaaggcacttgttgataatcaacaaacgtgtaagggtagggctcaagcctactccccaaacccgtttaactcctaacactggctcttcctctaacagatagacctgaacgtggcttcttttcaggcgtcctggtgttgggccccttcgtttgagaactccctttgctcccgtgctagcatcgggagttatggaagtctgacctcccctctagtagacagtattggtaggggctggttgtatagatcacttggggtggtggttgcgtcagatggcaccccgtggtggggggtctgcactttgacagccgccggagggcaagacactgtgagtggagtgaatgtgtggtagagcgagcttcgggttttcaccagttgaagagcttctttacatagtgcttgtgcacattatgaaacctccaggcaccattcctgtgggtgctacgttgtttgaagggttgtgacagccgacgccaagtgcagcaaggagtgaaggagaagccaggccagtgtagaaggcccagccataatttccaaacagtgtggtctccagtcttcgtggacccaagtttgacagtcgattggaagacttgtgaaataccttcatgttgggccaccactccccaggagaccgtgactgtgactgaggaaaccagcagaaaggcgcctcaatttgagcccaaaggcagtgttccccgggtatttgatgttgtagtagcggagaactgtataatgaatccgaataggacttggttcccggttaccgtgttttgccaaagccagtagggggggggggc

SEQ ID NO: 651006 - DNA, 321 bp, Homo sapiens
ggtatagccgaatatccgtaagtatagttctgttgaattagtaaactgaagattgtaggaaaatgagtgagcaaaagttgtttagtgtggtgaagtgtttcctacggcacgggtttaatcttggtgtttccaggtgtctgtactaatagatacatttctgtgcataagattataaagcatatactcacagttcagtagttttcgttaaggatttactgtgtgagtactttactgtgaggaatggcagaacctattcccctctactcttgtctaaaagttctgtgtggcacacagagatgcgacctacctatttcacaatcg

SEQ ID NO: 651007 - DNA, 646 bp, Homo sapiens
aggaaccccccgcaccactgcaattaacagcatttgcaacattctagggaatatccacagccatttatttttttctcaaatgcggaaatgtaattttacatcatttttcccctccatttcatatttatcaaaatattttcatgtcagtttcatttgaatcaataattcatcatatttttgtgatgaccgattactagccaagcaaaacaaacagagattaatggagttttactgtaagaaagaaaaagtaacaagataaccaatgattcgaagaaaatgtcagatttggaagcccttgtactctgtaatgtgttgttaaaaggaacatgctaaaaaagataattatatattttagtttagtacaaaaagccttggggagagaattaaagagagctaaaaattcagtaaaggctacaaaagttaactaagaaggcactcctgtttacaaacagcatgtgatgctgctaaaataaatgcaaaaccacacgtttctttcttaaccaatcagaagctttaatataaagaagcaagaaaaataaggctcagcaactcctatttgcatctctaccttaaaataaaattttttttatattcaacgaccaattcttatcattctggggaaaatacttatttagtgcatcagggg

SEQ ID NO: 651008 - DNA, 261 bp, Homo sapiens
  misc_feature (197)..(197): n is a, c, g, or t
accagtagctccttcctatcatcgactatttaactcacacacctagctcataacatctactactcactctcatgccaggaatatcaactctgagcaacactatatgactagctacacaatagctttatagtaaagatacctcgttacggactccacttatgactccctacatgccatgtcgaagcccccatcgctgngtcaatagtacttgctgcagtactctaaaaactaggcggctatggtataatacgcctcgtaaaa

SEQ ID NO: 651009 - DNA, 792 bp, Homo sapiens
tcgtgccgtatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaacttttggctgcacctaatacttgcactccagcttaaggatgtgtttcaaccccggcctttgtccccaataaatgtgccctga

SEQ ID NO: 651010 - DNA, 611 bp, Homo sapiens
gacaccgtcatgcattagacgcatttcccttggcagggattcgacgaagtgaccttactcccctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaacatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 651011 - DNA, 197 bp, Homo sapiens
aggggaattccggctctatagggagataattccgaagcctggtaggataagaatataaactatcaggtaaccgaaaaatcagaataggtagtaggtatagaatggggtctcctacctaccggcggggtcgaagaaggtggtgttgaggtagcggactagtaagtagtataagtgcatgccagcagctaaggcactgg

SEQ ID NO: 651012 - DNA, 636 bp, Homo sapiens
gccgggcgcagtggctcatgcctgtaatcctagcactttgggaggccgaggcgggcggatcacgaggtcaggagattgagaccatcctggctaacatggtgaaaccccgtctctactaaaaatacaaaaaaaattagccgggcatggtggcgggtgcctgtagtaccagctactcgggagactgaagcaggagaatggcatgaacctgggaggcggagcttgtagtgagccgagattgcgtcactgcactccagcctgggcgacagagtgagactgtctcaaaaaaaaaaaaaaaaaaaaaaaaaaaaaaaaaaaaaaaaaaaaaaaaaaaaaaaaaaaaaaaaaaaaaatagaaaaaaaaaaaaaaaaaaaaaattacgtccaaatttcagcctaatttggccaattagccttaaagggagccgtttgacaattaacttgctcgccttttacaacgtgctaattgggaaaacccctgtgttacccaatataaccgccttgaaggcaatccccctttgggccgtctgcctaaatggcgaaaaggcctggccggtggcactttccaacaattgaccacccaaaatttgaatggaaatttgaaggggttaaaattttgtctaaccgggtgttctttgt

SEQ ID NO: 651013 - DNA, 417 bp, Homo sapiens
  misc_feature (2)..(2): n is a, c, g, or t
gntgcatgcagagagagtgaaactgatcagacgaactacgaacccctgtgacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaatggccgaccggagtcacaatgacatccaatcccataacatggggacagatcaagaaaacgacacaagaagctgagaaactactggagcgccaggctcaggcaaaaacccctgactccatgttcttggccatgctagctgtagtgtcctgtgcgtctataggatcgggtgaagcaccaaccggcaattgaaagc

SEQ ID NO: 651014 - DNA, 1096 bp, Homo sapiens
ggataggtagctaccggtccggccggcgcgcgagctcggaggctcgccgataccagaggcgcacgcgatatctcgaggacccgacaagtacacgtcatacccgggagccagtacatcaggcagcatcgcactgtcgtacgtaatgctcactctcgtccatcggttgctccagagcgaccatcacggccaaagcattggctccgctaagcacctgcatacctgcatgtcatgcaatcgttgcaactggagcggagatcctcttcgggatgcctagggatgaactcgagtggcatcgggttccgcactgactatgaatcgcatggcataaactacgcagaccttgcctcatctatttggtttgtttccgtgcgccttcggaactttaaggccccatatggaaaaccgagcgtacgcaaacattcgcactcggcatacgggcccaaggtgctaaagcctgtctctgcgacttcccctgccggaggacctgatatttaggcaccgaaggaacttcagataacgccttatcataatttaacggctataaaacctagctccgtgtgaccatgtaacattagactacagctctagcgtgtgactttgcgtgtgcgcccgtgcccaatccgtggtgcgttgcatccaggcaacctgaacgtacgtaacatttcagagagcatagcgagaccatgcgtgggtccacaacgtaaccaccacgttgcatactgtggaacgacctggatagcccgttaggcgttctaaaaccccttggccattggctgtgcccttttcccctcctgcaaacggtgttaacaaacgtgtcccaaaacacaaaaccgaccctccgagtgactaggcccccctaggacacaaacggactcagacaagctagcagaccaatcggtgggtaaacgccccagccaagacaccgttagagcggccttgaatcagcttgttagaatccgcccacaggagaactgccacacctcgacctttgattcgctatacgttaggtaatattccaaagaaaaacataagcagcctttctgcagggcaagggactttgggcccggggcaccatcgcgcagtaccttcgaaaggc

SEQ ID NO: 651015 - DNA, 401 bp, Homo sapiens
actatgagtgtctctgctctaagcccaacccgatttgcagacagcctctctggcttcctccaagtggcctctgtgctcggtctgctcctgctgctggtgaaagctgtccagttctacctccacaggcaatggctactcaaggctttccagcagttcccatcacctccttttcactggttctttgggcatgagaagttcaaaggtgaccaagaactacaggaaattgtgtcgtgcatagagaacttcccaagtgcctttcctagatggttctggggaagcaaggcctacttaactgtctatgaccctgactacatgaaagtgattctggggcgatcagatccaaaggctaatggtgcgtacagattgctagctccttggattgggtatggtttgctcttgtt

SEQ ID NO: 651016 - DNA, 823 bp, Homo sapiens
cggtgcgcagaccaagagtcgtttaggccgcgcgagggtccctcttggtaaccccacccaacgaagagtggctcaaggaggggaaacccatagggaattgcgagcaaccattgcggggcccaaaaactgaacaagtgtgcccccccggcccgcgaaagtcgcccccctgaagcgtagccgacggcttgttctttcaaggtgaaacgcatatctctggagacacctggttgcagaaccgaccagaagttggcaaatcgattggcaacttcgaggcacgcccactcgattattctttcgcccaaacactgtacttttaaatgtcgctgcggcgtcaaaaagacaaagacttcttgctataacagagtaaaaagctgaagccactcgtggaacacacccagttaggtgtgcccccacataatatttagagaacgattgtatctcacaacgatctctgtattaactaggccactcactaccactcgttgtaaacaacgtgtagccacaaaatttgtcggcatccaccagcggtatttgtggggggatatctcgtttgatttacgggggatctctatgtaacatctttcttgacaaagccggcgctattagcggtgcagggagtaccccgcagtgatatctatttgagacaccccaccccgtgtctagataacctgcatctgttgattttcaaaagtggacaacccctgcgccacgcacttttaacggaaggccgtcgtaataccaggacgcggtccccctaacatcctttcactaaggagaaaacaggcagcaggaaaaagggtaaaaaaaaaacacccacataaca

SEQ ID NO: 651017 - DNA, 114 bp, Homo sapiens
cctctactcgcctgtggtcgtgcagagcaagcgcgtcgcggtacttgacgggctagggcaagatctaccactcatcggttccgttcgtggtcttcagtaacatcaccgtcgtag

SEQ ID NO: 651018 - DNA, 147 bp, Homo sapiens
tactatgagatgtagccgattcatatgctcatactctacagcatatatgccatatttcatgtctcctcggactccaggtgtggctgtcaaaggtgagcttctcacctcccgatggagtttagcaaggtccttccggatagtttcgaa

SEQ ID NO: 651019 - DNA, 432 bp, Homo sapiens
gtgcgattagtgtgtgggaggaatggggtgggttttgtatgttccaactggcatatttatattttacgttgttagatattgggagtagtgtgagtgaggtggagtagaataggcgtaagtagaagtataggttaaggagggtgatggtggctatgatggtggggatgattgaggctattgttttttgggaattcttcgataattgtggcccttttgggccaaaagccggttagcgggggcaggcctcctagggagaggggggggtggattgggattaaggggtgttagtcatgttagcttttttcagggtgcgagatagtagtaggggtcgtggtgctggagtttaaagttgagtagtaggaatgcggtagtagttaggataatataaatagttcaattaaggaatgggactgttaggctatcaaaagacga

SEQ ID NO: 651020 - DNA, 255 bp, Homo sapiens
ggtaagagcggtctgatcgcaactatgagaccagaagaccaatctaggttcatattttgggcagaagcaatacttcaggaaaaaagagaaagaggaggcaaaagaggacagagaaaatgaccagtcacaaagacaggagaaaaatacaaaaatacagtacactgttccaaccatgaatattcatgagcttaaggagaaggtttttacctatcttgaattaataagacaagccgaaaataacactggggaaaacct

SEQ ID NO: 651021 - DNA, 218 bp, Homo sapiens
cgggtcagagcctgaactatgaaagaataatagctgagtcaccatggtgtaactatacaatcggactagggtagaatcctgatcaagtcctcaactcctatttgacacacaagttaaaaaattttaaaactaaatttacatgtgatgttttgagcatcacacagctactatctaaaaggattcagtctcccagagttcttggatctaaatgcactcca

SEQ ID NO: 651022 - DNA, 140 bp, Homo sapiens
ctacagcacacgcatcccccctagtgatagggataagaaattatcttccaaaaaatcatgcttcatacattgcatagtgagctatacaatatatactaccccccagagatagtacaggtccttcgataatgtaagagata

SEQ ID NO: 651023 - DNA, 245 bp, Homo sapiens
ccgccacatgggaaacccatctctactaaaaatacaaaatttagctgggcatgtgattatgttgcaggaaggttgcagtgagccgagatggcagcagtaccgtccagctttggctcggcatcagagggagaccgtggaaggagaccgtggagagagagggagacgagagggagagggagagggagagctgtttcacagtttttgatgattgtgaataacgctgcctatgttgcagtgtgcttccg

SEQ ID NO: 651024 - DNA, 1218 bp, Homo sapiens
cacaccacaaatacgatagactacgtgcgggggggtaaaccgccgctgtgggacgccacatggtccccccaagggggagaccgcccagtgcacgcaataacgccactaggcccgagggggccgcacgcgggtagcaacgaggtccgccgaccgctaggaaaacagcttgcagcgtgtttgtagtaactaaccccctctaatgggcagcccataggaaccaccgggcacgacacaaagatggggggctccacagcaaatcctgcgtatggcggccccccacagggcttatatcattgtaatgaaccaattcgtggcgattgccaagtccccatggcgtgtgattgtactttgaattggtgtaagagaaatccttggcggcgccaagttattcagggaaggagtgtctggcgtccggtcgggtttgcgggggttactcttgaggacagcgtctaggacagcagccacagcaaagcccagtgaaggtctcccccacacccatgctttgaggtcgcacccgtgagtgtcccaaccccgggggagtcgatagtggcctccaaaacagtctgtcgcaaggtagagacctgaggtgccccgttgagccccttcccgggggcaattgcggccagagtcgccccagccacacagaatgcccccaggtgcccccagtgaatgtccccccggcaaaattgtctcgccccttctgaaggcgcaaattggaagaatgagggaatcttgttaaatctctccaccgtgctttgagaatgtcttgccccctcttatcccccacgagggaaatttacacgaaaacttggccctcgggcctcgtgtcccccactggctaagggccgcgaaggggttcttttccctttctttcttttcctacctaacccctctgtttctctctggccacggggcctcgtattcctaccctttccttgtcccctgggctggctgcacacacagaaggattcgccccttgctcttttcacagagagctggcccctcgagatgccacaaattatgcaatttaagtaattttgcacacaagtctaagggaccactggctgcctgccttggggaggaaccatatctccctctgggccgcttctggcctcttggagccacatgggcccaaggccaaaggggaatgggcacagaaggtctgtgtttggtctggcccagttccccatcattaaactcagcctgactgctgcccta

SEQ ID NO: 651025 - DNA, 224 bp, Homo sapiens
gtcctcatttgtgccctcttatagactggctgggctgggggtactggtggacaaagaagctggggcgagagaccaggacacagggataccccatggtccccttcctctggctgtcccctggtggggtcactttggatccttggtgggagcatagcacagctccagtggccgggacaccttccagaatttctcattcaccagctccagggtcagcgagccattca

SEQ ID NO: 651026 - DNA, 463 bp, Homo sapiens
agcagggacactgtttgtctatgtcaagaacaaagacaggcaaagaaatgtcgatgccgcatttacaaatgcaagaatggacttgtatttgatatagcttattcccaacaaataagggaccatgagtcatttggggcatgttacagagagtttcagtaaaaattcagacaacaataataaatatgaacaggcacagcatgcccagaagcctttttatggagccaggcatggttgacctgctttccatgtctcaaaacattagtccctacaagaatcctatgaggtttatcttcttttcacccattttgagagaagaaaagttcagctcagagagctgcaggaacattggggacatctccaagtcacagccaataggtggcagtcatcagtgtgtcttggaagggacaaaacattgagcttctgaacagctactccagaaactatggtgctgtggtgaagtcct

SEQ ID NO: 651027 - DNA, 1907 bp, Homo sapiens
  misc_feature (1062)..(1062): n is a, c, g, or t
gttaggtgttccttgtccgaagagagcaacgcatgattgtttcttctattagttaagacggggtttgtgagggcgctccactcgagtgtgaagcttcgttatatctatagccggcgtcactcaatctacagagccacaccatattatatggtgcgataaacatacattgatgtcgccccaatcaccattgtggtcgccccactaagtcccgtcgatcgccctctgtttggtgagaacacacattcttgccccctctgtgggattgtacatactggagattctggtggtaagggagacgttcttataatacttacgttcctttgagtagtagggtcagagccttgctttcgtcctacacttggctcgtttttgtgtgccacctcaaaaaaaaaaaacggtggggggggtagtagaaactattttgtgggggggtggagacaaaaaaatttcgtcgtaggccgccacttcggcaaggttagggtatgacagtaatatgggatcccttctggtggctgttataccgcccttattagaatgtggctcccgcttgtcccccctccttcgggtgaacgaaaagttgggccacacacaaatttttcggatatacacctacaacgggggtatgttcttccgatgaggggaaattgtgtttgccaacaacggggagaaaactatctgtcggagcactgtattttgttagtacgcacaatagactacatcatggtgtaaacaacctctcgctctttgtgtggaagaagattttataatgattatatttggtagaagacgcccccctttctcttgtatgtctgacacgtgcggggccacccccgcaccagaggttgattgaagagcgaatatattgcataacagactcctagctgcgaagacttcttcctcctcatcctgcggggccgtcttcttgtttcgagatgattggcttgccgatgtggtggatcctcattgggattggtgcaatcatcattaatgcagaagagggtggatatcaactatgatcggcgccacactcaaggtcgttcgtcacaaaataggtggtgcgcnacaccagcatcttcgggggcagcagagagcgctccacatgcagcatcatcttcggcgtagaacaacacaagcagcgcaccgcctcagccacactagcgtcttctgcaccaacttcacacgcggctgctgctcgtcacaacggcacacaacgccacacagcgcagagagaaaccactggggagatctttcaacacagcgtgctctatatgaggagacacaacacactcttggcgcactcatagacacacgcgcctatacacaatgtggcgcacaccacacggcggctctctcccctgctctctcatcatcagtagagtagtatattcgcgcacacgcgcccacacatgtctcctcacgcgcacacaccacagcgggtgtttctacacacagcacacactctctctctcggaagagggtgaataactctccctgttgaggtagagggtctgtcacacacacagagacacaccgagagagtgtccacacaacaggtactactacgcgaacttgcgcagactctctcttatagacgtcccacatagcgatatatctccacactttcctggggcgcactctcctattgttcacacctatctccgctcagcatcgttctcatagacccacttctggacatgaagtcttcccgacacccctctttctggattgacaagcggcacagtgaccacacccacgctggtcacgaacttctgaatgttcgggtaacctggccttctgtgggcgactctcgtaaaccaccccgaggcgctctgtactagagacctgcttttaaaaataacggtgaataatggttgcgaccaaaacaaaataaaaaaaaacctcagact

SEQ ID NO: 651028 - DNA, 856 bp, Homo sapiens
tcccatctctacaaaaaattagccgagcatggtgttgggtgcctgtggtcccagctactcaggaggctgaggtgggaggatcacttgagctcgggaggttgaggctgcagtgagtcaagattgtgccactgcattccagcatgggtgacagagtgagaccctgtctcaaaaaaaagaaaagaaaaaagtaagactaaaatcagttagtgacaaaacttatgtattacagcatcttgacttaaaaaaaaaaaaaccaaaacccttcattttccgagtttttcataagccaggtattttcttaaattggaagtcttagaaacttaggttatttgggctcgctagctgtatgtgtagagtgaacaatagtatttctacattgggtcagtgtgcataatgttactataccttgtgatccatctggaatttatctgggtatgcagtgtgaagcaagcatcggattctgcttttttctaggtgactacccagttgtcccatgactgattttaaaaagcagtttattatataccaaatgtttatattggggtattcagggattctacttgttccactaaatccgttttggtccagatacgacacggctttcagctaatgttcctcctagtattttaaatatttggtgggctagcttccatttccttgggagaattgcctttggcgcgggcaaaggatatcctttcgggttggaggggaaattggctgttccccggcggggggaggggtgggcctggggcctggcgccggtaagatgtctccgcccctgggggtgatacgcgcccctgttttgcgggcgtcggggggtccggtgtgtacccccgggggggcgggtttaagtaag

SEQ ID NO: 651029 - DNA, 861 bp, Homo sapiens
gagacaggtagagtcagcctccacatttcacgaggcatcataagtaatggcaatcaattggctttgggatggacgtgcagaaaatagtgtcatggagttcaacaactcgatagacgagagcttatgtatgaggataagcgtctgtaggggcaaaggtttatatactatcgcgtcatgtgttgtccttccgttagcactaatgggaatgaagaatagataatatcagaagaggaagggaggcaatgggtgtgactgggtgatgacctcatcacgaggactatctggagagctgcatagaggattgcatgccatggtaggtcggaactataggagtgcaatgtcgtcatgactgtatctttatagatgtcatagatatagtgcagagaagatatgttcttgtgagcattgtatacaatatagctccccataatagtagtaaagatctagttgactagataatgcgctagatggagaatgttaggagatggctatactgatacaactgtggtcatgactgaggaaaggagctcacgccctagagactgggcatgttctcgccggaggccaatgtccaagaagggtctggcgagatagtcaggcgtcagggcagacgtctgacccatgctgcaagactactggagtgtgacacaggctgacatagaagtctcctttgaggaacagagggggtcctcaagaacattcttgtcgtaccctattagcttcctcattgatctgatgaactattggaggggggggaaaaggttataggggaggaaaggtgggactaagcgatggtatgtaataacataagataaccttaaaggttggtgaacaagtacataaaggtgggacaagaaaggc

SEQ ID NO: 651030 - DNA, 128 bp, Homo sapiens
atccagatttcttaaatttggccaagttataatagagagcagtagcttgagacccgaagtcaggaaactttgacaatatgattttgcttgggttaatccagacactcatagcggaatatgccttaccc

SEQ ID NO: 651031 - DNA, 197 bp, Homo sapiens
acgatccccgtcatgaaaccctggtcatcaaccctcatcgaaacccttctcaaaccctcatcaaacccgtcatcgttaaaccctgcttcttggttgggtgttgggttattatactaagttgtatgatgatctcatttactggggtgcaaggcgcttctgtgtaagttacgcccttattttctcttgttccgtttcgt

SEQ ID NO: 651032 - DNA, 252 bp, Homo sapiens
tatgacttctagcaagcctcgctaaactcgccttagcccccactattaaccaacggggaaaacactctgtgcgagaaaccatttactcctgttcatatatcactctcctacttacaggactcaacatagtagtcacagttgtatcctgcctcgacttgtttagcacaagacaatgttgctccctcggccaccatataatcatacatagcaaccttcatacacacgaaaaagacacccgtatgtgcatatatt

SEQ ID NO: 651033 - DNA, 362 bp, Homo sapiens
agcctggcgcctaggaaccagacccgaaaccaaggaaccagacctgaaaccaggcctgggcctgcctgacctaagcctggtagttaaaattccacccttgacctagcaactgatgttatctatagattatagaaagacattgtaaaacttcccggtctgttctgtttcactctaaccaccggtgcatgcagcccctgtcacgtacccctgtttgctcagtcgatcacgaccctctcacacggacccccccttagagttgtgagcccttaaaagggacaggaattgctcactcagggagctcggattttaagacactagcctgctgatgctcccagctgattaaagccactcccttcactaaa

SEQ ID NO: 651034 - DNA, 446 bp, Homo sapiens
gattctagaggatccctgagggtgaccttcgggggagtgacgaaaaaggatagttctaccacttactggattgtggggtaagcaacaagagagttatataggcaaatccgtatagcataatcttgagttgtgatgcatagtgaagacttcggtcgagtaacgaattgaatgatttcatgtttccaagaaaagcttctagtgttaattttttatcaacctgtaccgagaacgaacacacgttcccaagatgagtattctaaggcgagcgagaaaaccaatgttaaggaactctgcaaaataaccccgtaagttcgcgagaaggggcgcctatttttaataggccacagaaaatagggggggcaactgtttatcaaaaacacagctctctgctaagttgtaaaacgacgtatagagggtgaagcctgcccagtgcccgaaggtcaacc

SEQ ID NO: 651035 - DNA, 315 bp, Homo sapiens
  misc_feature (103)..(103): n is a, c, g, or t
gatttggcaaatatttgggtgagatttgaaaataaattacaccactgctgcacaagttaatgtgaatcaagcatctgtttatttcattcagtttatgcctttntttctttttttgtgcagtgcagttggggtcacagactctcaatttgacaagacactttaaaagcaggagtagaaattaggctagggttttacaactattacaggaactgtcataacaaacttcaagtggatcagtttatttctgatttaacttggggataaacagtgttcaatattttccaaaagattctccccatatagaagtcccaaaag

SEQ ID NO: 651036 - DNA, 397 bp, Homo sapiens
ttgtgtagaggagaagatagacagttacatcaagaacagctttgctgacttttatatgtttcagaactaacttaagtgactacattccgtcttatggctgcagtgaaaggtgtgttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatccagtacttagaatcactagttcaaactca

SEQ ID NO: 651037 - DNA, 473 bp, Homo sapiens
attcacattcaccaatcagattcatttttatcatctcctattcctcatgagaaatacatttttttataaccttttaccttgaattcaaatccatttttcctctgaagcacctgaggtgaggtgggtatctcctcttgtcctaatcttatccacatgccatgatatggtttgtctgtgtccctacccaaatctcatcttgaatcatagctcctgtaatccccatgtgttgtgggaagaacctggtgggaggtaattgaatcagaggggtgggtttttcccatgctgttcttgtgataatgaataagtttcatgagatctgatggttttataaaggcgagttcccctgcaaaatgctctctttcctgccaccatgtaagatgtgactttgcttctcctttgcttccaccatgattgtgagtcctccccagccatgtggaactgtgagtcaattaaacctctttcctttataaatt

SEQ ID NO: 651038 - DNA, 243 bp, Homo sapiens
cccaggttggagtacaatggtgtgatattggcccactgcaagctcttctcccagggttcaagtgattaacccacctcagcctcccgtgtagccgggaccacaggtgcaccccaccatacccagctaatttttatatttgtagtagagacagggtttcgccatgtcggccaggctgatctccaacccctgtcctcaagtgatccacccgcgtcaggctcccaaagtgctgggattacaggcgtg

SEQ ID NO: 651039 - DNA, 908 bp, Homo sapiens
  misc_feature (16)..(16): n is a, c, g, or t
  misc_feature (26)..(26): n is a, c, g, or t
  misc_feature (181)..(181): n is a, c, g, or t
  misc_feature (234)..(234): n is a, c, g, or t
  misc_feature (250)..(250): n is a, c, g, or t
  misc_feature (309)..(309): n is a, c, g, or t
  misc_feature (342)..(342): n is a, c, g, or t
  misc_feature (383)..(383): n is a, c, g, or t
  misc_feature (395)..(395): n is a, c, g, or t
  misc_feature (417)..(417): n is a, c, g, or t
  misc_feature (433)..(433): n is a, c, g, or t
  misc_feature (470)..(470): n is a, c, g, or t
  misc_feature (483)..(483): n is a, c, g, or t
  misc_feature (493)..(493): n is a, c, g, or t
  misc_feature (531)..(531): n is a, c, g, or t
  misc_feature (544)..(544): n is a, c, g, or t
  misc_feature (550)..(550): n is a, c, g, or t
  misc_feature (557)..(557): n is a, c, g, or t
gggaacgaagggcggngatgtcaggnctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccanaaagtctgttctggtgtcggtgtcagaggtcaaagcggtggctgaaatgcagnttggggaactccttgnctgctgtgaggaaggcccaggccatagtgtgatgctcttcttagaggagaaggagcaangctgcgctgagccaggccaacggtatcaaggcnccacctggagtacaggagtgccgagatggagaagagcacgncaggagctggangaggatggcggccatcagcgancactgtccagttcttnggaggagtactgcaagtttaatgaacactgaagacantcacccttccctnagtgtttacngtagggcttgaaggataaacgtctcgggcatccgcaancgttatcacgganatccancggtacncgttaatccagttgctggagaactataagaaaaagctccaggagtttgccaaggaagaggagtatgacatcagaactcaagtgtctggcgttgttcacgcgcagaatatggacttccatgagctgagtcccagcaccagggaacagttcctccaagtatgcgtatgacaatcacagtttggaccctgggacacacatgacaacaaggtatcttcacgggctgccaggagggagaaaccgctaggtccaccaaacaaaccacgcccctgggaagcattcctaacccggaacttccccagcggggttccttgcagtggcgggcaggtgtgttgcccagccaaagttggtaccg

SEQ ID NO: 651040 - DNA, 103 bp, Homo sapiens
ggtaccggcgatctgcgggcgcggcggcggcaggcgccgtcagcgcgcgagcttgccgctcgcgatctgcttcgccagctcgccgggatcgggcaatgtcgag

SEQ ID NO: 651041 - DNA, 395 bp, Homo sapiens
gatttcccaagacaccctcctctctccctaagcaagctaggtgatctgtgaaaatggttcgctattcaccttgacccggagaaccccacgaaatcatgcaaatcaagaggttccaatcttcgtgtacactttaagaacactcgtgaaactgctcaggccatcaagggtatgcatatacgaaaagccacgaagtatctgaaaagatgtcactttacagaaacagtgtgtacccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatagtagattctctggt

SEQ ID NO: 651042 - DNA, 264 bp, Homo sapiens
ggctgtttgaggatccaactcagggcgagctgcagcggaaggttagggataaagtcagcccccggagtcctccaggcagcggggtgggctgaagtccagctcatcaccatcatctagccaggctgagtgtacggtgtgagggagacccatgagagtgcccccatgcccagcgtgctgagtgactcagaaggaggaacgaggaggactcacgaggaggaggactcggcagctcgccccttgaggggtacctgagctcgaacttcg

SEQ ID NO: 651043 - DNA, 321 bp, Homo sapiens
tcactcaggctggaatgcagtggcatggtctcagctcactgcaacctccacttcccaggttcaagtgattctcgtgcctcagcctcctgagtagctgggactacaggcatatgccaccacacccagctaattttcatatttttaatagacacggggcttcaccatgttgctcaggctgatctcaaactcctgacctcaagtgatccacctgcctcagcctcccaaagtgctgagattacaggtgtgagccactgtgcctggcccattacctacattttgagtggtattttctgtgttcctaaggtcgacgcggccggcaat

SEQ ID NO: 651044 - DNA, 337 bp, Homo sapiens
actaagagcacatttaacacgtctcaccataaaaaaacactaggtaagtgaaggggttggctttgcctaactggcttcatttgaaaatcctacattgtaatgcatatattaaaacatccattgcatccataaagaaatacagtgaggatttggtccaatcaaaaataataataaaaaatttaaagaagaattgtatagcaaaggaacacctttcaggattgagaaaactctgtgaagaaggcacctagaaattctccaagaagtggcacctgtgtactgaaaacccctttaatggacttttgtggagctataggtgattcatacaagttcagacaaa

SEQ ID NO: 651045 - DNA, 330 bp, Homo sapiens
cctagaggatcccgtccactgtgcgatgaaagcatccttcatcgagtcttacagcatatgtaaagtaggacttactagggtcacaaagcacaagaataatatacaactggccaagggagctatgagataaataatcaggagagaatctattcatgcactagtttgatacagctaaattctttacagtacacaaaacccattaataatgtagtatagagaccaaaatgtaaagagagatagaatacattactgatgtgtggattaattcaagttcaggcatctacttgtgttacagcacagctgtcaaaaggcgataatgagtaaatcata

SEQ ID NO: 651046 - DNA, 224 bp, Homo sapiens
cttttggggtctttgctacttaaagtgacggacgggcgccaccaggcggggggcctgcctgttacttagaccgaccacgcacgacctaactcacccggcacgcgcacaggctggacagactgatagctctctctcgatcccgtccgcgagagtgcatgcacgttcttagttagtggagcgagctgtctggctgattccgaccgctaacgagcctgactcatgct

SEQ ID NO: 651047 - DNA, 175 bp, Homo sapiens
  misc_feature (46)..(46): n is a, c, g, or t
gagactatagcaagcagtaccttggtggcttactggggtgcacagntggggcgcacttccaacggaaaaatattcaggtaacgaggaatagcagagaaaggtgagtatatggtgagaaggcagctgtctgtgaaccagaaggagggccctcaccaagaagtgaccatgctggcac

SEQ ID NO: 651048 - DNA, 155 bp, Homo sapiens
cacgatccccatatacctaacatactatcccaagaatggtacactaaagaatctttgaaacaaaatttcaggtaatgaatttttaaaagttttattctttgtttttttccccgagacggaatcgtcgactcttgtcccaggtcggagtgtggtgt

SEQ ID NO: 651049 - DNA, 1054 bp, Homo sapiens
actcgtggcggatgggctagggcatgtgcaatctcaatggagtttgtgctgtctcttgtagagatcaaaccatgttgcgatcagtactagatgtgagtctccttaattcgtacgtgtacaggacagctcatcggcggcctcgtgaagcacccagatgtagggagacgctgagacgcgcgcaataactactggctgtgctattcagaaaggggttcagccaggcgaggcagacggacatccgtcgtgaccatgagtgtggcagtggtgtggtcgttcgtcgtgcctcacttctgagcaaaggctaagtgagctacggctagaggggttggcgaggtagacgatagtgtcgatctacatgtcgtgtaacaccggcgtttttgaagtggcagcaggagtgtcggtagatcatcgtagcagtcgatgattgtaagtcaaggaattttggaacggagatgtatcacctggagatagtggcgttgtatgagatacgaattgagatgggatatgtcgacgcgcgtgaattacgtatcgacttacgacgcagctgtcgtgtattcaaagagacttgagccttggattacttggaggtgtcattagagtgatgtagaccatggatagaattgaataggcttttgtgttgacgaggttattgtttaagcgtgttaagagttggtgacttcgtgattgaggtttggctgagtgaactaggatgaggtggttaaaagttgtctcatgggtatactgttggactagtagggggtcgtagtgcgataaatagggctgtcagtggtcaggttgtgcccgagattaggaaggccaatgagattcgtagttgtgaaaggggtgtactgtcgtaagtaaccccaggtccgtgtatgggctaaatggagtagatcatctaattgactaatgagattcgagttggttaagatgttgtggaattataaggagtctcctttagtggggtgtaatgtggtttgggggatttggaatttcaagtaaagaataagggtgaaagttcttaatcaaggaggaatgtgtggcatattgttgg

SEQ ID NO: 651050 - DNA, 103 bp, Homo sapiens
cacgtgaatggacttatttacttaatccatcaacctctcatagcacatatttgagaaaacaaatttatattcagattcttatctacacgtagggaagtaagaa

SEQ ID NO: 651051 - DNA, 449 bp, Homo sapiens
  misc_feature (19)..(19): n is a, c, g, or t
  misc_feature (24)..(24): n is a, c, g, or t
  misc_feature (217)..(217): n is a, c, g, or t
cacttcatagaaaatcctnttttngcttttcctttggagacagagttttggtagctcctaccagcctccaaattctcttatgtagctgaagatgaccttgactacctgagtttcctgtctcttacttcttttcagcttctgggaccacaggcctgtaccaccatggccagctttagagagtaaaacattttaatttgttcttgatttgtatgatgtngggggcgttagcattacgtgttgaatattttgagtaagaagaaaagaatccatcttcagaatatagggttgttctttgggaaaaagagtataagaacataatttctttgtcctagactttacaaatttttcaaaactgtaactttattttaaacttgtgtatcacaacttggttgatatgcctaaaatgatctactggcttttgcttatgattaaaaaacctcaaatctatc

SEQ ID NO: 651052 - DNA, 968 bp, Homo sapiens
gctccacttactaccagacaacttagccaaaccatgtacccaaataaagtataggcgatagaaattgaaaactggggcagatagatataagtaccgcaagaggagagatgaagataattataaccagagcataatatagctaggactaatcgctataacttctgcataatgaattaactgagaacataacttggctaaggaggagcccaaaaggcgtaacggacccccgagaaccagacgagcgtacctaagaacagctgaaagagcacgacccgtctatgtagcaaaatagtgggaagatttatacggtagaggcgactgaactcgtactcgagtcctggtgatatgctgggttgtccagggatagaatcgtagttcaagtttaaatttggccagagaacctcgaaatccccttggtaaatttaaccatgtccagtccaaagaggaacaggtctgtggacgacgtaggaaaaaatcttgtagcagagagtaccaaaatttgagacagccatagtagggctaaaagcagcgaagccacgtcaagaacacgggttcaagctcaatggcccactagctaaagagatcgcgaaagatatatagtgaagctcctcagagccaataggacgatctatcaacctatagaaagaactaatcgtgagtagcaagtcacatgaaaacattctcctccggataagcctgggtcaaaattgaaaacagtggcgtgaggattaagatgggcaatagggtaagatcaagcaagcaagtcgttattagcctcagtgtcagacccaagcacaggggtgctcataaagagggtcaaaaaaggaacggagcgcgggaatctaccccgctgttacaaaaatcacctcagataccaggttaaggacgctggccgagaacatgtaaaggggcgggccacggggaagggcagacatcgcataaaaggacggagaaggccaagggaggct

SEQ ID NO: 651053 - DNA, 1429 bp, Homo sapiens
  misc_feature (291)..(291): n is a, c, g, or t
  misc_feature (381)..(381): n is a, c, g, or t
  misc_feature (959)..(959): n is a, c, g, or t
agcggcatgagacataatctcctggtgtgcgcatttgctaagactgttggaaaagcacagtaattatgggtgggagtgtctcgatttttccaggtaccgcatcatgtgcgatgggcttcgccgttgggttaggaaatgggaatttccgccaaagcccttgtgcttcctggcgtgaggtgatgcccctaccgtgctctgtgtggctgcacccaccgtctgacaagaccacagtgaggtgaacccggtacctcacgtttggaaaatgcaggaagatcagtccagtcattctgntggtagcgtcaacatcatgggaaagcttgcatgatcatggaagctactatccttatttccggcacaatcttggagaaccgtcccccttgnttcataggtgtttatgttatgcatgggttgctttggtttttattctatttttcaatattcttgtggggggagagagtggggtgcaaaatcgtggggttaattaaggtgcgagggagaagtgcacagtgtgtcttgtgtgaatctggaagagaatctcaagtctaaatgtgtttattgaaacgctatttcccgaggcgtagcaaaagtgagaaaatctttttcgcatgatcttaaaacatgtctgggtgtaggtatatgcagtgcagagagtcataaagagaggtggtcacgtgtgcaacaaatgggcgatgttgtataatatgggggcaatataagtcccatgtactttctaatctcttttcgcagcatgtgtccaattattgttcgagagggtttagacataaataattacttttttctgtggcccagatgggtttgagccacgcaagagtgcggggtgtttgtgtcaaaaacaaggcacccttccgaggggtgccactgccaagagaaggtagagtgcgccagccaacgtcatgtgcgcgctggttagggagggcacctcgcaccaccagaggaangttgtcctgggggggttaatttttaaagcagccgggggtgtctgtgtttacaatcggcgcgcacatctgtaggtaatctcctccaaggcacgacaaaaagaggcgggcggggataactatatccacagcgaaagggagcgtttttcactcccacacaacattgtcttccccgatcaggaaaagcagcggaagttcttctcgcgaaactccatttgtcgtcgtgcccacacaagcgggcctgttcttaacggtactccacgagggacagtaattctaaacatcccatactcgccagcgccgggttgttcacccacgtttttgtacatctttccacaatacgaatgaccacacagaaaaagagcaaatcctctctcttccgcccggtggcgctgtgtaaacacccttcgcaggcacccactatgagggggacgcgcgtgatactcaccacgtgaaacagagaggcggggaga

SEQ ID NO: 651054 - DNA, 799 bp, Homo sapiens
taaaaaaagggtctttatggggtcggcccccccatcctgtgattttgtagacaagggtgttttgggggtaaggcgggtaagagtggggtctcccacgcccgaggttgggtgcaaatcaaaagttgggtgcaaacatgttcaaaaaaaaaaacaaaaaaaaaaaaaaaacaaaaaccaacaacaaaaacaacaaacaaaaaaacaaaacaacaaacacaaacaacaaaacacaaacaaaacaaacaaacaacaaaacacacaacaacagacatcacacacgacaacacacacacagcagacgacgcagacctcacaagacaaacaggaacggagagaacaaaaccacggacagcgagcaggcacgaccgcaagaaggagcggaggcagtcggaaccacacacaatagcatgaggacacatggacaaacacaccgatcccgccgacgcacagaatcccgcaacaagcacgaacgagaagcagaacgatgcagagaaaaagtacacgatcaccatcacagcagacgcacacgaacacaacaagagacgtcgggcacgcaacagacgcgaccagacgacagacaaaacaacacgatcagtaatcccgcagacctcacgagaagcagcaagaaagacacacaaaccaacaggcgagagcaccaccgatgcgacacaaaaacaacagatcacaacacgaccgccgacgacaacagctccacaccaaccaagcacacataacgaagcgacaagaacaactcacaccgaaggcgcacaagcacacaacaccacaaaagacagaaaaa

SEQ ID NO: 651055 - DNA, 210 bp, Homo sapiens
ttcatgtcaggcctttcatccgggtaaggcgagagtgcctaagacagaaatcgggaaagaactagccaaaatgtacaagagcacaccggatgtcatcatggtattgggattcagaactcattttggtggtggcaagacaactggcttgggcatgaaggccctcgacatgaagtcccccttcaggaagggatgagagcactcgaccatgaa

SEQ ID NO: 651056 - DNA, 260 bp, Homo sapiens
gaagaggtcttgagacactgatgctagctacaaagcgtgactagtctactcgaaagacacataaggatccacctctaatgaacaaactctcgagatgaaggcacgcattctgcattactctgacctttgtagcagaccttctggtctggcagtagtgaattgctctgaagtgacttcaaatggccatagataagagctgtaggtctatcatgttcacaaaataaactagccattgatgtcatagaaaccaatctcccggg

SEQ ID NO: 651057 - DNA, 457 bp, Homo sapiens
gttgctgtcttcaatctagagctcttgctcatcacgcccagaaaaagcagacagcctggagcccatggggtgagttgcaaaagctccctcctccagcccttcctcctggccagctcatggccaccattgatggggacagtgaggaacgctagcatttacactggacaacctttgcttcgttgaatctgcagagcagcctgtgagatttgcacccctcgatgttcccattttccgaatgaggaaactgaggcagagaggttaggtgagctgcccaatctaaaatgaaagaggattttgactcagtgactcccaaggccacactattaacagccatcttggccgggcacagcggcttgcacctgtaattccagcgctttgggaggccaaggcaagaggatcagcagtccaggagtttgagaccagcctaagcaacatagttagactttgtctctattta

SEQ ID NO: 651058 - DNA, 486 bp, Homo sapiens
tgaatgtgcactacccctctctgagccctgctgtctttagagcaggagtgacactgtctgcccagcctagtgccctggtgcttgaggattagaattagacaataagggttgtcaccacaaccagacgctatctagaggaagcaaatgaatggctcctgcagtgacagcatccagcctctgaagacagatgtttctgaattcttccccctcccccactccaaggctaaactttagggtaattcttgtgctccaaccaatcaagaagtggcgttaattcagcctgggcaacatggcaaaccccatctctacaaaaaataaaataaaatcagcccggcacagtggctcacccatgtagacccagccacttgggaggccaaggtgggaggatcgattgagcccaggaggtcaaggtgcagtgagctgtgatggtgtcactgcactccagcctgggcaacagagcgagaccctgtcttaaaaaataataat

SEQ ID NO: 651059 - DNA, 1414 bp, Homo sapiens
cactgatcttacactcacaataccctaggctcactaaacatgtctactactcacgtcgttccactgtgcccacaggacctctcatctgagactctctgatgccaacaactgaatatgtacttagtcgttacactatgtagcatgctatagtaagaggataccgtcgtattatgcgagcatcagaccttatgcatgtccactgaaagggcccgactgatcgaaagactccgcgccatcggcatcgggagtccaccatttacgctatcgtcttgccgcgggcgaggataaacttacttgtaatagacatcgtcacgagcagaggcgtggagtagcgcttgtgagaggtgatcggtcccttgcgagccatcgtccaagtatcgttccaaattcctccccatgttaaccaaaataactactaattaggccaataacacacacctttactcgtttgcttaaccttattctcccattttatacgtagaagttatataacttatatatgcacaccaatagctttccatattactagccacgttcacccgcacggaaacaccagtacccgttatacacattcccgctccatatttctgccacttcatgttcatttcccatatgtccacgtttcccacattattaatcccccctttccggttaagttacactaaagcccaattaccttcctattctctaaaaacccaaccacatgcaaacgccttttccaccatgcgactgcccatgctttaatttactcccaattaagttccagccacatccgcgtaacctcttaccaatttcccgtctaaatatacctcaattttcatagacaccttacgtccaaaaacaatcaaacaccttttaacagaacaccccgtgaacgtcccaccaaagtttccgctcactttctagagttattatttctccccttctttccattctaaaaggcgcaactttttccattagaatcctttcctatgttcattcccccacaatgtgaatacattaagccctattttatgtggcacgctgcaccttttcttatatcccacttgtcccttccggaccataattactctttacgaccccttctaattactctccacccaatttttatctttcaaaaccgcttaaaccttgggggaaggaaaacttccttcattgttgtgcctaaggattacaccctagcggctatccttccctttggagttcccacggattatttgcaacttcctctccgcattaacctatttaaccaagggtgaaccttcgaaggggaattacgcgttagggatcaacgaagggaccgccgttattaagtcgttccccactttcgttaaccaagtgattttttagtcccgaccatatagcagcaaaaaatgggacggggcgtccagacactccaaactcagcagtcaga

SEQ ID NO: 651060 - DNA, 812 bp, Homo sapiens
  misc_feature (360)..(360): n is a, c, g, or t
ggatgaccacttaacaccgggaaggaggttggaacccccctgggtgcctattgggaatggtccgcgcgggtactgaattggagtgccctcaacttggttttgtttttcgcgcgcgcaatgtttctcgtgtccgaacttccccagctcttcaatttttcccgcgcctctcacacgcgcccccgctctctacacacggggtgttcctggccccccccctcgtgagcacgcacgcggaaagacactcgggactgccacacccccctcgtggtgttgttctcacgctcgcccccgcctctcgctctctcgctccttctatgggggcgcgcatgcactcccgctcccgtaaatcacgctcggctntgtctgcgtctccgccaacaatattgccgcgccctcgtatctttctcgttaagagaatctccccccgccatgtacacacattaatatgcactctcatctatctatttccttccccctccactcttatatgtcgcctcgccttactcacccctcctcgcttttgataccctcgctacgttgcttaccttcaacatcacgctccaatctcttacttctccgccctctcctgatccgaactattgtcccgccgagttatctgcactacacctcggggataattgtataataactcccactgtgcgaccacaccctagcatcactcccccctcccttatctgctctctccaccaacgcacgtcgattgccgcccctctctcaccgctcttcattcgcagcccatgagtctcccccctattatgaattgaaaattcctccaactgacaatcgcaaac

SEQ ID NO: 651061 - DNA, 904 bp, Homo sapiens
acagtcaaacacatgtatcttcgtgatcacctccacacctcgactgccttcgtctgccatacgctgctggtaaaggctgggtggctgcactgtcttccccaacccaacattgctttcgtctgggaaaatgcgtctgataggcaattaagccatgggagtggacatttacacggaggctacgcacatctcaggggaacgctcaaactgcagctcgttcctcagacgcactgttgggtgcgaaggacacctggagggtgagggagacctggacacctggagggtgagggagacctcggcgcgttcctgcggggccttggccacgtggccattgcccgcaccctgtcccgtacaaattatggtatcatttgaatgattttctaatctacttatctcaatttatgtatttaaatgtcaaggcagagaaatacattgatcatgttaaggtcatgtgatgtggtggcgcagtaatgacttcctgaggaaacagagaaattggatgttttgtgatttagctatgtgcactaaacttattttccatgttttgagagcacattaaacattcacgtacaacgtgggactaggttggcttgtacccagaacgtccaacccaatgccaccctttgaatcgctgtgaacattgttctgttgctgttcagagaaaacaagcaaggttgtaatgttaatttttatatttatatttattgcccgggcccgggcagctccgctcttgtggtctgaggccacatggccccgcccaggggcagcctggccacaagcacgtggggtccaaggcaccaggacccaggcaggactgaggtggccccacagcgtggcccgaggcatcactggctgacgggcactcacacacaaccccaataacagcattctcacaataataacaatg

SEQ ID NO: 651062 - DNA, 386 bp, Homo sapiens
tttccagaatgatgccaaggtaggcgcgctgttcgatgaaagtgggcaaactaaggagcgtcctgaagtagttgagctcgagtttcaccctctgatggcttcaatggagcatctggccgttgatatcaatgatgtcgcggctgtggtatataagtgcttgacggatgtcgctagggctacctggttcagccagtacggatgatctctcgacattgcaagacatgctgccttacacttataccatcacatttaggacatctctacctaccctatgctagcagaacgaaacatttgatcttaagcttagtcacccgctgatcagagacatgcttcgacgacttaacgctgatgaagatgacggctatcttcttaccgacactaactcc

SEQ ID NO: 651063 - DNA, 276 bp, Homo sapiens
cgatctacaggatcccggaggcttgatgtcttccgggtgtcagatgagcatcactcactgtactgcacttcccaggtactggtgtgtgtaggggaagaccagcagtcccttgcttctatggacacctaggctgtgtccacagcaaaaaaatacttaattttgctcacagatcacaaaacggtgtcagcctccttatgcaaccatgtccttcccatgggcatgcgatgtgcagtctagtcatagtgccgatagccacattggacattcaacgcctcg

SEQ ID NO: 651064 - DNA, 728 bp, Homo sapiens
gccaaaccatttacccaaataaagtatacgcgatagaaattgaaacctggcgcaatacatatagtaccgtcagggacagatgaagaattatagccaagcataatatacggaaggagctaacccctatacttctgcataatgaattaactagaaatacacgtttgcaaggagagccaaagctaagacccccgaaatcgaagacgagctagctaagaacagctaaaagagcacacccgtctatgtagtcaaacatagtgggaagattataggtagaggcgagaaacctacacgacggacctggtgatagctggtaagtccaagatagaaatcttaagttcaacttataggaattgtggcccgacagaaccctctaaatccccgtgtacagtttgaagctgttagtccagagagaggagacagctcttctggagcactgagtgaaaaaaccttgtagagagagtacaagaaatttgagcacccatagtaggcctaaatagcaggcaccaattaagaaagcgttcaggctcaatagccactactaaaaaattccaaaattataactggaagtcctcaaacccaatgggaccaatctatcagcgctatagaagaactaatgttagtataagtgtaccattgaaaacattctcctccgagataagacctgcgtccagattgaaaaacctgaactgagcaatgaccagcccgaatatctacggttcaacaaccag

SEQ ID NO: 651065 - DNA, 199 bp, Homo sapiens
acgaaattacggtcatatactgtactactttcacagaagatcacacagttttgcaaaacgacttgtcatatgtactatgctatattcaaatgagaaaagctgtaagcaattatattcgctaaataaatgcggtacttacagtttgtcaggagacattagaaatcatctatcctttaaatttctgtgcccttttcaaggc

SEQ ID NO: 651066 - DNA, 232 bp, Homo sapiens
gcatggtgatgtgcacatctagacgtcagattgggagaattgcttgagcccaggagtttgaggtgcagtgaactatgaccacgctccagcccaggcaatagagcaagaccttgtctcaaaaaataaaaataaaaaagatacctatgatagaaataatgataaaggggagaaattttaacatacaggaaggccccaaattagaatagtttgacttaaaattttggactttatg

SEQ ID NO: 651067 - DNA, 501 bp, Homo sapiens
gcgaattcactagtgattgtgagctgagatcgcacccggtccaagcactggctttgagataagcaatattaaaaacattttcagcttcatcagatgctgactaactgacctccaaccactgttccaccagccataactacagctttggttggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtatgtttagtcaatccattgagcatgaagctcctaacctaaaccctccttctttgaagtgcctgtctctggtcttggt

SEQ ID NO: 651068 - DNA, 176 bp, Homo sapiens
  misc_feature (55)..(55): n is a, c, g, or t
  misc_feature (105)..(105): n is a, c, g, or t
gactgccggtcggttttacaactgctcgttacatggagaataccgtgtcgtcggnctgcgcatgcgtcgccacacgccagccaccgcgcaagcattccaacctangaagtaaggctagcgagcgtgttgttctcaacataggtgcagctcgctcacgtcgcaggatgccgctgtaa

SEQ ID NO: 651069 - DNA, 1177 bp, Homo sapiens
aacgtccctcttgggtctgtgttgtgttgttgtggctgtgggggggagggccccgccgcgggccggccaccccccgcggcgggtctctttttttgcttgtgttttgggctgaggaaccaccaactctccctcttcttgtggttttgtttcgtgcggtgcgccgtcgttatcgtacatcgcgtgtcgcgctccttgctctcgtcgcgacgtctgtgttgcttgtgtctgtcgtttgcctggttggggtcccgtggttgtgcctgtgtctgcccgcacttcgcacatgtctttctgattgcccgggtgttgggtgtacgcgtccctcccggcttcgtcagtttctcgtgggtgttgtgtgggccttgccgggagttttgcgtggcgcactcgcatgtttcagccgcgttctttgtttggtgtcctgtcctgtgcggcctgcccgcacgcttccgtttgtattgctcttgctcctgcttgctcgcggcgctcgtcttctatcgttcggccggtgtctgtgggtttcgtcctttctgcacctatcgctcccctctctcttcgctcgcgggcgtgcgctctcactctccccgaccccagatttcgttagtgtactgtatctatgttgttgtcacctcgccgctgccgtggggcgctcgtgttctcatcactcgccgtcacgctcctcgtgcgcgggcctaccactcgccacgcgccacgcacgtttgtctttctcccctccgaccgcgctacgctcctcctctcgcgccgagccgtctctgctcctccacaccatggtcctcgctcctccgccgggtggagtctgtcttttctccgccccgcggcgcgtctggggcgagatatatatgggccacgcaggcggctccggttgcttgtttttttcttcgtcctcgcggcgctcacgccgcggtggctgcccgtatgtagtgctagcccatttgtgggagcgagcgggcggcgagctcagggatcatgttcttgtcccgccgccctcctcgcagctccccccgcccggtgcctccagccttgcagaattctattttgtctgtgtctccccccccctgcccccccccccccccccgccccccgcccccccctctttttttttttttgtgtttttcccacaaataagctgtcggttttttctctctgccaccaaaca

SEQ ID NO: 651070 - DNA, 517 bp, Homo sapiens
tattgtatgtcggacagaacaaaagaagaggcagaaaatattgcatataacaaatcctagcttataaatgtagtttttaagcggtgatgtctctaatcatcattcagggatttttttttttttttaaattggctccacggggtctcgagcacggatatgggagaaaagcacatccggcataaagtgtaacccagggtctcaaaccacgggaaggacccgggagagcaaacatgatttttctaattccctctaagtaatcttccttaagtaaaacaccaagtgatcttgggcatagatccatacttaaagggcatcaatatggcattaatatcaggcaagcaactatacaaatatgcggagggcctggaaaactaaccatcctcatttaaagggaaatagggaaagcctgagtgtcaaggaccaactaaagtggtacacatccgaggtggggaacaaccacacagcgaggggcggaaagcaaggagtgtcaggcaaggttcatactccttgacccatc

SEQ ID NO: 651071 - DNA, 241 bp, Homo sapiens
ggtccctgcctaccaatatatactacaaaccccttagtctggcacacaaggccctgatgtgaccacgctcccactttcttctttcctagccttcccccaacccacaaatgcctttacataacaagcaacctttctttcctctaactgcacttagcgctgctcttcactacccttctgcatcagacttacttcccatcctcagccccagactcccctaccctccatgagaaacaccctactt

SEQ ID NO: 651072 - DNA, 373 bp, Homo sapiens
cccccttccagggcctttgctccaaaggaggcctttggaacccaggactttggggtttttcaaaagggctggggtgtggaagggcaaactgccccaaaaacggtggatataacccccgccccccccccgctgcctagcatttgcttggcccattagttcagcctcagaccatggcccttttagggggtctcttcctccccctccacagctgcagggggaccccagtgccaacttcctctcccactagggccctgccttcagctggggcttgctgcgattcctgtgccttatgtaactgcccttccttcccctgccctaggaaaaaggctgcatctttatatgttaccttcatataaactttgtaactttttta

SEQ ID NO: 651073 - DNA, 244 bp, Homo sapiens
  misc_feature (90)..(90): n is a, c, g, or t
  misc_feature (149)..(149): n is a, c, g, or t
  misc_feature (160)..(160): n is a, c, g, or t
  misc_feature (223)..(223): n is a, c, g, or t
  misc_feature (241)..(241): n is a, c, g, or t
cgccgcagctgcgagaagggttgggggcggagttgggagtttagcgcagtcgccggagtgcgtggacaacgaccgtccggccctagcctngccgagcgggtgccgggagcttccctttctcagcgcggcgcgaaggtggctcgacgtcngcgcctgcttncctcgacctagtcctcctaaaaaatccgaagctaaacagtagatgtggcgcctatgactacanttattcccgaccactatnaaa

SEQ ID NO: 651074 - DNA, 1006 bp, Homo sapiens
tctcacgatgggtgggtttctttcaaggggggtacatgcatcggggggtgagccaggtttccgctgttttgtgggggcgacgtggttccgaattggtgttgagctgtcgaagaggttgccccgcgcacgggttgtttgccaggtgagggggtggcccccaggagagtggtgtgtgcaccaaggatgcgttgccagccgggtggttgtcttatatagtggggggatttgtgcgctctgtgtgccattggcacgcacccgcacagagcggcgctggtgtccccccgccacggtggttccccgggcccaccgggtgcttttgttgtgcccacgcgacgggattgaatagtgtccgccccaatttcttgccctcttgttggaggcggccccaaccgttgtggggttccttgttgggtgctgtcctcagccgtcgctgtgcccaccccctggaggtgtctgcacccccgcaccgatgcctcgcccggcggcgtctgcaacccacgtgatgagcacggagggcgtgtgcgtggtagcagtctggtgcgcttcttttttgttttttgaaaagagagcccccccttgttctggctccacgacgcacttgtgcgctacagcacggggtgtttttcagttctcccacgcgaagcctctccaccacacgacggatggggcccccacgggcaatcccgcggagccttccctcgttttctcagcctatccttttacccactcgcacttctgttgatggacgccgtaaaactgcacctcttgggtgattattccgcgttcaccactcaccacgatgaggggacttttcgcgagcccttcacaaaatgatgtgcttttctgataaagttgttcaattatttggccaactaaagggttgtttttaaaaccatgaaacttaaccaattcctcgcgggggtttctcgtaaggacacccggggggccaaccctttcttttaaaacaacggcctcccctggaaaagaaattaacccctttttatta

SEQ ID NO: 651075 - DNA, 116 bp, Homo sapiens
gatgttacatcgctttaaaccctgcgtgcaatccctgacgaccgccgtgatgcccatgtatgacagacgacttgagtcaactacttcttaagatcatccacttattgattgatatc

SEQ ID NO: 651076 - DNA, 179 bp, Homo sapiens
tctgggaccagcaataacagggggcgatcctcagctttctcgctatagccataatgattattaatgatgagtatcgattggtagtattggtcatggttcattgtccggagagtatattgttgaagaggatagctattagaaggattatggatgcggttgcttgcgtgaggaaatacttg

SEQ ID NO: 651077 - DNA, 263 bp, Homo sapiens
ctcaccctgaccacacttagtttattgatggcagttccaccaggcctaatcgccacacaccagcaaaagcaggctatgctatagtacaagccactagcccgcctctcagaacctctcgtttcctttccatcgtggaaatctatcctcaaggaaataacttctcagtgttccatcagctattctactactcctcagggattcttcagggccccctccctttcccttacacattcaaggttcagggggttttgcccccacccggg

SEQ ID NO: 651078 - DNA, 519 bp, Homo sapiens
tcgcaagtgcgccgatcagggcgtaattggagtttgatgctcaccctgaatcaaaggattgattaaacggctaggctaaagggtggcataaaaataaattaggaggccataggtttgagggttgaccagggggttgtggcttatggggaggggggtccatagttaaaagagcgatggtaggagaccataaggctcgggagcggatgactgttaaagggtgcatggaaatgttgcgccgcggtaccaaccagaggcccctccactagggacagcaaacacccccacacagcggccacgctacaagcgccaaaacgaggctacgacgaacaatacaccaccccaacaagggagcgaccaccaacacaaaagcgcgagacggcggacacactctgcgcccacacacactcacccccctcactacgccccacaacaaaacacctaccagccgcgtccgccgcgccaaacgccccactacccggcaacagctgcccccactctgcccgacctaaacccacagcg

SEQ ID NO: 651079 - DNA, 200 bp, Homo sapiens
tgaacattcgtcttaaacaagaggcatgcatgaccccctcattcttcccatcatgtgaggtcagaacaagaaggtgtcatctacgaaccaggaatagggcccacaccagacactgaatttgccagcatcttgatcttgggtttcccagcctccataactataggaaactaaatttctgtttgtttggacacgaatgttca

SEQ ID NO: 651080 - DNA, 170 bp, Homo sapiens
tttgtacacccgacgggggccacccactcttttcttccccccacttcatctcgggattgcggaccggtcccacctcccccgcacactggggcgcggctcaacccttcagtgccccagcaggcaggctgtgcatggcgagcagtgacgcccatcgagcccaagcaccggga

SEQ ID NO: 651081 - DNA, 374 bp, Homo sapiens
ttgtggtcgatctctagcaggatcccctagttttcgtgaaaggggggaatatagctaacaaacaatattcaacagtgcggagctccctctgctggtctgcatctaggttggtatgttacaatacacattcccagagacatcttctaatttgctggagaagtggtctaaagacaggctgtgttgggctttgcctcatgagagtaacacttatgagacagctgagacacagcgaggtttattttcccgtccctaccgactctcacagtagcctcggatgtgaatctatcaagatcatgagtccagacccttcacttctgcacttcactgcctctctccatgttcattagctccaccttatttctctcggaccaatg

SEQ ID NO: 651082 - DNA, 664 bp, Homo sapiens
  misc_feature (500)..(500): n is a, c, g, or t
  misc_feature (553)..(553): n is a, c, g, or t
cgcggtggatcacccctgtaatcccagcagtttgggaggccgaggcgggtggatcatctaaggtcgagagttcgagacaagtctggccaaagatggtgaagccgcactcggtctctacgaatagatagcaaaatagattacgtcctgcgggcgtggctgtgtctcactgcgcgtgtaatactgcagtcatagctcggggaggactgacgatcaaggagatatgtatgagcccgggagtgacgcgtaagggtagcagggatccgagatctcgcgatcgaactccagccgggggcggcagagcgggactccatctcgcaaatataagagtacatggaagaaaggatagaactttaggagtcgtgagcagagcccaggcgcacggcctagagatccttatgtcaaccactcgagtagtgggctcaggccacaatacagaagggggatcagtgggacataaggagggactaccataggagcgccctcgggtgtcacggccatgngctcggggaggtcaccaacagatgcagatagcatgccgcgctggggaaaccgngagagtgtgcaaaggcaaaacacacattatgcggtggtgtaagccggtggacgtgggccttgataatgcggaaagcggaagatactgtactccaaatacatcccggtgggt

SEQ ID NO: 651083 - DNA, 950 bp, Homo sapiens
gccacctctgaccagagtatgtcaagacttgtacattaagttggacatgctgcaggtggtcacgaagagacatgtatacaagtattgactatgtctcgacacgatgtgatccagtatatagtccagtagttgtagcactttttgactagcctattgactgtatgctagtctcggtggcctgtactagtaacaagcactttaatctcattggaaaagtacaactctatggctaaataatcctggtaattgcgctcactaagagtctgctaaatgtaatttctcttttaaacaacattactgctattttctgattgctgatgttgctcttcccagtgtttcactagtttgcacgtcattaccggggaaatgcaagcgattcttcatggttccaacaactgcttgccccatttggcattgtatgatactaggaggctgtgttggcccatatttcggttcttgatatgcacaattgtcttcgtcccaaaggaataggcagagattccacatcttgtgaagtttttctataatatgggcccgcattgtatgttgacatgggagctgcccctgtgtatcgcatgtggggtgagttccaagaaataaacctcgtaatatgggtatggcggagtctttaggcaaattgaggtccacattatgctccctaacttgttgtgacacacacatgtgataggatactcttgctcgaagcggttgcttgcgcccagccactaatcaatttcgcccgttttgtcgccctcacagccacgagatactgtaatgaaactctttgctgcaaccttactcaccaagcgtcttggaacattgggtacaagtagcacttctggtccctgagcagggtgaatcctaccagttccattattgctggcccatactgatttctgtaaaaaaagtaatggtcactctcttatgagtacacatgttgatcagaataa

SEQ ID NO: 651084 - DNA, 275 bp, Homo sapiens
tgtcctttctttctgcccaggctggtctcaactcatgatctccagcgatctgctgcctcgtgtctccccaaaatgctatatttacgaggcatgagccagccggttttacatttcgtgtaggtcagaaagcccacatggtgcacagtgggctaatatcaaggtgttgcccaggtgagcccatggtgctgggttccttgcctttttccatgcctgttgtaggccacctgtcgttccttgtctcagtggtcccttccgctccatgcatcagaggctca

SEQ ID NO: 651085 - DNA, 792 bp, Homo sapiens
  misc_feature (17)..(17): n is a, c, g, or t
  misc_feature (65)..(65): n is a, c, g, or t
  misc_feature (72)..(72): n is a, c, g, or t
  misc_feature (87)..(87): n is a, c, g, or t
  misc_feature (234)..(234): n is a, c, g, or t
  misc_feature (236)..(236): n is a, c, g, or t
  misc_feature (243)..(243): n is a, c, g, or t
  misc_feature (245)..(245): n is a, c, g, or t
  misc_feature (301)..(301): n is a, c, g, or t
  misc_feature (303)..(303): n is a, c, g, or t
  misc_feature (311)..(311): n is a, c, g, or t
  misc_feature (365)..(365): n is a, c, g, or t
  misc_feature (367)..(367): n is a, c, g, or t
  misc_feature (379)..(379): n is a, c, g, or t
  misc_feature (421)..(421): n is a, c, g, or t
  misc_feature (467)..(467): n is a, c, g, or t
  misc_feature (475)..(475): n is a, c, g, or t
  misc_feature (496)..(496): n is a, c, g, or t
  misc_feature (584)..(584): n is a, c, g, or t
  misc_feature (591)..(591): n is a, c, g, or t
  misc_feature (634)..(634): n is a, c, g, or t
  misc_feature (652)..(652): n is a, c, g, or t
  misc_feature (659)..(659): n is a, c, g, or t
  misc_feature (710)..(710): n is a, c, g, or t
  misc_feature (722)..(722): n is a, c, g, or t
  misc_feature (782)..(782): n is a, c, g, or t
taacttactgctatatnacaaattacaacctcaagaccgcacgccaataaacacatatgaaaaangcttgtnattcagaagtgtgcnaaaattttgaatggataatcgtccttcttctgaataaagcatggattccattactcggtaatacaagcgaaacaaccaagtttgtatcgctgtgatccaatttcgacacaaccctgtcccacagctttagcaaatttctctttaaanangtatccnanatccttcactcttttcagtatactttcttttggattcactgtgcagtcgtaaaaanangaaaacanaatttctgaaggttgaacacttgctgaatttaaaaacatcattaattgttgganantgtccaaaacantcctaactggagtgtgtggaggaattacattcacctctccancaaggttactttttcgtggtgttctctgtgtttcaaaactgtctanagaatcantctgaagagttttatcatganccaaaaataatcttgcatctagatctttatttttaagaaaaatttcttcgtatcgtttagaaagaatttcaacctctggaagtccatnagatgtnacaagtccaagagaattcataaaaggtataaaatttttgaaanaaacatttttcacctcanctatatnacattcatgttctttacagagaacttcaataattcttgtatcaatttctanttgtgttgctanccgtgcactcctgttctgacctcgcctgggtgttcgaggtgaaccattaatgggtataanagctgtttta

SEQ ID NO: 651086 - DNA, 153 bp, Homo sapiens
acagagagtacatctatcatctcagtaacaaccctttccaacacatagttatcacatgatcttcttactctatgcaggatacgtcaagacccaacaaatgaaacacttctcctggcacattcatatccccattatggtttatcttttttcaaa

SEQ ID NO: 651087 - DNA, 321 bp, Homo sapiens
tatttagcagagtcgagcgagaactgatggatgtcgcctacaccggtccatctgcggggctcagtgggggctgctgtatgtcttggctgccgaacgggcaaggtgacctaggcttcatagccgaagaggcacgtagcgattaggcccagtacccctgcgacgatttaggagtggttgcctctctcaacaaggacaacactagaggtgactcaggtcgagtattgccgctataagggttcggaagaaatcactccagggccagttgatgaatggtatcttggagtgcaggtcacgcattttgaacacaaatcgtcagcagca

SEQ ID NO: 651088 - DNA, 180 bp, Homo sapiens
cggcacctctcttatttgtatcctaaacatacgtactatcatgcttttgttcacacacgctctgaagaatcctgtacgcccctgcattaagccgacagtcttcgtggcttttctggtcttcggctgctcagagttcatctgaagattcgaatgcaaagaaatgcatgtttcctgctccgg

SEQ ID NO: 651089 - DNA, 151 bp, Homo sapiens
gactttagctcggccccacaccacctgagtcacaccacctgagtcacaccacctgagtcacaccacctgagtcacaccacctgagtcaataaagtgattggcttagtgggcgaaatattatgctttgttgtttggatatatggaggatggg

SEQ ID NO: 651090 - DNA, 148 bp, Homo sapiens
cgcctttcttcaaatggtcagcctgagaaccgaggacacagccatatacttctgtacgcgggccccgggttattatgatggtagtggttattcagggcatgatgatcttgatctctggggccaagggacaatggtcaccgtctcttca

SEQ ID NO: 651091 - DNA, 470 bp, Homo sapiens
  misc_feature (4)..(4): n is a, c, g, or t
ggtnggggggcccccccccggcggcaacggctttggacgagggcagaaccccaacgtgcaagggttccccccctaccgacggtaggccgcggggccgcgaagtttgcacggcccagacccaggattcccaacttgtgaactcgtgacaatcccaaacttggcggcaaagtggcgactcaaccttgggggggggggcggggggagggccccaggcttttggaacggctgtgggtgtcgtttggactgagggttttaaaaatttctttttctaacccatcagccccaataaaaaaaagtccctggttcaaccacagggtttaaaaaaaatgttttcagctttaattcaaaacttcagggtttttttttttccttttttttgggaattattttcctgagccctttgtttttcgggatattgtaaacttttatgttaaaaaaaaaaaataccttttccaattgtgagattttta

SEQ ID NO: 651092 - DNA, 877 bp, Homo sapiens
tgcacgttggtgtgagggctgactaatattgcgtcgctcattagatttatgataccgtcccttgtgctggccccaccagtgtttcccggggggaccctttgttttcacacgctggtgggttcgttctccctgtgcaagtcggtggctctccttgcggccttggtttcctcacgcgtggcctacgaatgaacaaccctcggctggttccttaaagaggtgtgttcacaacgctcctttagcaaatctaatcgttcaaactcatccattctgggcgccgaaatgatatcctcgcggtcggcttgcccccccgagtgtgacaagtgaaaatagctcccacccgttttagctaactcttggccaccggttcctatcccccctcctttgctagttgtctcccccgtacaaagagtcttctgctccttctgcgtggagacaaatgttggtgtccttgtctatgccacccaaagaagaagatggggggcaaacattttgtcacacgcccccccctggtctgaggatcgctctccttcttgccttgggggaggtacatatcccactaaggaacaagaataaactgggcgacaagttcacttctcagtaacagtcccatgcccgaccactggctccagatgtgaggatcatcctgtccccacctactttcagcgagtgacttctcgaagattacaggttctaaccatgtagacctccccccaactgttgtttcaaggtccaccagcagtgggtgaagcaattctttcatcagctccctcattgttataggttttatcggcgtcctaacacgtctcagggacacaaattgagcagtgctgaaggatatcccaaaaaggaataaattgggaacccgccccacaaaaca

SEQ ID NO: 651093 - DNA, 228 bp, Homo sapiens
agaggatctgatcatccccttcgtgggccaccgtcatattccctgagtgcacagtacggggggctccaggtgtcagggcagccctgccatggcaggtgcaagggggtccagactcgatggcagagggtcacgagggatggaggccctggcctcccccacctccctgtgcagggaggtgacacttgtggtggcctgagaggatgtggcagtccctctggaggcacgggg

SEQ ID NO: 651094 - DNA, 572 bp, Homo sapiens
gaattcggcacgaggggaatagtgcacgagagacaagatcacgcatgcacctgcgatagaggctggtgagatattgagaacactgcagttattagcctgtggcaaagctagagttctggcgaaaaattcgcgcaactttttacgattaagatcaatcctatcccgatttaagaaacggttgtagaacaagcactcactacacatagagtgtttcaagacagacacgtatcaaattggtgctctaattgcgcgaattctgaagatgagaaagacacttatgcacaatctcctttgtttcgaagtgttcaaccagttggaattttcactcaaggctgctgatgtttagaaagagatataatcttctcatgacccggactacatggtaagagataaacgctcgaacccggtcaactatattggatagaatggtggccctgcagcattttgcgtcatattccggaaccacgggatgaacccacccggtgaatccaattatttggctcccttttgtcttcccgtgaaccaatggaaggtgcccctaatggtcagctgagtggaccttttcttggggt

SEQ ID NO: 651095 - DNA, 309 bp, Homo sapiens
cacctctgtacgattccacctctgcacctagttcctcatactctaaagtgtagtctgcctccaggatgacatcgttcttgaccacgatgctaccgttgtagcaatctccgaatgttcacccctctatactgaggaagattgtcgcccttcaaaacgacatccatccgattcttgaagagggtactgaagttctggtattcctgggaggatgcgtcattcatcttttctgtgaaatttctgtaagtcactttcactgtcatacctaaagtggcgttgagtttttccggggtttctacagggacggattcc

SEQ ID NO: 651096 - DNA, 262 bp, Homo sapiens
ggtactctagaggatcgtctggacgagacgactacaataaaaagtacagtactattccaataaacactgcagagggagcacccctcggttgctgagtcccctcttccctggaaacttccacccagtgctgaacttccctctctcataccctccctccctaccctaaccaaggttccttggcccatgcagaaagcatccctcacccagtcctagaggccaggcaggagcccgttctatacccacgccagaagtgagacatcca

SEQ ID NO: 651097 - DNA, 101 bp, Homo sapiens
ggaagtgtagaaatgactgagaaaacgagactgtttcagaggaacattgtcacaacgaatacttctggaagcttaacaaaactaacctgctgtccttttta

SEQ ID NO: 651098 - DNA, 121 bp, Homo sapiens
agttagctatggctgtatcaccaccctttattcagatgatctacctcatgctttgagagagaaaagaaccacagtggttgcacaactgaaacagcttcagagcagatacagaaccaattgt

SEQ ID NO: 651099 - DNA, 610 bp, Homo sapiens
gtggaaccaacagcagctcgatgacttgtacttggatcgccatctgccatcgccggggcatcagatccctacgcgaccttactccggatgcacttgccgctgctcaggaacatcctccaccaggggcaggaggccatcctgtcgagcgctaccggatgaagggagaccagtctgcgatgtatacctgcactatcctgccctcctactacgcacctgcgatgtgcacttcagccgcccgtgggcttcgaggcccccggtctcaggcggtggagcgggcccagctgctggtctgaggtgatcgagaacttggagtgtgaccctaggcactagcagcagttgcagcgctcaccttctgaccctcatggggctgtacgatccccctgctcaatgctcttgcaggaggctcagcaaagctgaattaactcaggcagacagatgcacagatgtgtgggatcgcgggacggagtggtggcacaagatgtgtatctccaagtgaattggctacaaatgtattttataccggcttattcctagtatggaataaactagcgggctcactcaaaaaaaacaaagaggggcgaccacgaagattcccctagagagaaaccgg

SEQ ID NO: 651100 - DNA, 167 bp, Homo sapiens
actcttcatggggctatagcttcctacctccttcaccctacactacctgcctttctagcatctaggctagtgtaggccaggtaggtcttgaactcctgggctcaagcagtcattcggacctaagcctcctaaagtcctgggatagtaggggtaagccaccaacccac

SEQ ID NO: 651101 - DNA, 667 bp, Homo sapiens
tcctccctctggtggtcatcattacacctcctatgtatgcctcgctgtgctgagcccttgccttgtgtccattccaacagactaactaccctgaggtgcgaaatacgaacgattgggtggaaacagatgcaacgccagaggcccacggtgccgcaggacttgtctggtccagcattcatgctgtccttctttgtggggagcagggtgacatacagagagataactctggctgtgtgcttagcgaccctacgaagtgggctggggttggtggttcacgcctgtaagcccaacactttgggaggctgaggtgggaggatcctttgagcccaggagttgggacagttgggcaacaatagtgagaacccctgtctctacccgaaaaacagaactaaaagccaaagagagacatgaaaaaaccgggcgaggagcaacaagggcccgaggggaaacggagtataaacaaaaagagatgctcgggagcaaccccaggcggaaacgggtacgcaatgtgaccaaaggggcaccaacaaagacccagcaaagacaaaagccggggggtagtccccaaaaaaaacggcggggggcagaacggctgaacaaacacaagagagacagagcacagggggagacacaaggggaccagggacagataaatcaccggcgggga

SEQ ID NO: 651102 - DNA, 313 bp, Homo sapiens
gtcgacggcctctagtgagtctggctgaggttttatctatcttgttgattttctcaaagaaccagctcctcgtttggttgattctttaaatagttcttcttgtttccagttggttgaaactcgcccctgagtttgattatttcctgccatctacttctcttgggtgaatttgcttcctttttttctaggtcttttaggtgtgttgtcaaactgctagtgtgtgctctctctagtttctttttgagggaactcagagctatgagtttccctcttagaaatgctttcattgtatcccataagtttgagtcgacgc

SEQ ID NO: 651103 - DNA, 423 bp, Homo sapiens
  misc_feature (21)..(21): n is a, c, g, or t
ccaccgaggatgttccaggcntgcgcgatgagcgtggcgtagagcgccatcatcacgaagttcagcatgacgcccgactgggtgaccagcggcacgcagccgacgaccacagcaaagagcgcgatggccgcgagctgtctgtatccggcgttgattcccgctttcatgccttggctccgaacatgccctgcgggcggaacagcaccacgccgatgaagatggcgaagatgccgatctgcccgagcgactcgcccaggtacagcccgccgagcgactcgaccacgcccacgaggaagccgccgatgagcgcgcccacgaagctgcccatgccgccgagcacgacgatcgtgaaggccacgagcacgaagccgctgccgacctgcgggttgacgtagtacgcgggcagcaggaagcaagcggccg

SEQ ID NO: 651104 - DNA, 337 bp, Homo sapiens
aaggcctaggtgaggctgcagttccatgatgtggccggcgacatcttccaccagcagtgcaagcgcaacgagctggtgatccgcgtgcatcccatcgaggccttgtacaccaagatgatgaccaagaagccgggcatgttcttcaacccctaggagtcggagctggacctgacctactgctacagattcaatatcgtgaatctccctgacgcctacaagcgcctgatcctggactttttctgcgggagccaaatgcacttattgctcagatacgagcttccgtgaggcctgtcgttttatcaccccattgcttgaccagattgagctggataagccc

SEQ ID NO: 651105 - DNA, 472 bp, Homo sapiens
  misc_feature (449)..(449): n is a, c, g, or t
ggcagggcggtgcccctaatactgggtgatgctagagttgatgtttgggaaaacaggcgggtaagattggccgagtccctttaacttttttaacccttcccttatgagcatgcctgtgtggggttgacagtgagggtaataatgactggtgggtggatggtagatacggggctgtaattggtcagtccagggtttaaatctgacgcaggctaatgcgaagaagaatgtttcatggtccttatactaccataagtcctcctataggggtgatagatggtcccacgtggggtgtgagaagtcagtaatatgtaggggatccaaaaggtagggggtgtggagcttgaacgcttcctaaatggggggctgctttaaggcctacaaggggtgtcaaatttttaactctctctacatggtttttccctagtgtccaaagagctgtccctctttgncctaacagttaattctacagggg

SEQ ID NO: 651106 - DNA, 314 bp, Homo sapiens
  misc_feature (47)..(47): n is a, c, g, or t
  misc_feature (221)..(221): n is a, c, g, or t
  misc_feature (248)..(248): n is a, c, g, or t
  misc_feature (295)..(295): n is a, c, g, or t
cgaacaagcgaaacatgcgattcgttgagtacagattcgatgttacnacaaatgatttcccccatttcatgaaatggcgggctgctgcacatggcggcgagaatattgccttcaagctggcgaatctgccgttcttcggtgatatccgaaaaagtcattaccaggttctgcagatgcgcgagcacgtcataaaccgggctgatagaggctttaatccagantttttcaccggtgcgcgtcaacagcanaaattcgtcctgattgcgggcggttttccatagcaactgttgtaaangaatgcggttatcggcagg

SEQ ID NO: 651107 - DNA, 771 bp, Homo sapiens
cgggaacattgatgtgagctgctgaggcgcgagctgtgctgcagctctgtcagtgtccacgggccactcggggggcggtgtgcatcagccagggccggagctatgacacggatcaaggacgagtgttctgtgaaatgtgaaccccagatggctggaggccaggagacgacatgttttgaagtgtgagactggcaagtttaacgtgccatcctgaaaacaaacactggtgaagagtgcccaatgcccatcaaggttcttggattgccccatgtgctggctgggagcgtgctggtgatggaagcacatggacatgagtgcatctgagcagtcatgctgcaaagctttggagcccagctgtgccggatttacaccttgataacaagaagcttggaggagatgctgcctgaaggaggctgggacacatgtgggtgagaaggaggtgggcaggaggggaactggccttttgttggcccggttcgggattttgacgtggtgactgttgctgtgtgatacctcccccatggtgagtgactggcatggatggactgggtcgtgttctatgcccgggagcgcatacagccgccagatggacatggttgagccgtgagtctggggacagggaggccctccagctttgtctgctctgcgtaggatccttgactgttcggtgaccttgagataatccaggcttactcaggggcctctgggtggacgtcgcgagggtctcttggccgtggtttggccagttcaggcactcggatttgtggttgt

SEQ ID NO: 651108 - DNA, 1163 bp, Homo sapiens
ccacgcgtgcgtggacgcggtgggctgatgctgtggggtgtatacaatcagctgaggtaaactaaaaaccttaacgtcttcgtccgaatggggaattgcagaccagatgaacgagacgtggaaaattgtagcaacggctaggagagacgatgtaaagactcaagtaacgtccactacgttggtggtatctcatacctcacccataggtaacactactggcatctatctcacctatcatcactgtgatggaattgcataagtactgagcgtcaccatcgtaccgctctggaacatccataacaaaaacaactaactatcacgatcaacaccaacaacacctgaagtgtcttacattcttgcctcgcctctacatttgaggtgcgcaagataggacattagatgcaacagcacctttcctgccatgttgagtccgaaacctacaactacgaccaagttgccctactcgaatcaaacatcttcctcgttaaactattatcaatctcccataagcgggtatgcgtttaaaatattgatctagtgggtcctcctacttaataacagttaaacaatacgtcgtcgcgaaggaatactatgccgcacgcgtctcaaagaaggtaagagataaaagaagtgggagacacaaaagagacaaaaaagggtaccgcaaccaaaaaaacagagcaagagagcagggggaatgtgttgccaaaaggcagcgtaggattttacaagaggggtcgcccacgagtgggcacattaagtggggccgaaagtaagaccatataaggcccaagagagacagcctaacggagttcgataaccaaaaaaaaagatacaacaggaatgggtccaatgagacaacaaaggatgggagagaaagggtggccagtaacgcagggttcacccaaagaattaacagtagaagaagaacgcggctcaggaacagaagaaggtgcaggggaaaccaacttggtgtggacgacattttgaggagaaaggctgcacggatgggacatgagcaacggaaggaagctaatatgaaataggtagaccgtggtgtaaaataacgccacaaagtggaagagagcgagagaccaaggaggccacaagattgagaggggaagacacaccgtgagtcttcatacaagacgaattatccatag

SEQ ID NO: 651109 - DNA, 127 bp, Homo sapiens
actacacaacaatacaacagccttaacttcctgggctcaaggagtcctctcaccttagcccctcggatagctgggactacagtgcactgtgcacgcatgcccaaattaaatttttaatttttgtgta

SEQ ID NO: 651110 - DNA, 1353 bp, Homo sapiens
  misc_feature (1122)..(1122): n is a, c, g, or t
  misc_feature (1142)..(1142): n is a, c, g, or t
ccagtgagggatccaaaaggctttttgcagcagcacatcttgaaaggactgggagcagttggccaagatgctgggacacagtgccgacgagaccatcggcgtggtccacctcgtcctgcgcaggcttctccaagagcagcaccagctctctagcagaagtgaggaaaggggcaagggctgggcggggatcacacagcacaacggcagcgcaagcaggctcgctgtcttgtgggccaccccacacacagccagtctgagctctgtctgtgctgttgctggaaagaatgagagaacacacagagagaaaaccgtgtctagggaaggcgatgcctggggctggaaaaaggaagcactctgcttgcccagaggctggaaggagctgctctgttccctccattcacccctgcctggctaagacctgcggtattcgggagcgtctgcacgcaagtgttcagtgtgcatatatggggagtcttcagttccgaagtcagccccgtaggtcattcccctaccatgctgggagcacgtgtcgtccacacagagcgtgcgtgtcaaaggatcaatcaccatcacagttgtgtgctgatttattaaatgtttatatgtccacagttatgttaaaaaaaaaaagctataaaatattgtattcactgagctaactttctattttaaaaatttaaatccatacagaaagaaaaggtctgtaagacaacttagtaaaatggttatatggttatctgtgagtggtggaattaagagtgattttcttttgctaatctgcaaaaatcacaatgaccattgtgaggacaatgttaatttaaaataataacaataatagcaagaagaagtcctgccccatgacaagaaaatctgctcccacctcaggtacttctttgcctgaaactggcattcctatttattttccattttgaacaatctgattttattttaagcctcttattctggtgggatttcagcaaagtgagcacacccagagtcacactgatgaaatgacagaatcctggaagcaggtggacagttcccgcagcactccacatctgtgtggtctgcctcagggtttgggtggcagcagctgagacggctggcggtagcctgggccantcttactattgagctcaagntctgttctttcagtaatttttttcaaaatggatctaagattacaattatgtaggatagaggaatttttagagattgatgttatcttcaaaaggtcattaagttggtggtaacaacaggaactacttcaaaatacttagattaatttagaaagctattacctcaaaacgagtgttatttctattaaacacttatttagggtttataaaacgc

SEQ ID NO: 651111 - DNA, 459 bp, Homo sapiens
agaggctccccccgtaatgtagtaactgtgttcatcccagtctattcgatcgtggtgaaaatatttacgttacctggtctggctgtatcatatgataaggtagaggtccaagaatcctttccatcattgctaaatgctccttactatcgtgtgttggaaatacggttaacccatgatagtatgcaataagaatgcatccaatgctccagacatcacatggttgggaccaccctagggctaataattatacttacaggtgctctataatgttcttgtagataccaatgtactgtgatgttcgtcatcatatgtagcactaccaaagtctaccaactttatatatctggattcattaaggtgcgttcatcacgtttaatcctcgggataatacgcctctgtgtagtcagactgcaccaattatatgttttcaggctttaggtctgtgtgagtctacttata

SEQ ID NO: 651112 - DNA, 121 bp, Homo sapiens
gcttaccgaatgatatcccgttctgctgctagccctccattccagcctgacccaggtgcccagccaaacctcagtcctcacttgcagagcccatggtatgagacgagacttcttgcctgct

SEQ ID NO: 651113 - DNA, 531 bp, Homo sapiens
tctagaggatctcccccaggcatccccacccaggaactgactcagcacaagaagacagctctgacttcctgtgatttcatctctgaccaatcagcactcctggctcactagcttccccccacccaccaagttatccttaaaatctctgctccctgactgctaggggaggctgatttaagtgataataaaactccggtctcctgcatggccaactctgcataaattactctttctctattgcaatgcccctgtcgtgatgaatcggctatctaggcagtgggcaagatgaacttcttgggtggttaccccagttaggattaggtttgactgcatataactgagaaacctcaaatatcgtagcttagaacgggtttatttttgtcttatgtaaaaaagtttgtaggtggacagtccagaagacaaagaggggcatgctccctctggttaagtactctttcaggaaattgcacacattatttttcttacaccttattggtcagaacttagtttcataactatggctatctcaag

SEQ ID NO: 651114 - DNA, 1059 bp, Homo sapiens
agcggctcgggtcgctcaggcccgtggggccgacaagatggcgcaagtgtcgcggacttcgctactggctaggaagctccgtatgtcaccgactgagaccagaagtggcatagataaacagatatacagacaatgctcatttgggcacagagccataaaggccgaacccgtttcgcaaggtgcgttctcactgcgacaacaggaactcgctgctggcaacaaaagtaggcacggttgaagcgcacaacagccaaacttcctgccacttacgggacagtgtgtaagggtccagcctgcatcaagcaatggcaagcacaaatcaccagcctttgtagccaactgacgcgcttgccttgcaacttctatctgcacgcaccacatgcatgcacagtctctgcgttgcctgcgcatcccggctcggccaaacggctccctgcctgctcaggctgcatcatctcgcctcgcgcagctccaggcttttcacagggcttcgtcccacacaagctcagccccaatagctctctcctcatctatcacggccccttcatcaccccacagcggcccacacgcacaggggccacacagcaacccgacaaggatcccatacacacactccatttcaactggccgttggaacaaccactcgctaaggcttacagcttaacacgcctttctcgacctcagttggccccaacacaccaccgacgaacaacagacaaaagaaccacgcccactcgcaacccgacgcggggtgtaaattaccgcgcgccccaaatatgaggggcgggccgcgagacccacgccatctccactcaagacgggagcgtgactccccccacgcgaaacacccccaacgaccagtagtcgagaggaagcccccccgacattacagcaaggcggaggcggtaatacaaaatgtacaccgacaacacctaggtgggcgcgcataacactaatgtcggcccacaaaagaaaacggacggccaccccgagtggtgcaacaaaagaagcgataaaaggcgggatgcacaacaaacgactcacagaaggcaagcccag

SEQ ID NO: 651115 - DNA, 102 bp, Homo sapiens
ctgtacgaagctaccaaatgtgtcttccaaatgtgcgcatctattttgtgttcctaccaggaatgaatgggaattcctgttgctccacatctcaccaacatt

SEQ ID NO: 651116 - DNA, 852 bp, Homo sapiens
acacctgttccttggcaaaggcaatcaccctcttccaaagagagctccttgctggagtgtaaacccagcaggttggccaggtgcagtggctcacgcctgtaatcccagcaccttgggaggctgaggcgggcggatcacctgaggtcaagagttcaagaccagcctgaccaacatggtgaaaccccatctctactaaaaatacaaaaattagccgggtgtggcagcagctgcctgtattcctagctactgaggaggctgaggcagaaggatcccttgaatccaggaggcggaggttgtagtgagccgagattgagccactgcactccagcctgggcaacagagcaagactccacctcaaaaaaaaaaaaaaaaaaaaaggaaaaaaaaacccggtggccttggccaaaagctattcccgggtgtcacccttgagcccaaagccagaggtgacagccgcctgggttcccttttcacgcttgccctttaatagcccggggactacgattggtatggtggcctcttttctcatcccactggaattaagaaatagtggtctttctaatcatatgcgggataaagaaggggaaatttataaaaaagggaggaattgcgtggtggtattctcacacagggtcttgggcctttaaatatgtggaacatcaattaattacttccaaagggaaattgttctgggggggtgtgtagtgggacacaggcgttgtaatcccaaaaattgtggagaggccattggcaggaggatcattggccctaggagttggaaccagttggaacatattggggcggttttggaaaaatttaaatccgttggcagggtacccattggcagattga

SEQ ID NO: 651117 - DNA, 361 bp, Homo sapiens
  misc_feature (331)..(331): n is a, c, g, or t
  misc_feature (333)..(333): n is a, c, g, or t
  misc_feature (335)..(335): n is a, c, g, or t
acagcttaaaaaagagtatcctaaatttgaacacaaaaatatgatttttccttgaactgaattaatgaaataaaaccttttcttttcttttcttctcttttttttttttttttttttgagatggagtctcactcttgttgcctaggctgcagtgcagtggcatgatgtcggctcactgcaacctctgccttccaggttcaagggattctcctacctacgcctgacctcagggtatccacctaactcggcctcccaaagtgctggaattacaggtatgagccaccctgcccggccgaaacctttccttaaaagtcaaattcggctgggtgcnangngcacgcctgtaatcccaacactctgg

SEQ ID NO: 651118 - DNA, 345 bp, Homo sapiens
aaaaaaaaaaaaaaaaaaaaaaagttgggggcggcctgggccctgaaaaattttaaacccttcgtgggggggggggccccacagggtcaagtggagaacctggggtcacataaggcctggtccccccaagggaaaatccggggtccatgaactctatgatgctggggttcgctctccaccacaattaaaaaaacgcccggggggggacacaccaggagcgtgttcctggaaccaactctccacaagaggggagtctcggagggtccatcaacggggtctcctcatacaaccgggatgccccaagggagagacccaatatcaaaattcaccccccgacgcgggaga

SEQ ID NO: 651119 - DNA, 323 bp, Homo sapiens
ttttccaaaaaaaccaattttgggttatttttttttttggtgccgggggggtaaccgttaactcctgtaaaagtttggggtttcccccatgggtggtctctctctctgtaatcccccttgccaattttcccccgggcagggtttttttattaaaggggggctttggccccgtttgcttttatttagccgggacttcccgatggttttaattttcgatgctgtggtggcccccctatggttttttggggttttgggcggctctcctttccttgtttgcccgggggggtcgttgctgttgccccataaaggttgggggcgttcca

SEQ ID NO: 651120 - DNA, 309 bp, Homo sapiens
  misc_feature (43)..(43): n is a, c, g, or t
  misc_feature (212)..(212): n is a, c, g, or t
gcctttttttttataatttttcctttttggttccccccactcngggggtaaataaaaaaatccccccctttggggggggggtttgcccctttttcccccgcccgggtccctttttccaaaaaattttttttgggaggaattcccttttttttttttgttttagaaatggccccccttttcccccccccttgggccctccaaaaaattacccngcccctaatggttttgtctcccctttttttttttttcttcccggccctaggttgggcctttggggggctccaaaagggttttggttggggtgtttta

SEQ ID NO: 651121 - DNA, 242 bp, Homo sapiens
ggcggtgtctagaggatccctaagagcggctgcccaattgtgatttgctggttctttgccttaggagacagatcaataaatactgctttgatttatgtcagagtgtcctacctatgttttcttctaagagttttatggtttccagtgttacatttagatctttaatccatttggagtttattttggtgtatggtgttaagaaaatattcttgagaccgctcttaccgagaccgctcttaccg

SEQ ID NO: 651122 - DNA, 357 bp, Homo sapiens
acgttggggaaatacacatgcagagatcacccgttcacccacactgcgtctcactccagtccaaaggacaaatttccaccaatctaatgtccattgctcgtgtttcttggcccaagcaattggtgtcctttagtagtggttggttcctttgcagcaatttgaccatgaaggcctgattcacgtaggctcctctgaacagttcatgttgagatgtgtctgttatttgaattctgtgaagcaattatttgggttgcaatttctgaggctggtaactctaatgaacttctcctctgcggcagaggtatctctgggtctttcatagttttgatgtatacactattattctatgtcgacgcg

SEQ ID NO: 651123 - DNA, 424 bp, Homo sapiens
  misc_feature (228)..(228): n is a, c, g, or t
taaaatgcactctcaatgctattgggaaaacttactttatttccacagaaaattcttcttcaaatcctctgcaaaaaagctatttcactcctcctgttctcaaatcttgaacacgtttctccctggccgctccactcataacatggtcccactctatatgaaaaaagtagaagcactcagacccaaactccttcattctcacccttcacatttgtgaaacccatattntaggtcttctcccatttcaacggaagaattgtccttgatcaatcaaaagtgatttcctctggatctcatctcttgtggaattctcaagtcccagcttctgcaattagcctccctcattgtccggaattattgcttttctccctttctactatgtgattccagcagcaaacaagcatgttagaatgtcctgtggttt

SEQ ID NO: 651124 - DNA, 910 bp, Homo sapiens
gggcggatgaacgccggtgacagcgggggggcccggaggcccttggggccctgggatggggaatcgcggtggcttccgcggaggtttcggcagcggcattcgagggtccgtggggtcggccggacgatgtgacggggaccggggccgatggtctgcgtggaggcctcgcggaggcaacggccgaggactaaggagtggatgctcgcgctgagcataggtggtggccgcattgtgtcttggggaccatgaacgatcaagatccccgttggaaggacgattcttactctctgttctcctctgtggcgcatctaaggaatcagagattcatttgatgtgtctttccgtgggggcctcttctcaacggatgatggtttgaagatctatgccacatgttgcaagaaggcaaggacaccgtgccggccaggcgacagccaggttcacacggtcattcgttcgctatcggggtactacaaagtggccaagtcggtctgggtgttaaggtggtccacacggaatggttggtcacgcgccctctccgttgtgggtcattcatcctggctcataagctcgtccatcgatccctcgatgcctgcaagagcgtgtactggtgggaagcgacgatcgaggccttgacactgtgccattgctgaggtggagcagggcggctgcgggtctggtgctggtacgggtctagtcctgcgaccacagggggaccgtggtggtcgtacttcgggatgctgttggctaacgaatgctggtcctgagtgggtggtatggatgagggttaaccctcagccggggtgtgaatggtcacctgggaaatttcggcaaggcacctttgatgcattttaaccttaaataactgaacgcgacttggagggatgttcacaatctccatagcgttatggat

SEQ ID NO: 651125 - DNA, 89 bp, Homo sapiens
  misc_feature (54)..(54): n is a, c, g, or t
aattcaagcttctcgatgtacggggacatggttgtggttaatctggtgttattntttgttccacaagttaaataaatcataaaacttga

SEQ ID NO: 651126 - DNA, 354 bp, Homo sapiens
acatcgcccaccgtaaaggctggctgtcgctgcacacaggtaacctggatggagaggaccatgccgcagagcaaccggtggaggatgttttccttcgcaagttcatgtggggtaccttcccaggctgcctggctgaccagctggttttaaagcgccggggtaaccagttggagatctgtgccgtggtcctaaggcagttgtctccacaaagtactacttctcgtggctcagtaaactttgctgtctactttacaatgtctgtgcgactcactcaactgtgcctaagtgtgtatagtactctgacatccctttttcatcagcttagctcgaatgaacgtggaagattgtattggg

SEQ ID NO: 651127 - DNA, 337 bp, Homo sapiens
ctatcaagcaaactgaatatagatatacaccacatatagatacatagaaattacctacaatggcttgtagctctaaatgtaagagctagaactgtaaaacttctagaagaaaccagtgaagaaaatcttcataaccttcagttcagaatacagttcttagttacaacaccaaaagcacaacccatttaaaaaattggtacgtaaaactcactcagcatttaaaacttttgtgcctgaaatgacaccatcgagaacatgaaacagataagccacagacagggagaaatatctgaaaatcctatatagataataggactagtgtctagaatatactaaa

SEQ ID NO: 651128 - DNA, 247 bp, Homo sapiens
tcaacgctttatacttcctcaggctaatatgttccgtattgaattcaaggtataatattaggtatgcaggggaagtataaagggtagagaagtataaagcgtgagaagtataaagcgttgagaagtataaagcgtagagaagtataaagcgttgagaagtgtaaagcgtagagaagtataaagggtcgggaagtataaagcgtggcacaagtataatagcgtggagaagtgatatacagcgttgcag

SEQ ID NO: 651129 - DNA, 743 bp, Homo sapiens
atcagtagcatctgtaacagcgttacctgtcttaaagagagagagagagaattccgaattggggaacacacgataaaaaaaaaaaaaaaaaaaaaaaaaaaaaaaaaaaaaaaaacaaaaccaccaacaaaaaacaaaccaacaaaaaaccccaaaccaacataaccacccaacacttttttggagctcacccccccaatcccccctataatcagtcgtcctccaaccccctccccgttgccccccacctaccccccccgtaccacccccgccctcccccatctcaacccccttccccccccccccccttccgccagctggcacaataacaaaccggcccccaccgacccccctcccaaacagtttgccaaccctgaatgcccaacgcaacttgaatccttaattatttttgaaaaacccgtcttacatttctactaaaccaacccatttcccccccaatgcgcacacacccgccacactccctaaaaaacccaaaaaacccacccagaccgggccccccgctcccccccggaccccccacccaccccccatccgccccccgttcctacccaccaaaaccccgaacacccctcctatcccccttatgtccccccctccaccacccaatcactttaacccggtttctgcgccccccacccccccaaacccgcctcaacccgccccccctccagccaccccctattttatacatggcccaataacccccccgccaacccggcgcc

SEQ ID NO: 651130 - DNA, 246 bp, Homo sapiens
cgacgacctacgcacacgagaacatgccctctcgcaaaggatctccttcatccctctccagaggaggagaagaggaaccacaagaagaacgccttgtcagagccccaattcctacttaatggatgtgaaatccccaggatgctataaaatcaccacggtctttagccatcacaaacggtagttttgtgtgttgctgctcactgtctctgcagctacagagggaaagcaaggcttacagagggtgtt

SEQ ID NO: 651131 - DNA, 204 bp, Homo sapiens
gacagagtgacactctgcctcaaaaaaaataaaaagcaaggaggggccaggtgtggtcgtcacgcctgtagtcccagcactttgggaggccgaggtggatggatgacgaggtcaggagttcacgaccagtctggccaacatggtgaaaacccatctctactaaaaatttgaatttttttttcaacactcttacacctgttatgg

SEQ ID NO: 651132 - DNA, 290 bp, Homo sapiens
ctcaagtgtatacgaagtcaatagtgaatctgcagtatgacaaaaggtatcattcatcataagatcatgccgataagtcttgtaaattatatacataaattctcccacagattctaagcagtagtctgtaactgggcagttaacttatgcacgcttacctctcttaccaagctttgagtgcaagagatagaagagttcaaatctgaccaagatgttgatgttggataagagaatactctgctccccacctctaagtggccagccctcctagagcgggaggttattggcat

SEQ ID NO: 651133 - DNA, 500 bp, Homo sapiens
  misc_feature (400)..(400): n is a, c, g, or t
aggtctggttatgctgcccaggctggagtgcagatattttctggtgcaaccacaggggactgcagctataaactgctgggctaaagcgatcctaccgcctcagcctaccaagtatgttgggactagatgcacgcaccacccgcctgactcaggacattattcttaaaggtattatccatgaaacagataacgtcattcataagacacacggctcatactctttagctcagtgtgaacaatgaaagtagattccactattgaagcacaagttgtgaatgggtgacatagtgaacatattgctgtctgaaagggagatcagcgaggcgtgtatatgagcacttgaactgttcaaggcgacataatccagctatctgccacaaagaatttacattgcacgatntgatgtgcctcagaggaagacactgacgacatttgaggtcatgcactctttatgatcaacagaccataccggtcgagtgtctttaagctgctgacatcgg

SEQ ID NO: 651134 - DNA, 312 bp, Homo sapiens
attattcgtaggctaggtagaggcgtcggaccagggtatgcaaccacttgtacaggttcattcgcctctagaggtagcctaggtgtcagtttgtcctaaccttcaaggtcgcgattcctagtgtgccataccataccttccgatcattcgaggtctcccatctccaccccactgttcaacttttgggcttgtacaaaaaaccaactcaataagcagtttccttgtgcacttaaccctaagtgtgtttgtacacagagcagatttcattttctttaggagctaaccaaccggggcctacgaataactcctccg

SEQ ID NO: 651135 - DNA, 480 bp, Homo sapiens
ctatcacgcaccacgatacggccgggcagatatgcggtttgatatagaaatcggttattatttctaactatattaagtgcttgctgtcaatatcataatccagacaagatgttctgtggtccctggatctaggagaatgaagacgccactgacttgctctccttggttgtccaggaaggccaccctaagaatacaacaaaaccttgatttctttagtccacgtgtgtgtgtctgtgtctgtgttgtaagtatgcgtgcatttgggtcctcacctgatgaagaaaagtgagaaatctagtatatttgtgggtacaaggtgtctcagagttgatgacatgcatctgtgcttttccatgatcatctttgatgtccaaaacggtatgagactacttcgtctagtagacaatatatgtaaattaagctgcataaacaatttagtcattagcctcaattctcctaattagtaaagattggaaccaa

SEQ ID NO: 651136 - DNA, 256 bp, Homo sapiens
  misc_feature (31)..(31): n is a, c, g, or t
  misc_feature (36)..(36): n is a, c, g, or t
  misc_feature (66)..(66): n is a, c, g, or t
  misc_feature (85)..(85): n is a, c, g, or t
cttggccctcctcctcgcccacgggcctcanatttnaggaccctcctcctcgcccacgggcctcanacctcaggaccctgccgtntcacgcctttttgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatgg

SEQ ID NO: 651137 - DNA, 1409 bp, Homo sapiens
gacctctcttggtccagcgagcgttgccgggccaggtcaagcggcagggctccgacggcgcggacgcgagcgacagcgccgagccatggacgcaccaaacggcgcatccacgccacgcgaagcagctgcaaggaattctcttgaccaaggacacgggcctggctctgctgccggctcactcacacggctctgtcgactccgaccagaccgaggcacgcctcgctgccctgaggctgccctcgacaggacgcccacgctacggccccgcatggcgtactcacgcgaccctaatgcaccacgcgcccccgcaaacatgacacaccctgccctgccgcacagacacacagcaccagaccccccatgaccatacccccatgcctccctaacccgacaccatccagaaccactcaccacgcacactcgccactccaaccgccccctctccgcacaatgagcccttccctcctccccttccggcccctgggcctccggccccctgccactacaccctccaccacccggcctgccccaggcccttgcacccgcacctgcccctgcctccccccgcccgcgaccccaccccccgcgcgccccccacccacgcctgcacccccccccgcgcacgcctccccgcgcacacccgcctcgcgcccccaaccacctccaaccacgcccacctccacccccctccacaccgcgacccacccctcgcctcgcacaaacccggcacctcccacccccacacacactccctccctaccgcccctcgcaccgcactatcccaccgccaccacacccacccccctcggacccagccacaccgcacctgccaatagccccgcacggcccaccccccatagccccccaccagccccacacgccacccccacctacagccgccccctcgcacccacaccgccaaccgccaccgcgcccatcccacgacctcccccccgccaacactccccccgccccccccccaaaccccccccgaccaccgcaccgccgacccgcaccccacgagccccacaccacccaacgccccgcgctcgcgccaccaccccacgccccacacaccgccccccgccccaaagcaccacacccccctgcacacacagcacggaccccccacctccccaccccccctcctaccaccacgcccccccactctcacccaactccacacacctagcaacaccaatcaccccccaaacccacgcaaccccccacacccatccccccccacaccccccccaccccctctccccacaccgccccccaaccacacaaccccacacctctccaccctccccccccacccatcctacccaccatcccccccaccaccaccctcccacccccgccccctccccgaacccccaaatcacaacccaccaccccgcgcccaa

SEQ ID NO: 651138 - DNA, 750 bp, Homo sapiens
caagagacctcctctgcgggggtcgcaccacagacccgcgaggaggagagagaaaaaggcccgtcccctcccgctgtttggtccccccgatgtctccccgtggttagagagtagtgttcgcccctcataacacaggacgcccccccgcccacaatccgtctgtgtctgtccgcccccctctacagggggcaccaccactttgtgttccctcacaccacagcggtcggtgccactgcgtggcccaccaccactctcacaccgtctctttctgttacgcagccgccccctctctagtggggaagttcaccccgcccctcccgcgcgcagtagtaccccgcgcgtgtcacgcgcgcgtcgcacaaagcttctttctccgccgcacgcgacgccgcacgcggaggggttcttacaccaggcccccaccagagagacactaggcaggtgcaccacaattcagggcgctattaagagattgcgtgtgaggagcagccgcaaacaatggtgtccgcccggagggacccccccgacgcgccgcacagaggttgttaatgggcacttcttctgaaatagtaataatttctatgatacggcacgttagtgtgctaactctccccgcacttgtgctagtttctgccgctcttctccgcgcccctttatgacacgctcgttgagaccccacttgtctctcccgttacaacaaacagattctctcctcccaccctgtcaaacacccccactaatagtcagaaa

SEQ ID NO: 651139 - DNA, 201 bp, Homo sapiens
  misc_feature (171)..(171): n is a, c, g, or t
ccgctgccgtacagttgcgtgtgtttctcaggccagtgctggtgtgcgctcccagcaacatcgcagtggaccagctgactgagaagatccacatgtcgggcctgaaggtggtgaggctctgtgccaagagcagagaggccatcgactcccccgtgtccttcctggctctgnacaaccagatccgcaactggtacggcggga

SEQ ID NO: 651140 - DNA, 426 bp, Homo sapiens
ggaggtatgtttttgacaaattgaaggaattatacaaaagtttcatttattctttagggtgaccctgggaaacctggagaagcaggaaatgctggagttcctgggcagagggtaaatatacattttctgctaaagaaaaataatgtaggtactatttaaattatcatagactcacctcacaaatatctgtgtgtgatactagggagctcctggaaaagatggtgaagttggtccttctggtcctgtgggcccgccggtatgtgatttttgtgtgtgtgtgtgtgagaatatatatatacacacattgcattttttcgatgatgtttgttcaagacttatgcgtaagtttcagggaaagtgaataagaatgtatgggaatgaagaatttctgttataccttctcttttgatttctgtgagataatgt

SEQ ID NO: 651141 - DNA, 173 bp, Homo sapiens
ttacaccttcctagcagtcccccatagtcttaacttatttgagcattaactccaaagtccacagttcaacatctcatccgagacaaggcaagtcccttctgcctatgagcctgtaaaatcaaaagcaagttcgatagttgatatacatgggggtacacggcgttggttaaata

SEQ ID NO: 651142 - DNA, 129 bp, Homo sapiens
gagctcggaccctaacgcaaacccccgacttcaggcgatgggcggagtgtgtatctgtgtgtggagtgtgtgtggtgtgcgtgtgtgtggtgtgtctgggtggtgtgtgtactgtgcaatgtgttttgt

SEQ ID NO: 651143 - DNA, 113 bp, Homo sapiens
  misc_feature (109)..(110): n is a, c, g, or t
cagcggtctctcaacacagggccacagagctggagctggatctaccatgaaagacctctgaacccaggaagagagactgactgagcaacatgttattcatgggtctccnnatc

SEQ ID NO: 651144 - DNA, 416 bp, Homo sapiens
ttgagattatagctagcacgctgaaaccccatctctactaaaaatacaaaaaattggctgggcagagtggtgggcacctgtaatcccagctactcaggaggctgaggcagaggaatcacttgaactgggaggcagaggttgcagtgcgccagagatcacaccactgcactccagcctgggcaacaagagctaaactccgtctcaaaaaaaaaaaaaaaaaatttatactttcagagactattggctgacatcataaaatgcccaacatttaagtaggggatgcaatataacaaattaagtcacttttctcctttacaaacctttctctcccccttttttcacacacattggacatttcttacgttcatttacgcgtgataatttcctaaaaggaaaaaccacctgaaatttaatgc

SEQ ID NO: 651145 - DNA, 828 bp, Homo sapiens
cggctaggatgtttaaatgtctaaacagcaggagttttggtgagtgaaaccggcaaggattatctgagaaagggataagaagaattactgggaaaagtagtggtggtcaatttaataaataacttctttttgaagagcgctcaccattagtaattgtaattgaaccctcttaagcagataagaccatccttaatgactagcattcacagaccttagaatgctcatcttaatcttttctgctttcctaaagagatactgttggagaggtggccttgtaggtttgtgcatatatccttcagggtaagtgcattagcccgaagttcctctgaaatacttcttaatggggtttttatttgaacttgggtgacaattaaagggtctcactgttgaaccgtccaacagtgaatagagtatcttcagtctcagggtgatcacagcttcttccttgaaaactccctgtctcatttcagtctgggctcttaactttgcccttagccactggtaaatgtatgggcactttagatgatcagaccccagtgtttgcttggtgtttgacctctgtcccttggggggcaggtggcaagctatctttgagtctctttatcttttcagctgggatacttcctaagaaactgcaacacacgaaaggtgtcaaaaactctgcagagaagccatttaagcatgggttgctggggtacctggtgactccattaagacttgcccggggtttgaattcctaagtcctggccattatgttgccaccggcacagtaattaacccggccgtcaccaagtttccctccccaacatggaataaaataaacctttt

SEQ ID NO: 651146 - DNA, 1161 bp, Homo sapiens
tcgaacacacgtcgtccgtctaccgttgactatatctctacaaaccacaaatgacattgtgaacactatacctattattacggcgcatgagctaggagtcctaggcacagctctaagactctccttatacgagccgagctgggccaggcaggcaaccttctaggtaacgatcacatcgtacaaccgtctatcgtacacagcccatgccattatgtaatacatcttcttcatagataataacccatcataatcgcgaggcttcaggcaatctgactagtacccctaataatcggtagcccccgatatggcgtactccccgcataaacaacataagctatctagactcttacctccctctctcctactcctgctacacatctgctatagctggaggccggagccacggaacaggcttgaacagtctaccctccctttacgcagggaactaactccacaccctggcagcatccgtagacctaacccactcttctccttacccctacgcaggtgtctcgctctattcttaaggaggccactgacgtatccatcaccaacaaactgagtcagtaatctggcgccccctgtccatcatagccaactaccgacaccgaccaatactacggtactgactccgccctacactctcgcaccagagcctagcgttcgttctaagtagtctgaccgctgtccatcatctgccgggtcagtcacgcataacgtcaccaacaaggaccgcaaccctcacaaccacacattcactaggaactccagacgctatcaaggcatgcgccgcactcccccaacccacgtacatctcatcctttcgtcgcacacccgtcaactagcccacttaatcatcaccacaggcaatgagcggacaacaaacacccgcatcttagagcgtgctaccctcgcaagccatcccacctgatctgcgtgaacacaagccttgagccctgcgcaccctatcgtcatcgcgcctcctcatgcgttacacgtctacacctcccaacactataaacgatcgtaatatgaccgaacagcgaccacatatctcatcgcgtaccaacttcgctctccgactgattccagctctacgcattactaccacgagaaagcgagaaaactacgacgcgcgcacaagacatatctacagtgagt

SEQ ID NO: 651147 - DNA, 106 bp, Homo sapiens
agccttgcgcagctctccaccttctccccgccaggcacaggagccagcagctggagcgtgctctgagtttcaggggaggccccccccctcaaaaaggatgggggct

SEQ ID NO: 651148 - DNA, 814 bp, Homo sapiens
  misc_feature (59)..(59): n is a, c, g, or t
  misc_feature (76)..(76): n is a, c, g, or t
  misc_feature (106)..(106): n is a, c, g, or t
  misc_feature (325)..(325): n is a, c, g, or t
  misc_feature (537)..(537): n is a, c, g, or t
  misc_feature (599)..(599): n is a, c, g, or t
  misc_feature (617)..(617): n is a, c, g, or t
  misc_feature (623)..(623): n is a, c, g, or t
  misc_feature (638)..(638): n is a, c, g, or t
  misc_feature (649)..(649): n is a, c, g, or t
  misc_feature (671)..(671): n is a, c, g, or t
  misc_feature (679)..(679): n is a, c, g, or t
  misc_feature (686)..(686): n is a, c, g, or t
  misc_feature (697)..(697): n is a, c, g, or t
  misc_feature (717)..(717): n is a, c, g, or t
  misc_feature (720)..(721): n is a, c, g, or t
  misc_feature (804)..(804): n is a, c, g, or t
cttggacattgtctttaaattcttgtcactggcccaatctttttcttttgtttttggtngctgcgagctggactanaagttacattcttcagctaatacgtgcttntctaatattttccccgagatattacatttagaaaatacgcaaagaaaccttttaggagttaacaaaacgcacccgaactattcattataaaggaaagaataaaaaatccataaataatacattgtaatcaaataatataaagtattctgcagacataattttttttaattaataaactccttttaatttactcaccacaaatattaaaatggttcaagngcacttgtttaattaataaagcattttatatgcaattattaaggtgctaatcattaggaagtttacgttggttgagtgcaaatcactaggctcagacattaaaaaccattataaaaatataggctacaagggtcaggtatcaaattacccttccatagggacagctcaagggacagcttctatggtggatactgaggaatactttttttaanacacccaatatccctgctcaaaagcacaggaaaacctcaaggagcaggtgacatggaagggnagcttggaaacacagggnaagggncctttcccaacaaangaaaatagggngggggtccacaggcatatgggngattattnagttttnaatagtctggnggtaaatttttaaaaggtangannttaatttgtcaggccttcggctctggtcttcctccagctcttggggcttccttttttcgtttccccgtccttcacctcctgcngggaaacggg

SEQ ID NO: 651149 - DNA, 122 bp, Homo sapiens
atttccatttattcaagtcttttaaaaaattttttaaagcaaaacttttatctccttggttaaatttattcctaggtattttattcttttggatgctattataaatataattgtttccttga

SEQ ID NO: 651150 - DNA, 191 bp, Homo sapiens
tcgatacgactaatttttttgtatttttagtagagacagggtttcaccatgttggccaggctgatcttgaactcctgacctcaggtgatgcatctgcctcagtctcccaaagtgctgggattacaggtgtgagccaccacgcccggccctatgttgtattttttaaggaacctcccttctgtcgtcttctc

SEQ ID NO: 651151 - DNA, 348 bp, Homo sapiens
ccccccgggggcccctacggccagggggccaaaatcccttttcccaaattttttttctcaaaccaagaaaaaacccggaatgttcaccatgagctcccccttaaaaaaattttttcaaaagaatccccctgggctaaaaaagggaagggcccatttttccgggaaaaaaattttatgggggtatttacggacccggctcaaccaaaaaaatttccctataaaaattccccagagctaaccccagggctttttaaaaaaagaccaaagggaagttttgttttacaaatcaaaggggacaaccatccccaataaaaaagccaaaataaaatttttttttaaggcccccca

SEQ ID NO: 651152 - DNA, 220 bp, Homo sapiens
acttcacagagctgttaatccattctggggaggagagaacttagccatctgctcacattctgactaaagttaatttggcacttcaaataaaaaaaaaaaaaccccccaaactggatttttaacccaaaaaataactaattagcaatgggtttttaccaaaaaaggtcccagtcttatccttgggaaaaacgtggtagaccggaaaggaagctacttaaag

SEQ ID NO: 651153 - DNA, 194 bp, Homo sapiens
tcgatggaactgtgacagatgggtaccctggctctgacatcctggcccatgattacagtggactacaccaacgccttcaaaatcgacctcgcacatcactggccttcgtattacatttcacagatgaattggttcccagtggcaaacaatatggtttagtatgtcagcatgaccaatcggattaggtggtatag

SEQ ID NO: 651154 - DNA, 681 bp, Homo sapiens
catgcgggttgctggggccacgggatgctgtcctggatgcctgagagctgccgttgcgcttgtggcgcccatgcacagctccccggtctgcgccaagaaccgggctgtggcctgagatacaactgtacatgcaaaggagggacaatgcctggatgatcgtacggagtgagtgcacacggctgcccggactacgattcgcacctacacgctaacacgagcttgagctcgtcctgcgtggctatcactaggggttaagcccttggtagttcggagatggacgcatgcccgtcagagcggaactggtggaggatgtttgtcctctcgcagagtttcatgtagggcgtaccttcctcaggctgcctggctgagcagctggtatttaagagcgccgtgggtcaccaggtttggacgatcgtgtgccggtgtgtcccgttggtaaggaggccaaacggttttcgggaattaccttttgccgccaaagcagaatctcgaccaaaggggttaacccgcttaagtcgttattacccctttcgagattgggaggaccttaagcgaacgggttagaaaagacctttctagtcccggtgtcgcttacctttattgtaaacggaacttggtagcttggttggcgaggaaactttcccgacccttcccaacaattggtggccaccccttccaaga

SEQ ID NO: 651155 - DNA, 587 bp, Homo sapiens
  misc_feature (110)..(110): n is a, c, g, or t
  misc_feature (119)..(119): n is a, c, g, or t
agaggattcaccggcagaatcacactcaaattatggagagcagcctgctttactcagtctacccattcatatgtcaatctcatccaaaaacaccctcccagacacacccngaacatatnactgaatgtttgggcaccgcatggcccagtcaagttgacacatgaaagtaaccatcacagtagctaaaactgaaatccacaatttaggataacagaggaaattcacttgactcaccccaaagtcaaaatgccagcctagtctccaggaagacacagttctcagccactagagaaagcacacgtgttttgtttcagatggtcatcttgaggaagcgaactcagtataacgcaacttgagatggacacttaataaatgtggttttgatcaaattctcataataaaaccgcacagaagaacccaatgtctaatgtttccattcacccaagctcaaggaactttgtacctcagggcatctgagtcagagagccgcttagcgactcaggcccggtgctgacaaaggaggctgcctgagtcactgaggctgagtaactggccctcggcacaggacaggagtaaactactcctga

SEQ ID NO: 651156 - DNA, 125 bp, Homo sapiens
ttgagtgcaatgagctatgactgcactccatcttgggtgacagagcaagaccctgtcacccaagatggagtgcagtcatagctcattgcagcctcaaccttgggtgacagagcaagaccctgtca

SEQ ID NO: 651157 - DNA, 758 bp, Homo sapiens
caaccaccactcaccgctacgcgcgagctgggttgttaatcgccgcaggcttgagggcagccccatgcgccgcaccccgctgcccaagcatttatgagattacccaggagacagccctggctactctcgaaattggacatgcgaggctgtgcccagggccacctgctgccctggacgtccagcctgagtgaagccgaggaccatctctgaccaccctggcaccttaaataagtgaatgaggcccagattgtgaacacggacccatatatccctacctcccaccacctctgtcgagaagacacgaaactgcccgtgagttcaatagctcggagagaggtccagagtggttcctataagtgaaaaactatttacatacatgacctaggggatgtgcctaaaaccctttcggtggatcatgtcccatcagtccccccactagacacagcgtcactgccaaggcatcaaggccactcgggctcagcagtgtcactcacgctcaactactcacgggtcatgcgcacgcgttctgcacatccttgtgtgtgtccaccctatgtctctgacacctggcgacagtgtgtgctttttgctaccttaggcatgtggtcattcccccacacctgccctgcctccttcacggatctcgaacctgaccttcctggcaggcactggtgggcagctcagactccacatgctggctggtgcctgacggtctgctggctctactatccttgcgtcctctactctccccctcatcc

SEQ ID NO: 651158 - DNA, 108 bp, Homo sapiens
  misc_feature (23)..(23): n is a, c, g, or t
agttcgacggagactctcagggnagagaggtgtgtcaccttcaacaatttttaaaacaatggataagaaatggagccagcgaatgcatgattcatgcagcacatctca

SEQ ID NO: 651159 - DNA, 659 bp, Homo sapiens
  misc_feature (17)..(17): n is a, c, g, or t
  misc_feature (73)..(73): n is a, c, g, or t
  misc_feature (88)..(88): n is a, c, g, or t
  misc_feature (93)..(93): n is a, c, g, or t
  misc_feature (98)..(99): n is a, c, g, or t
  misc_feature (126)..(126): n is a, c, g, or t
  misc_feature (138)..(138): n is a, c, g, or t
  misc_feature (171)..(171): n is a, c, g, or t
  misc_feature (215)..(215): n is a, c, g, or t
  misc_feature (224)..(224): n is a, c, g, or t
  misc_feature (250)..(250): n is a, c, g, or t
  misc_feature (259)..(259): n is a, c, g, or t
  misc_feature (317)..(317): n is a, c, g, or t
  misc_feature (319)..(319): n is a, c, g, or t
  misc_feature (337)..(337): n is a, c, g, or t
  misc_feature (341)..(341): n is a, c, g, or t
  misc_feature (350)..(350): n is a, c, g, or t
  misc_feature (363)..(363): n is a, c, g, or t
  misc_feature (373)..(373): n is a, c, g, or t
  misc_feature (383)..(383): n is a, c, g, or t
  misc_feature (398)..(398): n is a, c, g, or t
  misc_feature (423)..(423): n is a, c, g, or t
  misc_feature (427)..(427): n is a, c, g, or t
  misc_feature (437)..(437): n is a, c, g, or t
  misc_feature (439)..(440): n is a, c, g, or t
  misc_feature (451)..(451): n is a, c, g, or t
  misc_feature (454)..(454): n is a, c, g, or t
  misc_feature (463)..(463): n is a, c, g, or t
  misc_feature (465)..(465): n is a, c, g, or t
  misc_feature (478)..(478): n is a, c, g, or t
  misc_feature (487)..(487): n is a, c, g, or t
  misc_feature (489)..(489): n is a, c, g, or t
  misc_feature (493)..(495): n is a, c, g, or t
  misc_feature (503)..(503): n is a, c, g, or t
  misc_feature (522)..(522): n is a, c, g, or t
  misc_feature (526)..(526): n is a, c, g, or t
  misc_feature (528)..(528): n is a, c, g, or t
  misc_feature (543)..(543): n is a, c, g, or t
  misc_feature (569)..(569): n is a, c, g, or t
  misc_feature (573)..(573): n is a, c, g, or t
  misc_feature (580)..(580): n is a, c, g, or t
  misc_feature (590)..(590): n is a, c, g, or t
  misc_feature (640)..(640): n is a, c, g, or t
ccgtaagtcatacagtnaattcttatgtatcaaagtccgtgtcgtaggtaacagcagtagtccagtccgtagnaaagtagtcagtccngtctncaagnntaagtcatacgttaatctgccaacgtncgtgtgttaaangctcatccactccgcagtaatgctgtaatgtcnacttccgccgttagtcagccagtcagtgtgtctgtcgtccaaangctccagtnacgtcagtccagtcatactcgttaanacgtcactnacgtccgtctcgagtcagctcccagtagttcccacaatagtccgtcgtcaaacacgtnantcagtgtccccaaaagtnaaancaaaacccnaaccaatccattnaaagtcatcnaaagtccctntcttttttcagtccngagtaagtgtaagtaaaagtcaaantaangtagtcgttntnnaccccccaaanccncgtagtagntntcagtcaaaagtnatcccccanancgtnnnctcaaagncccaaaccccaaaccccancgtnancccccaagtcagtcnaaaccaagttaaacaaattcgtcaancccncccgtantcattcaccnacccatccccgtcaactcccaaacaaaagttcccacaaaaaaagttaaanagcaagtgttgtaagtttt

SEQ ID NO: 651160 - DNA, 423 bp, Homo sapiens
  misc_feature (1)..(1): n is a, c, g, or t
  misc_feature (141)..(141): n is a, c, g, or t
  misc_feature (154)..(154): n is a, c, g, or t
  misc_feature (159)..(159): n is a, c, g, or t
  misc_feature (170)..(170): n is a, c, g, or t
  misc_feature (176)..(176): n is a, c, g, or t
  misc_feature (181)..(181): n is a, c, g, or t
  misc_feature (214)..(214): n is a, c, g, or t
  misc_feature (327)..(327): n is a, c, g, or t
  misc_feature (365)..(365): n is a, c, g, or t
  misc_feature (414)..(414): n is a, c, g, or t
  misc_feature (419)..(419): n is a, c, g, or t
nggggctgcggacggacaacatcagactgaatcagaagtgcggccttctaggaaggactcacttcttcgggacttgtaagaaaaggtggacaagaccgaactgcttcaccggcgcctggaatccctgaagagccaccacgntagcctcactttntcctncagaggccatnaggcancacgntcagggaggccaaagcctttatcccttcttgancagatcgatgagaagagtctgccaaaccactttcatcctcaggacgtgctgtcctgctttattttaccttcgttgctatttaaaaaggcctgtgttcatttggggacggggantcttatttttgtatttattcttcaaaacgtttttaggnttcccaaatcagtggctggaggcccaaacccggggtttagggatttttnttctngggg

SEQ ID NO: 651161 - DNA, 120 bp, Homo sapiens
tttctttatatgctgtgcgaccaatgaaaagtcgcacagcatgtgtctactgaaacatttttcacttttgctcgcacacctccctcctctaccgccacactcacctctaaaccgggcaat

SEQ ID NO: 651162 - DNA, 441 bp, Homo sapiens
  misc_feature (6)..(6): n is a, c, g, or t
  misc_feature (12)..(12): n is a, c, g, or t
  misc_feature (39)..(39): n is a, c, g, or t
  misc_feature (59)..(59): n is a, c, g, or t
  misc_feature (73)..(73): n is a, c, g, or t
  misc_feature (266)..(266): n is a, c, g, or t
  misc_feature (291)..(291): n is a, c, g, or t
  misc_feature (313)..(313): n is a, c, g, or t
  misc_feature (329)..(329): n is a, c, g, or t
  misc_feature (437)..(439): n is a, c, g, or t
aatggntggggnagaaaataagagactgtgacatttganaaactatgttaaaatcgaanttggactgtgccanagtgtcccccgggcttggtgaatgcccccaagcgtccttccatggaacctctggcggctttccttgctgcagcagtgtttacccacacccagcccaagtcacccttgaacttggaaaatgacttcatgccctccagcccactgaaggattatttttcctctcagcccctagtggtttctttacctaaatgtcncggtacaactgagaataaggcagcncggtcagttcaatagaagtaancctaaagtccaacaanccaggttagatattagccacggagggatgggaggaggagtcttctttttttttgagacggaatctcgctctgtccctcaggctgaagtgcagagtgagactccctcannnaa

SEQ ID NO: 651163 - DNA, 214 bp, Homo sapiens
taagaggtcacgagattgccacatcctggcccaagcgatccgcccgcctcagcctcccaagtagctgggaccacaggcacacaccactacgcccagctaatttttgtatttttagtagagacggggttcaggatggtctcaatctctctttttttttttggaaatggattttggccaaggtggttgtgcgtaacaaaaccccttcattgagccc

SEQ ID NO: 651164 - DNA, 310 bp, Homo sapiens
  misc_feature (60)..(60): n is a, c, g, or t
ggatcttcggcgagtgcaatggctactgtaacattatattgggggtgcattcaatcagtnaagagaatacataagtattacgacagaagaagcaggaagtgtgcggtggctcaacgcctgtaattctccacgctttgggaagcccagggcaggcggatcatgaagtcaggagtttgagaccaacctggcaaaaatggtaaaacccatccctactaaatatacaaaaaattagcagggcgtggtggcgcgcacctgtaatcccagctacttgggaggctgaggcaggagaatcgcttcaaaccgggaggcg

SEQ ID NO: 651165 - DNA, 303 bp, Homo sapiens
  misc_feature (137)..(137): n is a, c, g, or t
  misc_feature (139)..(139): n is a, c, g, or t
  misc_feature (153)..(153): n is a, c, g, or t
  misc_feature (181)..(181): n is a, c, g, or t
  misc_feature (189)..(189): n is a, c, g, or t
  misc_feature (191)..(191): n is a, c, g, or t
  misc_feature (193)..(194): n is a, c, g, or t
  misc_feature (206)..(206): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (218)..(218): n is a, c, g, or t
  misc_feature (220)..(221): n is a, c, g, or t
  misc_feature (227)..(227): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (244)..(244): n is a, c, g, or t
  misc_feature (252)..(252): n is a, c, g, or t
  misc_feature (254)..(254): n is a, c, g, or t
  misc_feature (260)..(260): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (281)..(281): n is a, c, g, or t
  misc_feature (283)..(283): n is a, c, g, or t
tcctgggcgcccctcctccagcttagctgtcagctgtccatcacctctcccgtactttctcatttgtgcttttttctctcgtaatagaaaagtggggagccgctgggagccaccccattcatccccgtatttccccntntcataacttctccncatcccaggaggagttctcaggcctggngtgggccncngnntgggtgcggggncgantcnacntntnngctgcnaangncgnganttcttnttgaacantntgctgntgtanacntntttnaaactantnccaataaagttttgtttaaa

SEQ ID NO: 651166 - DNA, 185 bp, Homo sapiens
  misc_feature (29)..(29): n is a, c, g, or t
  misc_feature (54)..(54): n is a, c, g, or t
  misc_feature (101)..(101): n is a, c, g, or t
  misc_feature (118)..(118): n is a, c, g, or t
  misc_feature (149)..(149): n is a, c, g, or t
ccacggtgccagctctctgcaagattttnggcaagtcacttaacttccctgtgnctcactttcctcatctgtaaagtgggaataattgctacctctgggtnaatgtgagaatcaaatnagttagaatagtggcatataccattttaatntttttatttattttttaaaatttattattattattt

SEQ ID NO: 651167 - DNA, 371 bp, Homo sapiens
atgcctggggccctcccatttgtttcccctggtgtcacctggctccccctggtggggggtgggtttccatttttccctccacccaccctcagaagaatttgtttcccatgccctcaccatcacctcattgcccccaggccttttgccctttttgggtgttgagctccccccccccccacaggcactttatgggaaaaggttttccttttgggaagggggggggtggtaaacccctttgctttttttagccctcttggggtggggttgggcacaaatccccaggcaggttttggagttgtttccatggtgatggggccaaatgtaaagtattcagaaaaaattttgtaaaaaaaatgttttgggggtaggga

SEQ ID NO: 651168 - DNA, 1037 bp, Homo sapiens
gtattcttcctgtctaccgctaaattcagtcctatgtgtgattgatgcacggctcatatgtcgtgctgcataagtacctagatttaataggctagaatcactgtgtgatcctcatcatcatggtcatcctgatcatcaggaactccactcttctacacggtggtggcgatcggcctgtccagtccagattcgacgcttgcatgaacacagtggtgcacgtaccactcatgttgactacctaaccgtcctcccttatattccacctcgacagatgatcaattgtcgtgaaattcttaccgcgagaagggtcgaacatagaggccagtgcacccagtctaaatccatattgtagttaactctacctttgatgacttgcagcgtcaccctagaaagatcctggttgctactagaattagtgatcctccaatgcagaacttcagtttgaaaatttcatacatcggccacatgacccacagctccttggagaccataatcacatatgtggcatttagtgccgtatggacaacaatctcgcacagcctaatttaaacaacctgtcctatttagtgttcttccacatcgagtgccttggtccgatagagagcactaggcatatgttccgcaaggtccctgacgttcgtggacctactccccacgtggtgtactgcagacggaggacttgggttcaccttaaactcccagtaaatattctcctgccacttagggaggaatacacctccctatgtgtaccacttcctgtttcctccagaaaccagcagacttgagtgtctaagcctgtgcccaggaaaatcagtgggcactcaactgaaagattgtgccgaaattttaattacagatactctcagtgttcttacggccttattcatcgaaatcataacgtggtccaagaccttaaccctggacgtctggaccagattggggcgccgccggccacttcggccccattggagagtcggcaagggccccaaccagaacaagcccggatctggcgttccgccggctggcgaaaactttgt

SEQ ID NO: 651169 - DNA, 344 bp, Homo sapiens
agcaggtgccttgagagctttaggggaaatggctgcagcgcagagtattactgcagaccttagagatatggttgattccatggataaaacttcttccagtatttcacctattattctactgcaatttttgcacatggctattgccacaggttgccgagacaggtgaacaaggacaggatcttcaacaggatgctaatgaatgttgcatacaaatgatgccagtattgcaacagaaatatggagccctagaggatgaatctgttaaagagacacgactgctcatctgcatcggctgcgacaccttctagtcagaatctggagaagaagaagtcaccataggggtt

SEQ ID NO: 651170 - DNA, 144 bp, Homo sapiens
gctcggcaccctattcgcttttcattgggacagctgccccattgtgaagcggattccaccttccgtgcatgacacggaaggcttgccgttcatgaagcatggttgcgtcttcagtgcgcaccgccggatgaacgacatgctggg

SEQ ID NO: 651171 - DNA, 176 bp, Homo sapiens
ttggatgatggcatacgggttgatcgagaacagaatgagacagtcttgtcatgcgctttgtagtagaaagtgtgtcggggaagtgcagaggcaatgcatttagtgtcttcagcatgtcctcggtgctgggccacatgtcaagaggggcagcaacaccaccagccattgcactccgg

SEQ ID NO: 651172 - DNA, 577 bp, Homo sapiens
  misc_feature (148)..(148): n is a, c, g, or t
  misc_feature (238)..(238): n is a, c, g, or t
ctgcccatcgtgtggggggcagctgggaggaggccatcaagttatcaaaccagggtggaaggccccgggccctctcatgttttccagcaacgacaaggtgattaagaaaattattgcaaaaacatccagtggtggggtggcggccaanaatgttattgtccacatccccttgcactttttgccctttgggggggtggggaaaaagggcatgggttcctcccatggcaaaaaaaggttngaaattttttttcccccccgtttttgcctggtgaggccttttatgaataataaaggcctgaaggtcaaatccccccccagcccggcccaaatttccccagccttaaggaggggttgctccgcctggcctggccaaattgggtcccatggggggggggccccccctcatgggttttttgggccctgggaaaatggttcctgcagccccagcccagccccattcttttgttgacctgttgacctggggacccccccttcccaaagggggccgggcctccccattccaagtttccccccctttttagaccaaaaaaaaggggaaaacaatttttttactcca

SEQ ID NO: 651173 - DNA, 116 bp, Homo sapiens
gcagtgagcctgatgcttaggagatagtttatgaactggtatacagcccccagcgtcgtggccctcatgaactttaccccaatggccaggaatgagggggtgggtcagaacataag

SEQ ID NO: 651174 - DNA, 927 bp, Homo sapiens
gggactcaactggcttctgccatgccagcgtcacccctggtctcaggaagccaggcaccccgaatggagagaccagtgaagccgggagaagaacaaaaatgtgaagattgaatggacatttatcagttcccaaacattaatatttttataatttcttacgccctgtctttactgcaatctctgaacataaatggtgaaagatttcatggctatttatcacttccccaatcaatacctcttataatgtcttatggtcgtctttaatctcttaatcccgtcatcttgtaagctgaggatgtatgtcacctcaggaccctgtgatgatgtgcaattaactgtacagatggtaacaacgtgtgtcggaacaatatgaaaccagtgcaccctgaacaacaggacagaagtaacagagattttcagggaaccaaaacgagatcatcatacaggcctgactgcctgcggggttgggcagaacaagccatatttactactcgaagaaagctatagatgggatggtgtgagtaggagaacatatgctgaatcttagtccccagcaacggcactattgacttcacctggattcgcccctgggcgacaggaatgcattccctgggggggcggtcctatgaaacgccggctctgggatagtctcgcgcatgtgcgtcgagcatacagggctgaaatacacccgtggtctccggaagcgcctcagggttgggaagatggggaaactccagccgggcatccactccagaccgggggtgtggctcaaccccgtccgtccacgaggttaccacgacatgttcgacggaggcaggcccgcgcagaattcaaggagcgcagagaaaatgggctgagaaggctgggacagcccggcgaaacctacactaaaggggagggaagagcgcagccacaggggcacgggaa

SEQ ID NO: 651175 - DNA, 400 bp, Homo sapiens
atggcactgtattgacgactgtgccattatggctaaaacaagcttatatcctgcttatgtctgctaaccatttcatttaagtatttatgacaaatcaaagctacattttacagcatttactataaagtttttaaatacttcagatttgctgcaaccctgcatcgagcaagtcatcattgccattgattcaacgagcatgttctccattagattctctgtgcatcatctagattatactcgacaatatttcaaactttctcattatcattacatctgttgttcttatctgtgaacacccggtccggttttcatttttagaggcagggtctcactatgttgcccaggctgatcttgaactcctggcctcaagcaatccccccaaaacaactacagtagtaac

SEQ ID NO: 651176 - DNA, 139 bp, Homo sapiens
cacgccagccccgcggggaggtctgaccatccagcttctgcagcggcgaaagccccagcgcccgagctcctgagccggcggggagcaagtaaaggttggccgatctccggggagccccggagtaggcgggcggcggccg

SEQ ID NO: 651177 - DNA, 1020 bp, Homo sapiens
gattctgaatccgggttgcgacgattcgcgtatctcatgggatctcaccgctggatccgcgttacgcctgttgctttgccgtatgtcctgtttgaggctctcagtgcgaaatatcggacaatgtcttgagaggatcaggctggagtatagtgactctcgcgtaaaagggacagagaacagacgcgccgcgcttacactagacgtactgaacagtagctcgggttgggtgcccgtaggtgggtcgggattgtagtccagaccagcattctaaattctagagagaggagatcggtcaatatgggaccttgtgcgcgcttgtaagatggctcgcatcgggtacaccgcaatatgacgtggctgggatgatcgtctcctcgcaacagttggcttgcatcttgccttggaaatgcctacagaatgggtcttctgggcaaaacgacgtttttatcgtactcctggcaatttccaagttgggacatcaatgacagttgagaactaggtctacccctcagtcgaggaaagccagtttaagtttgggccagcgttccgtgaaacactctaaattttcgtattgcctagttgtgggtaaactaaagacctacatgaggaattgcgtattgcttgcaatccgggattttgtactcagaggttgtcagagaagtggtttcccaggacgggttcttgtagtgactgctcggcattagcacgatcttgacgatgtggaatggttgggtttccccaacacattgtggttgccttgagccattagactcgtggccaagagacatgaatgcagagtggttcttgaactgccacaagacgtcgtattatggaggagtcaacaatgtggtgaagtcaccggactatcggttctcagaaagatgtcttcctttgtttagtttgttttcttatgaactatagtacagcatatagagatacagctagctacactacactcgacgcaagccaagtctcacatctgacagagacacccaaaaataacagcacaccgcgactgaa

SEQ ID NO: 651178 - DNA, 748 bp, Homo sapiens
  misc_feature (525)..(525): n is a, c, g, or t
  misc_feature (531)..(531): n is a, c, g, or t
  misc_feature (545)..(545): n is a, c, g, or t
  misc_feature (555)..(555): n is a, c, g, or t
accagtgctacctccacaaacagtgtatagccagtggaatgtgtgcatgtatgtgtacatgtctgctagtatgtgcctttgtgtgtgcatgtctgtgtgtgtgactgtacgtatgtgtacatgtctgtgtgtgcctatgtatgcatgtctgtgtgtgtgactgtgtaggtacatctatgtgaatgtgtgcatgtatgtgtacatgtctgttagtatgtgtgtgcatgtcatgcatgtgtacatgtctgtgtgactgtatgtctatgtgaatgtgtgcatgtatgtatacatgtctgttagtatgtgtgtgccttgtatgtgcatgtctggacagtgtgtgactgtgtgtacgtatgtctatgtgaatgtgtgcatgtatgtgtacatgtctgttagtatgtgtgtgtgcctgtttatgtgtgtgcatgtgctgtcagtgtgtgtgtgtacgtatgtctatgtgaatgtgtgcatacgtatgtacatgtctgttagtatgtgtgtgcatgtatatctgtgtctatnggaacntatgtacatgtgtncatgtgtctnggtaggggtgtgtgtgtccctgcacacctgtatccatgagtcagcacctatctgtgctggtgtccagtgtgaatgtgtgtgcatgtgtctgtgtgtggaagtgtgctgcagcctctgtcaaggcagggcaggggaggtctcagcctggccatcaccttccccaccaggcgcccccacatagttcagcgtctga

SEQ ID NO: 651179 - DNA, 342 bp, Homo sapiens
  misc_feature (320)..(320): n is a, c, g, or t
ccgctatgtaacatgctaaaatggactgaaagaagatgtataaaatcaaaatgatgttaccttcacaccttgaatcagtacgataaacccccctccccaatcacaaaagaaaaactaaacacaaaaaccaggctttggttgctcagacaattttacaggtgagttctagcaaacatgcaaagaacgtttaattgcactgttacagaaattcttctggagacaagaaaataagacacatcacccaaccaatttcataataacaatgtcaatgtataataacagaaaaagtggatctccaaagaaataaatttatttggaantaaacaaggattataatctgaa

SEQ ID NO: 651180 - DNA, 1266 bp, Homo sapiens
cgcctcggtccagcgccatggcgccctccaggaagttcttcgttgggggaaactggaagatgaacgggcggaagcagagtctggtgggagctcatcggcactctgaacgcggccaatggtgccggtcgacaccgagtgtgggtttgtgctcccccatactgcctatatcgacttcgccctggcagaagctagatcccaagattgctgtggcgtgcgcagaacatgctcacgaagtgactaatggggctttactggggagatcagccctgggcatgatcaaagactgctggagccacgtgatgtggtcctgggtgcacctcatgagagaaggcagtgtcttgtgggggagtcagatgaagctgattgtggcaggaaagtgtgcccatgctctggcgagagggactcggagtaatcgccatgcattagggtgagaaagctcagatgaacatggggaatgctggcatcactgcagaaggttggttttcgatgcagacaaaggtcatcgcagataaacgtgaaggactggagcaaggctcgtcctggcctatgaacctgtgtgggccatatggtactggacaaggactgcaataacccgagataggccagtgaagtacaccgaaaagctccgaggatgggttgaaagttccaagcgtctctgatgcggagggctcagagcaaccggtgactcatacatggaagggctctggtgactagggagcaaactggcaaggaggactgggccagacaggcttgaatgtgtgatagggcgttaccttagtgaggtaggaggctacccatccagaggccccggaacattccgttgggacgatcaattcgagtggcgaaacgaattggaggtcccgagcccagtagtaccgctaaccattagcgttggcagggcccatgggactaaagcagagcgcaagaaagcgcacagtaacgtaggcctttcacttgggatagttggctcttaaaagtggcgagtgacacagctgagtatacctattcacggtgtatgggcaagaatctcgaaacgggtatatatttcctttatgttgtgatataaaatcattcacccctgggtaattagtattggtacaccaaggaggccaaagcacgatttcctcagatcacaatgaaatggtgttgcaaagatacagtgcacacaaagggtgatcgttatacctttgcgagataaaattgacagaggttgtttagtatattggccctagtattccgcaaggcgacttgaggtagacagaaaaa

SEQ ID NO: 651181 - DNA, 806 bp, Homo sapiens
  misc_feature (583)..(583): n is a, c, g, or t
  misc_feature (589)..(589): n is a, c, g, or t
  misc_feature (603)..(603): n is a, c, g, or t
  misc_feature (613)..(613): n is a, c, g, or t
accagtgctacctccacaaacagtgtatagccagtggaatgtgtgcatgtatgtgtacatgtctgctagtatgtgcctttgtgtgtgcatgtctgtgtgtgtgactgtacgtatgtgtacatgtctgtgtgtgcctatgtatgcatgtctgtgtgtttgtgactgcatgtatgtgtacatgtctgtgtgtgcctatgtatgcatgtctgtgtgtgtgactgtgtaggtacatctatgtgaatgtgtgcatgtatgtgtacatgtctgttagtatgtgtgtgcatgtcatgcatgtgtacatgtctgtgtgactgtatgtctatgtgaatgtgtgcatgtatgtatacatgtctgttagtatgtgtgtgccttgtatgtgcatgtctggacagtgtgtgactgtgtgtacgtatgtctatgtgaatgtgtgcatgtatgtgtacatgtctgttagtatgtgtgtgtgcctgtttatgtgtgtgcatgtgctgtcagtgtgtgtgtgtacgtatgtctatgtgaatgtgtgcatacgtatgtacatgtctgttagtatgtgtgtgcatgtatatctgtgtctatnggaacntatgtacatgtgtncatgtgtctnggtaggggtgtgtgtgtccctgcacacctgtatccatgagtcagcacctatctgtgctggtgtccagtgtgaatgtgtgtgcatgtgtctgtgtgtggaagtgtgctgcagcctctgtcaaggcagggcaggggaggtctcagcctggccatcaccttccccaccaggcgcccccacatagttcagcgtctga

SEQ ID NO: 651182 - DNA, 1132 bp, Homo sapiens
  misc_feature (2)..(2): n is a, c, g, or t
  misc_feature (61)..(62): n is a, c, g, or t
  misc_feature (68)..(69): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (82)..(83): n is a, c, g, or t
  misc_feature (85)..(85): n is a, c, g, or t
  misc_feature (91)..(91): n is a, c, g, or t
  misc_feature (93)..(93): n is a, c, g, or t
  misc_feature (98)..(98): n is a, c, g, or t
  misc_feature (124)..(124): n is a, c, g, or t
  misc_feature (128)..(128): n is a, c, g, or t
  misc_feature (136)..(136): n is a, c, g, or t
  misc_feature (139)..(139): n is a, c, g, or t
  misc_feature (141)..(141): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (158)..(159): n is a, c, g, or t
  misc_feature (165)..(165): n is a, c, g, or t
  misc_feature (225)..(225): n is a, c, g, or t
  misc_feature (321)..(321): n is a, c, g, or t
  misc_feature (329)..(329): n is a, c, g, or t
  misc_feature (359)..(359): n is a, c, g, or t
  misc_feature (367)..(367): n is a, c, g, or t
  misc_feature (370)..(370): n is a, c, g, or t
  misc_feature (379)..(379): n is a, c, g, or t
  misc_feature (381)..(381): n is a, c, g, or t
  misc_feature (389)..(389): n is a, c, g, or t
  misc_feature (402)..(402): n is a, c, g, or t
  misc_feature (410)..(410): n is a, c, g, or t
  misc_feature (428)..(428): n is a, c, g, or t
  misc_feature (815)..(815): n is a, c, g, or t
  misc_feature (953)..(953): n is a, c, g, or t
gntgtgcagcactgctgtagaaaagtattaatagcttcatttcatataaacataatttacnnccaaanncttatntanantnntnaaaatntntcttntatttaagtaatcttaaccagttctncaanttactgtnttntntattantntnaaaatannaaaatntagttaattacaatttaaagagtattccacataacttcttaatttctacattccctcgcnttactcttcgggggtttgcctttcagtaagcaagcttttcgcatgctgcttaatgtattgcctttttagtaggaatccggaagtattagattgaanggaaaagnacttgccatctctgtctaggggtcacaaantgaaaggntcntgatcacananggaggttngtgatctgtggcnacaggggnttccttattcactctttnattgctgctgttgaagttgccaacccccccccccaaaaaaaattcacttaacacctccggcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaatanaagtacattttataaaccatttactatggctttgtaacaattgcatacccatattttaagggacaggtgaatttactactttctaaagtttattgatacttcccttttatgtaaaatgtagtagtgatacctatattnccacattgtgcattttgacacacttgtttagggatgcctggaagtgtataaaattgactgcatttttttgggtttttttctttaaaccgtttccttggcccatttttcccccagatgtaattgatatttggttaagtgttatttggaataaagtggacattttaaacttaaaaaaaaaa

SEQ ID NO: 651183 - DNA, 914 bp, Homo sapiens
  misc_feature (141)..(141): n is a, c, g, or t
  misc_feature (149)..(149): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (171)..(171): n is a, c, g, or t
  misc_feature (184)..(184): n is a, c, g, or t
  misc_feature (192)..(192): n is a, c, g, or t
  misc_feature (210)..(210): n is a, c, g, or t
  misc_feature (597)..(597): n is a, c, g, or t
  misc_feature (735)..(735): n is a, c, g, or t
ataatccacccccccccccaggtgggtgtcttcaaaaaaaaaaattttcccgcccctttaaaatttctcttttaggaggacccccggaaaaaataagatggaagaaaaagccctcccccattttgttggggtcccccaaantgaaaggntcntgatcacananggaggttngtgatctgtggcnacaggggnttccttattcactctttnattgctgctgttgaagttgccaacccccccccccaaaaaaaattcacttaacacctccggcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaatanaagtacattttataaaccatttactatggctttgtaacaattgcatacccatattttaagggacaggtgaatttactactttctaaagtttattgatacttcccttttatgtaaaatgtagtagtgatacctatattnccacattgtgcattttgacacacttgtttagggatgcctggaagtgtataaaattgactgcatttttttgggtttttttctttaaaccgtttccttggcccatttttcccccagatgtaattgatatttggttaagtgttatttggaataaagtggacattttaaacttaaaaaaaaaa

SEQ ID NO: 651184 - DNA, 635 bp, Homo sapiens
  misc_feature (141)..(141): n is a, c, g, or t
  misc_feature (149)..(149): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (171)..(171): n is a, c, g, or t
  misc_feature (184)..(184): n is a, c, g, or t
  misc_feature (192)..(192): n is a, c, g, or t
  misc_feature (210)..(210): n is a, c, g, or t
ataatccacccccccccccaggtgggtgtcttcaaaaaaaaaaattttcccgcccctttaaaatttctcttttaggaggacccccggaaaaaataagatggaagaaaaagccctcccccattttgttggggtcccccaaantgaaaggntcntgatcacananggaggttngtgatctgtggcnacaggggnttccttattcactctttnattgctgctgttgaagttgccaacccccccccccaaaaaaaattcacttaacacctccggcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgtcccataagaacccaccacgaggtaacatataaattaaaagatgtctattttttgacccgaaaaaaaaa

SEQ ID NO: 651185 - DNA, 343 bp, Homo sapiens
  misc_feature (14)..(14): n is a, c, g, or t
  misc_feature (70)..(70): n is a, c, g, or t
  misc_feature (79)..(79): n is a, c, g, or t
attgaaaaacgggncttcatcaaaattgaaaccccctgattatttatttatgagatggagtctggatcanacccgtatncctagcatcttgtgaggcccaggcaagaggaatgcttgaggtcaggagttcaggatcagcctgggcaaatatgctgagacctccattgctacaaaaaatttttaaaaaaaaaataagctgggcatggtagtatgcacatgtagtcctagccactagggaggctgaggcaggagggtcgtttaagcccaggagttagagggtacactaagttatgatcacgctactacactccagcctgggcaacagagcaagaccctgtctcta

SEQ ID NO: 651186 - DNA, 151 bp, Homo sapiens
  misc_feature (21)..(21): n is a, c, g, or t
  misc_feature (29)..(29): n is a, c, g, or t
  misc_feature (34)..(34): n is a, c, g, or t
  misc_feature (37)..(39): n is a, c, g, or t
acaattataccctagccaacnccttaaanccctnccnnncccccagggctggggtagccttcccgcgtcttctctcgctgtctccctccgtctctctctccctgtctctccctctgtctccctctctccctctgtctctctctctccgtct

SEQ ID NO: 651187 - DNA, 352 bp, Homo sapiens
gattgagcccggctgaggacaagtgaacacttgaaagctcagaactcggagctggcgtcacgtgcaatatgctcaggtaacaggtggcacagaattaaggagaaagtcatgaaccacagttaacagtgggtgccaactcatgctaacgcagcagttgcaaacattttgaagagagaccgtcgggggctgaggggcaacgaagaaaaaaaataacacagagagacagacttgagaacttgacacgttgcgacggagagaaaaaagaagtgtccgagaactaaagccaagggtatccaagttggactgggttgcgtcctgacggcgcccccagtgtgctcagtcgaacggactg

SEQ ID NO: 651188 - DNA, 294 bp, Homo sapiens
  misc_feature (171)..(171): n is a, c, g, or t
  misc_feature (262)..(262): n is a, c, g, or t
ccgtttgtccaggctggtgtcaaaatcctggctcaagcaatcttactgccttagcctccaaagtgctgcgattacaggcatgagccactgcacccggcccaatttcaggttgttaatggaactgcgtggttgtgaccatcagctgaccggacagcatgcagcagtctgaanggaccaataccaaggcaagtgctgccatcatggagagatgtcggacgaacccaagaaaataacaacaccgcatgtcggggagatgacccangcagtgacaaagcaatcctacagtgaacaaaa

SEQ ID NO: 651189 - DNA, 115 bp, Homo sapiens
  misc_feature (76)..(76): n is a, c, g, or t
gcaccacataacaaaggggtcatgaaaactaccccttaaactgccaaaattgggaaagagataagactcattatcntacattcctacgtcaatccgacactgatagaatctctgg

SEQ ID NO: 651190 - DNA, 1222 bp, Homo sapiens
  misc_feature (1034)..(1034): n is a, c, g, or t
ggattcaagttagaagtttctagatctggccgggcgcagtggctcacgcctgtaatcccagcactttgggaggctgaggcaggcggatcatgaggtcaggagatcgagaccgtcctggctaacacggtgaaaccccgtctctactaaaaatacaaaaaagtagtcgggtgtggtggcgggcgcctgtggtcccagccactcaggaggctgaggcaggagaatggcatgaacctgggaggcggagcttgcagtgagctgagatcgcgccactgcattccagcctgggcgacagagtgagactccgtctcaaaaacaaaaaaaccacaaagaagtttctagatctacggggcatgatgaacacaaaccccacagacactgaggaacccaggggtggcaggtgacctcgggcatcctctgctctctacagctccattggcagaaacagtgggaggggccgggcgtgggggatacacgccggatcatcccagccactctggggaggactggggcaggaggaacgcttgagcccaggagttcgaggaccaagacgtgggacaccatagtgacggctgatatacgctaacattaaagataaaacaaaaaaggtagagctggaggcagtcgcaccatgtgcgcctggggtcacagcatcactcaggaagcgcattaaggccacgaaggactgcttcgagccacggaagcttgcatgttgcacatagagcccaagacccggacccatgggcactccacaatgaggccaacggagcaaaacaccgtgtcgccggcagacacacaacacataaacaggaacgcctgaagagcgcacgaaaagcggacacacagcggagaaaaacgatggagatcaccaagccaagacaggaacgggcaaatgaggagtagacacccgagcagaaaagcacgaagaagggggcagaccgcgaaacgccagaggagacccgtggcaccaaagacgcacccagggagagtagaggacaagcacggtacaccggcagagacaagtactagagaaacanaaggaggaagcagtcggagagaggtaggagaccaggaaggaaaacgagacagaagtcagcgagcaagtagtgaccgcagcaacaagaggtcacagccagacggccaagagacagacaacgacgacagacagcggacggacgcagagatacaggagagtgactgcacgacgcggcgcaaacatgagaga

SEQ ID NO: 651191 - DNA, 814 bp, Homo sapiens
  misc_feature (438)..(438): n is a, c, g, or t
ggtacgacttctcggctgtgcaggaactgtcagagagatgtagtctctgtcagacttcaccctccatgaggcttactgcctgcgggtcctggtgctgtgtccggagtgtgacggagtcctgtgcccagggaaaccatggaggagcactgcatgcttgagcacctaggaggccaattgagtgccaggagcgctcacttgtctgagtgtcacatgcttctgcgaaacttggacggatgcacgcgtcatgctgagctggagctccaacgtagtcctacatgttggcgagccggactagagcttcctgcactacaggcgtgtggcctagttcatctatgcaacgctgaattgcgtcagttcccaagcaaaatgagatgtctgtcatgagtgcaagcaggcgcctagccatcggagaacagtgggaagaggagacttttcagnctaccgtgcaccagggacaactcgtagcgtgctacagtttatctggcaatatcgcgaacatgattccccgagataataagtatttccaccatatgggtaaagtgtcgtgccaaaactcagacttgtaagaaacacttgccttgtgtggaccatgccaggaacattcttccttcattctcttccaagtcgagctgctgcacaaatctacaacttccgcgactggaaggaaagatgtgtcggtcctgagacgcaggaagtattacccagagtgtcctcttcattctgacatttcatcaaaggaaagcacctgagaagcatgaaagcggaacaccgttggactccacttgtgatgtcagaggccaaagccccagggaac

SEQ ID NO: 651192 - DNA, 820 bp, Homo sapiens
  misc_feature (547)..(547): n is a, c, g, or t
  misc_feature (565)..(565): n is a, c, g, or t
  misc_feature (574)..(575): n is a, c, g, or t
ggtctgagtcaacgcggctgcagggcctgcagctgtgctgtggtctacctgcatactccatggtgggcagctggggctgagatcgatcaggcgaatgacttgtggggggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttcctccggccccagctggacatcccgatcgccgattgtacctcttgcctaagccaagggatggagtgagatggcacaacagatcaagcaggagtaagaaagagagtccctaagtgtggatttgtccgctgggaatgagaaagtcgctgtccctgcttgcctctggttaagcacagaaagtctggactctcaaaagagaaatgcattctggtgattacatggatccaacacctgatncccaagattgaagatggnaatgacttnnggggtagcaatccaggagaaggtgctggagaggtgatgccgtcaagcatcctaatagtggaagctttccacacgaacaccattgtaccgaagttactatctcagaaggtgggggatgctgtcggccaaaggcctcccagaggagaactcatgtcaatggattcaccgaggccttgggtgacatgagcgagcatgaggcagcctcatcggggaggtcacgggccgtggtcgctggcacctaggagg

SEQ ID NO: 651193 - DNA, 672 bp, Homo sapiens
gatttgagccagcctgtggatgaacacatttaaaattttatttataaatacatttactgttacatttgacttctcttattaaatacatttgtgatctatatcgctatggtctctgtgacaagtcatgcataactgggtcacgctgcatgtttctgataggaagtatcctttaaaaaatgcatgcagataaactggacttcataaaagctaaaaactttctgatgcaacacacactatcaacaaaacgtgcacacacacacgacaactcacggaatgagagaaaagatgtacaacatccatatgtctgcataaagaaactgtatgcagaatttacaactcaaccatacaaagacaacccatttgatgaatgataccaaggttttgctttagccaaaaaagctcatgcaaatgtgctcaacatcagtagccatcatggaaaatgcaaacgcaaagccacaataagataccacttcatattcagtcagatggccataatcaataagacagatgataacaagtgatggcaagatctggacacattgacacccttagacaactgctggtggaatgcgaaacagtgcagttgcttagaaaactggttaggctggccggcacggtggctcatgccgtaatcccagcacttgggagggcgaggtggcgtggatcaattag

SEQ ID NO: 651194 - DNA, 252 bp, Homo sapiens
tctcccacagtgctaggattacaagcgttatccaccacacctggtccattcttccttacctttttgctcttagccgacgaatggatattatttatcaatctgcagggaagagaggttatttctggttttcatgtcaccccctcgtgcgaattggttggttaatgataacctgggcatattatcattcattttataaggatttattttccttggtatctatctctgtgctctgaagggctcggaagatcagga

SEQ ID NO: 651195 - DNA, 179 bp, Homo sapiens
ctagtgcagcaggtcagtcttcaagcatcccaaggtaagcattgccttcagtctgcatgtttgttctcaaggcacttatcccctcacaatcattctcccactccatacttctccttctcaccccacccatgtgctccctgtgcactcctccagatggtcagcaggggtaaccacaagtc

SEQ ID NO: 651196 - DNA, 102 bp, Homo sapiens
gggggggggggttttcccccccccccccaaaaaattttttttgggggggggggggtttttaaaaaaccctttttttttcccccctttttgggggggccccca

SEQ ID NO: 651197 - DNA, 1045 bp, Homo sapiens
gtgtggtgtgctgcttgcatcagtgcacagagctgtgccctgcagcagtgccagaggcactggtgcctgtgtgcactgctcccacgtgtggcgtggcgcttcctgtgctggatgtctcctgcatggacagtgcaccagacctggtgatgaactgcccagctagtgcaggagactgtgctacttggaggacctgcctgctcagccagcttgtatatgtgcccactgaggagaactgcctctccaagtctgcagatcacatggactggccctactggatacctgcctgcctatttgcgcttctccacacatgatctacaatctgggccggactgactttcgtccaaagactggacgcgatagctgggttttgtgcaccagtgccacagtgcattaccacagcacttgaggtcttcacccactacgacctcctcactctcaatggctccaaggtggctgagtgggcacaagggcagcttctgtctggaggacacaaactgcccacaggactgcagcggcgctacgcatgtgccaactttgggacgaacagggagtgactgtaggctgctgggaccactaccggcatgacattgatttgccagtgagtggatatcacagatgtgggccccgggaattatatcttccaggtgcattgtgaacccccattatgaagttgcagagtcagatttactcaacaatatgctgcagtgccagctgaaagttttctatggcacgggtcttggctgcacaactgccacacacgtgcattcattaccaagtgcagatgcgaacgttaccggacaaccaggcaccaggcgcccaagcagaacgtctctgaggtgtaactgcgcagttcctagatgatgcgaatacacacaatccgtcaggaacttgggccgagccgttcagagtcccaaacagtaaaggcagtgcctggcaccggaccgtcgtagaagcgctcaatgtcacatcaccaaagtaagcccacgagagataggaccacaagggtggaaagaattcacgagcgaatcgaccattagagacgaac

SEQ ID NO: 651198 - DNA, 204 bp, Homo sapiens
tcccaggctccagctaacgatattaggacggtcagcacggtgctcacgtgtcgacggaactatgtacaggaaggcatgcaccgcaatggtgaatacacgtcgaccaggactccatgtaaacgataattaggaggtcagcacggtgctcacatatcgacggaactatgtacagagaagatatgccccgcagtggatagaatacac

SEQ ID NO: 651199 - DNA, 1157 bp, Homo sapiens
cccgtatgtgtagttcctcgctcgtcggttcgtctctgtgtgtggtgtggtattgtctgtggtttgttgaccgacagcatgtgcggtccgccttgcgcctgtgttttttcgtgcggtgtgtcttcccccccgtgtgccccgtttttgtcatatatgtcgggtctcacggtttccccccaggttattggggataggggggaagcatggataacacagggcggaccctgtgggtccctcctctcgtctcttaggtgcacccaggggttttctgccacactttagggaggacccccgtcccttgaggttataaacttcatgagttcacaagaactttgtctgtaagatgatccccccatggtggaccaaggaagggcaacgatctgggattcaaccacggggaaatgaggaaagcctatgtgatgtctttgacacggccaccacagtcctgagagatgtgactactgtgttgccatgtcccaaaatggcgcccgtgtgacaccccccatgaccagactaccagatatataagtggaaacttacttcctgggagtcccagaaaataggggaaaagctgtcccaaataccacgcccttgaaataggtttcacaggcacttccccaagagagcccaccacgcccatgagagataaagagcttatttccgccacggcgtataaggagcaccacgatgttatcccacgagaaccacttccctggcacaaggtgagaaagtgtcttgcaccccatctttcttgagacgtataaaaggagaaatatgctgagaaatgaaaattcttaaaaatattttgaggaaagaggcccaattttaatacgcccttttggagagttcacaagatgaaagccacccactgtatcacggagtttccgccacttatataaaatgaactataacacttgccttggctatatttcaccccaaaggagcttacttcttgttttttcccacgttttatatagaggaaacacctcgtctatgataggagtttcccaaagtatttgtggaccacgttaaatgctaattaaatatacactctgtagttattctaccactttttcttgaaatttgggaaggttaatacccagtattcatttcatgatgtaaagaaactgaaccgtgaagtggcttgattgcttata

SEQ ID NO: 651200 - DNA, 1518 bp, Homo sapiens
ggaactctaactgtctgacagagcgttctccgtgcctcatatagtgggtccctactgcgttcctgctctcggaacatgcgcagcagcatgtattgtgggacaggtgcacagagcttccctagaaggagtgacccgtccaagccggttccacctcagagtcttcctgtggatacaccggctgtgcatgactcacactcgttgcggtcaagtcgacaggccgagtatccatcggtgaacaagaaggaggtggatggcggcctgtgagcagtagtgaaaacaccaccccatggtttggcattgctgggcatagttgggcgtacggtggacacaggcccatcgagtgcctccggacgccttcaagaacttgtcgttaagcatgcagcaccatcaagcgatagagatcgcagggcaggggcgtagcgtatacgagcaatggcgccatcagatcgttccgcacagcacagggccttctacccaaggttacttgcaatacagaacatgcgcaggacttcagccatggccactgcaccgccagcctgggattgcaggcacttatccagcccccgtcattgaacgccccgtgactgcacacaggtcaatcgcgtgttcatagggcacactaccacaaggagtgatcgcctgcatattccttctgacgccagaatgaaagggccccacctggatgggaaggatcccgcggtcgaaccaggagggccctgttggccccgcacacacctgggactgggaccgcgctaaggactgcgctacggaaggccaaggcacgcggtaaccttgctgagacccacacgcagtcacgcgaccccagggatggcagattgcactccgacacagcacaaatcgcgcagctgcaccccagcgggcccaaagagcctcaccacaggggggatcaaccgagagacggataggccgaccacccacagcaacagccgtgcacaccgcgacagagcccaccagaggcccggcggacacggtacggacctggcacatatggcggacactgtgcacattcccagactcccggatgctactacgccaatctccactggcgtgctcacccggcgtgcctggtggccatgcaaacaggcaatacccaatccaccccacgccaccctcgcaacaacacaacagccgccgcacctcctaaccatacgcaactgggcccccacggctgtagcactaacccaaccggaccagagccaagaccgcactacacacacccaacagcccgaccccacagtaacacaatcacacgctacctaccgacaagacgaccaccaaacccccctgcgacaggcttgcccccaccaacagcgtaaccgacaaccacgacacacgaccacagcagaccacacccacgccacgcacgaagccacaaacaggccgcaccaccccacaaccacacccagcgcagcgacaacaccaacgcacggaccgccaaacccaccaacgcagcacaaccaacaagccacagaccgcccccaaccagcggaaccaccc

SEQ ID NO: 651201 - DNA, 407 bp, Homo sapiens
atccccatttcttatcattagaactgacctgacattaaagcaatgcttaattttttaccataagagtgaaattttgagattataattttaaagtgtaaaatatttacacttaaattacacttataattttaaagtgtataatatttacacagattaaaataaaatatgggaaacaatgaagcaaaacattctaaacttgaaaagtaaattgatattacaaacacagagtgacttaaaaacaaacaaaaacaacaaaaatcaaacctccgttataattgcagatttgttgactaaatgtttactaaaagactggctagcttgagcccagggggcgaaggtttcagtgagctgagattgtgccactgcgctccagcctgggcaacagagcaagacttcatctggaaaaa

SEQ ID NO: 651202 - DNA, 305 bp, Homo sapiens
  misc_feature (284)..(284): n is a, c, g, or t
  misc_feature (301)..(301): n is a, c, g, or t
tcgaggacatcagtatacgaatagacgcaaagaagcatatataatctctcactgtatatgattaaagcactagggcaaatatcacgtagatgtcaatattagggtctaaactcagaggacaaacaccaccatctacatctctatcaaacaatattagtagaagatccttaatatatatgtatattgtcagtatacggtttaatttaaacccattaaattctatttatttaaataagaattaataaacgccaatgcttatttcatttcacaaaacataaagtatnttaaatcacaacttcanggtg

SEQ ID NO: 651203 - DNA, 169 bp, Homo sapiens
cacccccacccccatagtacctatcaaaagccttaaaacagctccattttgttcacatttttcctctctttgcctgtctttcttttttatttttgtctgtttgtttattggggattgatccaagggttagatgagtgtcccaccactgagctacacccccagtcgacgc

SEQ ID NO: 651204 - DNA, 521 bp, Homo sapiens
tctgctgaatggggttataaaaatacaaggccacttgagttttgtaagctcatgaaaatgtacagaagctcacacttagtatgatattgcaaggcacttataacacacaataagatacttcgaaacccatctcatagattacaattgaaattgtctttgagaagaatttctaaatatagaaatagataggacgggcgactatgtcttcttttccaaaacacaggatcgcatttgccccatgttaactatacagcaccataaatgtggacacctcgtcccattttagttcttgagacaggttgatcctccagctgaaattactaagctagcttttcttcagttgagtctccattcggtttgacctaaagccaaattcttaatgagtatccaggatcttttagaatacctggctgatttcatgttgttgtaactcacaattcattaaataggaagatgatgatgcccaaatttaaccagtacttactatctagctgcccaaatcaccctaagcaacaatattt

SEQ ID NO: 651205 - DNA, 192 bp, Homo sapiens
  misc_feature (49)..(50): n is a, c, g, or t
tttttttgggggccctaaaaaaaaaaggggcccaacccggggccccttnnaggtttttcccccccccgggcccgttgggggggcccgggggaaattttggccccccccttctacggtcaaggggcccgggcccccccgggaaaaaattttagggggcccccccccccccgggaaaaaaagtttttgcgggga

SEQ ID NO: 651206 - DNA, 144 bp, Homo sapiens
  misc_feature (42)..(42): n is a, c, g, or t
  misc_feature (128)..(128): n is a, c, g, or t
taaacatgattgaaatcactgcttataaatgtgtgatgaganctagatgaccaaaactgttctgaagaatgtacccaggtgcctttttgctaatttgatactataatagaatgaggcataaaattcgntaatgggagcacctcc

SEQ ID NO: 651207 - DNA, 178 bp, Homo sapiens
  misc_feature (97)..(97): n is a, c, g, or t
ggtagatgttagtatgagaaatctcaacgcttcacaggactgactaattacatttccacacaggtataatgttctcttttctctgaaaccttacggnatgttattagacttctttacaatagccattcctaactggtgtgagatggtatcttatggtggtttggatttgcatttctct

SEQ ID NO: 651208 - DNA, 209 bp, Homo sapiens
tccgtacgagcgcctcctaacaccttccgtaacgagcgcctcctaacgagcgcctccgtaacacgcctccgtaacgagcgcctcctaacagctcctccgtaacgagcgccagcgcaactggaggagtcaggggcgtgttaagaggcgctgttaagaggcgtcgttacggaagggggttacggaagaggggatatcgagcatcgcggttc

SEQ ID NO: 651209 - DNA, 229 bp, Homo sapiens
gaggattagacagtcggtaggctaactactcccgtagagacgatagcgaaccagtactgtgaagggaaaggtgaaaagcacttcgaatagaagagtgaaatagtccctgaaaccatgcgctacaagcggtcggagcagcgtaggtgtgacggcgtgccttttgcataatgaacctacgagttactttttccggcaaggttaagcatcttgagtatggtgtttcggcgtg

SEQ ID NO: 651210 - DNA, 809 bp, Homo sapiens
gtgaatccagtcagagtccttgtgattggagcagctggtcaaatagtatattcactgttgtacaggatggaaatggatctgtcttgggtaaagatcagcctataattcttgtgctgtatggatatcaacccgcatgatgggtagttctggactggtagttactaatcggtacactgtcgtatgcactgttgactcctttgcactcctctcgtgcatacagtatagtcatacgctaggcatgataaagtagatgatcagtctagacgcttcagaagaccttggaagtgttgggccattgcttgatggagcgttccatgaccacagatagggagaggcattggagcatgaacatactttacttggatagacgccaaaatgtgccatagattctttcatatatcccgagaggatgctatgcactatatgagtaggagtaccgtcccatatgatacgtcaagatataacgggttacttgcttgctgggtaacttcaagtcacatagcaaactgcctgaaatgcttccaacgcttaaggtccaatcccaaatccgcgaaagggtatgaacctatcaagtttcgccttgacctcgctgttggattcagcatacccgtatctgtaatgggcatcaatattttagctctgtatagcattgtgtgtgactgtgtattgaggttgaggaatgttattattctaggtgaaaccatttgtcgtatatgtatgcgagatggtgaacatgcgaaggatgaaatttggtaggaaaggaagttggagtttatgagagtatgaaagatgagaattggtgagggaga

SEQ ID NO: 651211 - DNA, 171 bp, Homo sapiens
accccccccccccggttggggcccccccttgttcccccccctttggggccggggaaaggggggggttctttttcccttttccgggggcccggggggggggggggtccccccccccaaacttttccccccccctgggggggggttcccctaattggggtttttccccgggta

SEQ ID NO: 651212 - DNA, 88 bp, Homo sapiens
cccccatcctgccccactgtgtaacccactcatttttcaagcgtttttaaatgttatacatacaaaggtttacaagttcaaaaaaaaa

SEQ ID NO: 651213 - DNA, 429 bp, Homo sapiens
agccggcacccgagctgaaaattcctattaccaagtgatgtcataaccatcatcatgtcacaatgcaatgctttattcacgtttgtggggatacaggtataaacaaatctactacatctgccagttgtataaaagtataatatagctaggcgcggtggctcacgcctgtaatcccagcactttggtaggccgaggtgggcagatcacgaggttcaggagtttgagatcagcctggccaacatagtgaaacctcatctctactacaaatacaagtacaagaaacacaaatttggcctcattgtgctggcacatgctctaatgtcccaactactcgggaggctgagacaggagaatggcttaaacccaggaggtggaggttgcattgagctgggattgtgccattacactcccagcctgggggacagagcg

SEQ ID NO: 651214 - DNA, 754 bp, Homo sapiens
gaagaagaatgttgtaattgaccattatctcaatcatcatagttataggaaggaaaagaaaagtcatctcatgctcggaggaagcctgggaccaggttatgttcatatgatcttgatcatggacaaatatattgtgatactcctcttctgacattgtgagaaaatgggaagactattctacataattccgacttgtgaagacaatttaagaaacagaaataccaccctctagagtcaatagagatccattgatagcgaaagtatctactaattcacttaatattattgtcagacaataagacaatacaaggagtgccaatgtcgggggggggatgcccttaggactgaggtattgggcgtactatagaagcttggtactttggattagctatcttataagggacgattatttggggcttggcaaaaatgccgtcctccctttgatcagaacacccaaattccttttgaaagactatagtgctgctcatcgagcatagaaccatttcgttgaaaagcacctacggtgattgctgggaaatggtcttaccgatattccggtgtcgggtgacgggagtgggtgtgaaaatacaaaagaataacgaatgacaaagttctttccaaaagttatacgaacatatgctatgctaacgggttacggtagagatattttaaacgtgcttggaaacacggtaacgagactattcatctgctgttgtgaggggagtcggggggtttagaaaatgttcctatgggg

SEQ ID NO: 651215 - DNA, 279 bp, Homo sapiens
  misc_feature (56)..(56): n is a, c, g, or t
gggcggtggtcgccggctggggcgcgacggtggcccagttctgggcggggtgggtncccagccgggggaccccttggcgccgggccctccctctccccgttcttttcccccttcccagttctttcttctgcggaaccttcacccctccagtgggtgcgggaccctaggcaggaggccaggcaccgccgctctgtctgggggccccgaagcagttaacgggccggtcagcaaagtggtaaagccggtgccctctgtgggggctttgggccaggggtctcc

SEQ ID NO: 651216 - DNA, 168 bp, Homo sapiens
tattgccagcagcagtcccagatgcaagtggaacaacaacctcatctagccactccaaaaactcaggtcgtggagaatctacacactcacgcatcagtccaggctcaactgaatataacaacgttaactggcagtaacacaacaccaggcctcagagaggcatatacc

SEQ ID NO: 651217 - DNA, 409 bp, Homo sapiens
cttcctgacctcgtgatctgcctgcctcggcctcccaaagtgctgggattacaggtgtgagccactgcgcccagcctaattttggtatttttagtagagatgggatttggccatgtgggctaggctggcctcaatctccgggcctcaggtgatctggccaccttggtctcccaaagtgccgggatttttttttcttttcttctttttttttttttgggagagggagtctcgctctggtcgcccagcctgggagtgcaggggcgcgatctcgggtcattggcaagctcggccttcggggttcacaccattctccggcctcagtttccccagtagtggggatggcgggcgcttggccatatgcccgggtaattttgggtatttcacgagagcgggggttcaccacggtagt

SEQ ID NO: 651218 - DNA, 913 bp, Homo sapiens
  misc_feature (910)..(911): n is a, c, g, or t
tattcaaaatatttcataaggacctgtggtttgtttccccttaaaaagcaactctaggccgggcgagaagggctcatgcctggtaatcccaccacttgggtaggccaaggcaggtggatcacttgacggtcaggtgttcgagaccagctggttaatcactggtgaatccccatctctattaaaaatacatagaatctagcacaggttgttggtggaacgcgcctggtaatccctagctacatgggaggttgaggcagtgagaatctcttgaaccgcaggtagggtggaggttagctaggtgttagcctgcaaataatttaccatgtgcactccagcctgggtgacacagggagtgtccattttcgaaacataattctaacgtctttgttcctgtgtcgactcagcacattgagttctatagtcatttagaaggtgttacgccataaagtccagctttgactaatatggtgtgcctggaaccatctgttcgtcgggaggagagttccattatccccccttgtccatttgtccttgtggaactcatgctatgggacatactgtaaaaggtaaaacttcatgcttatgaaggctctctgataaggtcactgaggctagaatctttggatagggtgaaaggggttggatccaattaagtatggggtataggaaggaagttcccgaaagcaaaggtgtttagaaggcattgggggggggaaccccagggaaggtggggaactaattggtttgaggcaagattagagggtaagaggagaagatcgccgcggggaaaaaatggacacgtgtaaaaagaatatcaaggagctcgagagatgtttcaatggtgaaaaaagagtgttataaagatggtgatcaatattgttttttattttttttatatttatatagtgtnntg

SEQ ID NO: 651219 - DNA, 338 bp, Homo sapiens
  misc_feature (139)..(139): n is a, c, g, or t
ggccctgttttttgggaggggccccccctggaaaatgggtttgggtttgaacaacgggtttttttgcaacaaaacccgcatttggggtgacctgccaaattttggggttattccggcaaaaaccggggccaaatgggtnccccaagatttggtccccaagggttgaaacattcaggggaacttttttaaactttggtgggaagagggattttttttttagaaaggtattggttgggaaaaaaggcttttttaacccgggaaaaaggtttcctggaagggggtggaaactcccccccccccttattttttttttatcaaaacatggggaagggaccaga

SEQ ID NO: 651220 - DNA, 432 bp, Homo sapiens
tggcgccggttacatagcagcgatgcagggagatttcagaggtccacactattccatctgcggaaacaaacctagactggtctattaagtcacctggcgtaagtcacctgcttggcccttcaagtcattcgacttggcaacccttatgtacttctctgtttatgagacaaagtctcgctctgtcgcccaggctggggcgcagtggtgcaatttcggctcactgcaacctctgcctcctgggttcaagcgtttctccgtgtctcatcctcccaagtagctggggttacaggtgtttgccaccacacctggctgatatttgtatttttagtagagatggggtttcgccgtgttggccaagctggtctcgaactcctgacctcaggtgatccacctgccttggcctcccaaagggctgggattataggcgttgag

SEQ ID NO: 651221 - DNA, 679 bp, Homo sapiens
cttggagttcgaaacttctgagctccccgccgtcgtacctgtgcctggccaatggtggctggggcatggctttcctggctgtcggggccctccagtccctcaggaatgcctgtcctgggacgcctagctggacaccatatttactgtctgcttgtgtgtatgcttgatgttgaacatgcctgtgtggtgtcgactgcccctgcaccccctgctgctgctgtgtgatgatgctgcctgccctgctggtcaccttgtgtgccctgctgtgggcagatgatgttcactggttccttgcagcctcgggtacatgctttgactgccccctgtggctgtgtgcttaacactgtaacactgcgtggacctcgagagctaagcaagcatgggctgactaagacgcagccctctgcccagtgatccctgtctctccctgcgagctaccctgttccctgcccaatgtactcctgggtaaccgaggggagtgaccgtctgctccccgcctcgtggcccgcgggcggagccggaactgtcgggacaccgcggacgtgtctttgggcggcatgttttatgtcgcgaatctgtgtggatttcttaaattctgtattcccctaaaatagcagtgtatataatatgtaatgcttctaccctgaaaatcacaagcgaaatataggctccatgcaga

SEQ ID NO: 651222 - DNA, 155 bp, Homo sapiens
cccttggtttgctatgctcttccccagacagctgcacagctcatttaatttagatctcatttaatttagatctctcaattaatttagatctctgtttaaaaaaaaaaaaggaccctgggcggccaagggtttaccattatcattccctcaattta

SEQ ID NO: 651223 - DNA, 1528 bp, Homo sapiens
gctcaaagcctgtgctgctatagcgcagcagaacccttggaccactgagtaaatacagccaccaagggcgatggtgaggagaccccagcgcagggagagactgagtgcgtgcagcatctctctcatctcctccgaggtaggcctagtgcttgctggatcagcgggggaccttgccgagtcatctgaggtgtatgacgggacggcggggacgtctacacgctttctcagtaccgctacgcagtcccaccgcgtctgcacgcaaacgcgacagaattctgtccgcattccctccgaccgtatccgtacatcccgtcatccgtgattctaccacctcacccacaaaaatgacgcgaacaggccatgacgatcagtgtgggttcctggaagatctattccactagaatcgaccaggaccgtgcaccacccacgtcggaatcactcgtggacaccggctcaggcctggcgaaccagactagggggcggacgcgacaagtgcaatggcgtacgagacacgcagatggaagacgggcacgaggcagaggctcagaatcaggcgcaaaccgcgaggcaagcgcgacaccgacaccagcgagggcgcgaccttagtccgacacgaaccccaggagggcgccacatagctgcccgcacaacgccgccacgcggcggaactccacacaggagcctgcacacggcggaagaaccacgcccaagccaagcgcgcccgagtacacaccagggggcgtagcacagcacctaggaggaagcaacagaacagcccacgacacgcaagcacgcgcgcccagtgggggcccccaggacccaggccaaagaaaagaagcgcgacgcacacacaccagagaggccccaacggcgacgccaacaccacagcgagcagcagcagcacccccgacacgcagcacctcggcctcagagtacagccccaacaccggaagccagccgccgaaacgcagacgccgcactagcggggccccgcccgggccccacacaccccagctacagaggggaacgcccggccccacaaccaggacaccaagcagcgatcaaggcaccccaccggagacagcaagcacaccgcccgcgagaccccctcacaagcccacaggaaccccacccgacgaaacacccaaaccgaacacacgagcacgaggcccgcacaacaacgcagacaagccagcaggacacaagcgtcatgacgagaccacgcacccacaagaccacaaagaccgccccacaaccccagacaccgccaaagcaccccccgggcacgccagcacgagccaggacgccacgggcaggcacccggccaaagccgccacgccatcaccgcgcggagaacaaccccgccgacccgaacccaggcgaccgaggcgaagcggcccaaggcggcacccgcaagacacgctgcggacgccacaaaccaaccgccccgcgcacgagcgacaagcagaacgccaccgacgccacagcacacaagcacaccaacacacacggagagcagacccgccgg

SEQ ID NO: 651224 - DNA, 155 bp, Homo sapiens
  misc_feature (24)..(24): n is a, c, g, or t
  misc_feature (82)..(82): n is a, c, g, or t
  misc_feature (152)..(152): n is a, c, g, or t
ggcggacacataatggcaccgtcnggcagaagtacacttaacggaatgcgattgatatgagtaataaattaactttttagtngctttatattttcttattaccactattagtgtgaagttttttaaaaaggcagtatagtcagtttcttttnggt

SEQ ID NO: 651225 - DNA, 115 bp, Homo sapiens
cagatttcacccgcctggccgatcggcagatcgcggccttcgtcgtcgcggatggcgatttcggtgcccggaatcggcaagccgacggtgcccgagaacttgtcggtatcggttg

SEQ ID NO: 651226 - DNA, 558 bp, Homo sapiens
  misc_feature (169)..(169): n is a, c, g, or t
cagtcggatcgagatcgaaaggaagcaagactcgagtagcagcacggactcttggaagatggcgccgagtaatagtcagtaactgcaacaatgatagagtacggataaggactataactagaattgatatacttgttgtgaattgcccgagaggcgatgttctggcatntgtaataaagtcagcattgccagacctgaaccgttaactcagtctgcacactcctgtttctaactatctagcgaacatgtatattctgttcacgacactttatctcttagtcgcttcgatttcagaggaacaaagaagcaactttgaagttacctcatctatggaatttagaataaaagtggcacattacatatcggatctaagagattaataccatctagaagttacacagcttttagttgttgtggagatagtgtttggtttgtacagaacaaaataatatgtagcagcttcattgctattggaaaatcagttacttggaatttccacttgatatggctatacaactaatataactggtagttctataaacaccggcaatgtctgtt

SEQ ID NO: 651227 - DNA, 396 bp, Homo sapiens
tttgcagtggagaggagcaattttggttcccggctgagtgcacattctgcattctcgccatagtagctaaggctcctgacagcccagatcgagaggcgcaggccagaatgagtggctaatgggatctcagcgtttgtgcgaatggccgtgtctcaccatggtctgtaggggcttcagcagtatctgaactggatcccggcccgccttgaacgcacaacgtgctggccataccgacggcggctaccgggtccaagcgtcactgtttgtagaatcctgtgtatcttatgcatcgctagctcatatataggcctactagtcattgccgtaagctcgccaatgtcgcagcctaatccgttgccattatgccgtacttcactcccaccgcttgtctccttc

SEQ ID NO: 651228 - DNA, 157 bp, Homo sapiens
cctcccacggtgtaccgcatgccacacctggatccggtcctcccactggtccctggtaggtttgtgctggtccatcactctttgagggatcagccgctcagagctgaggtaccccgacttgtgcacttctttgttgtattccccgaacttcgcctgc

SEQ ID NO: 651229 - DNA, 737 bp, Homo sapiens
  misc_feature (49)..(49): n is a, c, g, or t
  misc_feature (89)..(89): n is a, c, g, or t
  misc_feature (114)..(114): n is a, c, g, or t
  misc_feature (171)..(171): n is a, c, g, or t
  misc_feature (178)..(178): n is a, c, g, or t
  misc_feature (194)..(194): n is a, c, g, or t
  misc_feature (202)..(202): n is a, c, g, or t
  misc_feature (217)..(217): n is a, c, g, or t
  misc_feature (221)..(221): n is a, c, g, or t
  misc_feature (224)..(225): n is a, c, g, or t
  misc_feature (228)..(228): n is a, c, g, or t
  misc_feature (230)..(230): n is a, c, g, or t
  misc_feature (238)..(239): n is a, c, g, or t
  misc_feature (254)..(254): n is a, c, g, or t
  misc_feature (260)..(261): n is a, c, g, or t
  misc_feature (286)..(287): n is a, c, g, or t
  misc_feature (316)..(316): n is a, c, g, or t
  misc_feature (319)..(320): n is a, c, g, or t
  misc_feature (324)..(324): n is a, c, g, or t
  misc_feature (340)..(340): n is a, c, g, or t
  misc_feature (350)..(350): n is a, c, g, or t
  misc_feature (361)..(362): n is a, c, g, or t
  misc_feature (440)..(440): n is a, c, g, or t
  misc_feature (469)..(469): n is a, c, g, or t
  misc_feature (496)..(496): n is a, c, g, or t
aattttttttaactatggtttgtttccttatgttctttttttgtcagtnaatcttcacaatcccacctgtacattttaacattcatggncttgtaatggtgatgctttggctancagcctagtagatgtattttatttcaattttatgatactacagtttcaaagtatttnttcaganctctgaatataaaatncccctaanccttaaaggccaaancccnttnnccntncgggtttnnatctttggccacgcngttagnncttagtgactcctcttctcctttgnncttttaaaatactgactattcataatggnggnnaatngcaaccaactcttttngtcccattanacatggttggnngttctggcctatggcttgaaacaaataaccctgggcatacatttttgaaaaacattgtcagattcattgctgtaggtntgaggggttaataatctggaggggaattntggaattaagctgaacccatgcctgcntatttaaaaaacaaagcggcttattttaatagtatcaaactcttcagtatggtattgaatagtcagtcatattttctagctaggcatatgggtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatca

SEQ ID NO: 651230 - DNA, 573 bp, Homo sapiens
gaggaactccactggaatatttgctcaggggaaactaactaatcatctgtttcaaggttggtattcattttagtctttgacctctgattatggggactttcagggaaagctgtttgcaaggtgagcatgaatcaggtgaaacagcaagatctgaagtcaggacagagtaagcaaattatccacagacctaatatgtaccctctgaagctggaaagtgggggccacctgggtagcatttgagcaggggtcacttatgttcccccataagtctgcacagctcctaaacaaggtccagtgggcaacttatttttatgtggtccctttatagcatgctgttaaggggtgcataaccacaggccagttgaggaaggaaccctactggatttaacccagtgacattatataagcaatcgcttggagccacataggtagttcgcaggtcctgaatatgtggtgcctgaaagcataggtgtaggcagtgttcattgcataggcattagctggacaggtttttttccatattggcacttattaattgacaaggtcagggtacacttccaatgagtgtaggga

SEQ ID NO: 651231 - DNA, 1119 bp, Homo sapiens
  misc_feature (14)..(14): n is a, c, g, or t
  misc_feature (21)..(21): n is a, c, g, or t
  misc_feature (1113)..(1113): n is a, c, g, or t
  misc_feature (1115)..(1115): n is a, c, g, or t
  misc_feature (1119)..(1119): n is a, c, g, or t
gaatttcgggcacnagaaggnaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttccccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtgctctgcctcttccaggggcacagatagtggaaaattgcctgtatgcaatactatgtgttctataaaatggcatgaatttagtttaaattatcgtaaacatttttaggttacagaggtgaaacatgcattctgtgtgaaattccaaaaaaaaaattataaaatctaaaatgatnancttn

SEQ ID NO: 651232 - DNA, 149 bp, Homo sapiens
ctcatcacgggcagcagtcagcacagctccacagcccccagcacaacagcccagcccatgccggtccatacagggcccgccagcagccagctgcacagttcaacacccaggcaggccactcacagctgtccctcgcggctcacggtcag

SEQ ID NO: 651233 - DNA, 930 bp, Homo sapiens
tgagacttgtctctaaaaaaattaaaagaaaaaaggtgagaaagtctgttaataagagtccagtgacctttaagacagctgcaataagggcttgaagaacagttaggaaaatgctatggaaactgatggaaaggagatccttgtgtagcggcagaaagtttagcaacactgtctcctgcattagtgtggagggtaggaaatatacctaaggaacggatggtctagctaaggagctttccagacagaatgttgaaggtgccacctggcttcttgctgcttatagtaaaactgaagaggagagagtaagttaaagaaaaaaaacacttaaatgaaaaagagcctgaaacttgtgggtttgaaaattcccagcctttccagataacaagtgatgttaaaattaacaaatggcttccgtgcaaagattaaatacaaggcattaaatacagggaaatgtggtctaaaggtcaagctgaggatgtgatgaaaaagtcctttgttaagacctcagaaataccaacaagatgcctcagaggggacttccagtcgaatgaaataataatcacgcttctgagaaggttaaaggtgttgtctttcagcgtctcagcacaagcccaaagtagagaagggcttaccttgcagagattttcttttttctttttcttttcttttttttttttttgagatagctcactgcaacctcctcctcctgggttcaagtgattctcctgtctcagcctcctgagtagctgcgattgcaggtgcccaccaccacgcccagctaatttttgtatttttagtagagatggggtttcaccatgttggtcaggctagtctcaaactcctgacctcaggtgatccacccacctcggcctcccaaagtgctgggattacagcgtgagccaccgcgcccggcccacattcccttccagt

SEQ ID NO: 651234 - DNA, 1203 bp, Homo sapiens
  misc_feature (14)..(14): n is a, c, g, or t
  misc_feature (21)..(21): n is a, c, g, or t
  misc_feature (1197)..(1197): n is a, c, g, or t
  misc_feature (1199)..(1199): n is a, c, g, or t
  misc_feature (1203)..(1203): n is a, c, g, or t
gaatttcgggcacnagaaggnaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttccccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtgctctgcctcttccaggggcacagatagtggaaaattgcctgtatgcaatactatgtgttctataaaatggcatgaatttagtttaaattatcgtaaacatttttaggttacagaggtgaaacatgcattctgtgtgaaattccaaaaaaaaaattataaaatctaaaatgatnancttn

SEQ ID NO: 651235 - DNA, 902 bp, Homo sapiens
  misc_feature (816)..(816): n is a, c, g, or t
tgagacttgtctctaaaaaaattaaaagaaaaaaggtgagaaagtctgttaataagagtccagtgacctttaagacagctgcaataagggcttgaagaacagttaggaaaatgctatggaaactgatggaaaggagatccttgtgtagcggcagaaagtttagcaacactgtctcctgcattagtgtggagggtaggaaatatacctaaggaacggatggtctagctaaggagctttccagacagaatgttgaaggtgccacctggcttcttgctgcttatagtaaaactgaagaggagagagtaagttaaagaaaaaaaacacttaaatgaaaaagagcctgaaacttgtgggtttgaaaattcccagcctttccagataacaagtgatgttaaaattaacaaatggcttccgtgcaaagattaaatacaaggcattaaatacagggaaatgtggtctaaaggtcaagctgaggatgtgatgaaaaagtcctttgttaagacctcagaaataccaacaagatgcctcagaggggacttccagtcgaatgaaataataatcacgcttctgagaaggttaaaggtgttgtctttcagcgtctcagcacaagcccaaagtagagaagggcttaccttgcagagattttcttttttctttttcttttcttttttttttttttgagatagctcactgcaacctcctcctcctgggttcaagtgattctcctgtctcagcctcctgagtagctgcgattgcaggtggcacgcctcggtggtcccggctacttgggtggttgaggcgggagagtcgcttgancctgggaaggcggaggtttgcggttgagccgatattacaggcgtgagccacttgtgccccgggccaatttgcagagatttcaaggt

SEQ ID NO: 651236 - DNA, 1473 bp, Homo sapiens
  misc_feature (14)..(14): n is a, c, g, or t
  misc_feature (21)..(21): n is a, c, g, or t
  misc_feature (1467)..(1467): n is a, c, g, or t
  misc_feature (1469)..(1469): n is a, c, g, or t
  misc_feature (1473)..(1473): n is a, c, g, or t
gaatttcgggcacnagaaggnaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtaagtttgatgaaacatctgcagattaattggctctgccagatagcgaaaaatctcttaatttacccagatgtcctaattaattgtaatcttgttatttgtgtccacactatgggaatcctaaggtcatcctttcggatcatctattccagaaggtcccccagaagattagggtcttagcctcccctacaccagcaagactcagatcctttcttgaaaaagctccaagtcaataagaaattaaaatattgtactttttttttgaaacaggtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttccccacttttaattccaagcacccttagccctgacatctgtcaagctttggggccacaaaataatttaatataaccctaagcaaaatgcagtgacggagttaaaaaacaaaatgcatcttaagtcaaataccagtgatttggattagcattaaaagagctttagaattctgttgtaagtcatctgtgctctgcctcttccaggggcacagatagtggaaaattgcctgtatgcaatactatgtgttctataaaatggcatgaatttagtttaaattatcgtaaacatttttaggttacagaggtgaaacatgcattctgtgtgaaattccaaaaaaaaaattataaaatctaaaatgatnancttn

SEQ ID NO: 651237 - DNA, 318 bp, Homo sapiens
cgatgtctgaacataaaaactaaaaccaaaaaactttttcaagaatgcttaggagaacatcttcttgacataggtgggcggagatttttaggtgaaatacactacccctaaaattaaaaattgatggccaggcatgccggggtctcatgcctgtaatcccagcactttgggaggccaggggggggggatcacttgaggccaggagtttgagaccaccctggccaacatggggaaaccccatctctactaaaaatacaaaaattagccccatgtggggacgggcacccgtagccccagctgttaaggagactgagggaa

SEQ ID NO: 651238 - DNA, 672 bp, Homo sapiens
ttcacgagaaatatttatttatgctttgtggggttgacggttttaacatagcaaaccaagatggattaccacttgtgctgaaagcacattattctccattataacctactggattctgctaacacagatgtgcattcaagtaggaccgtatgttagggatgagctcaaaagatccacgctacagctttctttgcgtcttaaggacctaatcctcttcttactaacagtctatggcctgatcaccaagagacaggaggacaataatgggggtgtagtgccggaaaagtttcctcgctcctctgaagaaattcacatccggtgcgattccttcagctgcaaggatatagaaactctttgactgtgttgagggatctgatactgcctttcagggcttctagtaaaagagcccgtgatatactagcggggactggctccttgttgtgtttgacaagttcccccaagagtgtgggagaattggttacctaataatccgtgaaggacaaaccgacggggctctataagacgtttaaaaggcccgggtgcagaaaaccgccagggtttcattagtgaaggcaacctggaatctcttttcttccgaggcctggccgggtaagccggtttttccaaaacaattggttccgtttttttacaggcaaccagggtaattttatg

SEQ ID NO: 651239 - DNA, 133 bp, Homo sapiens
actagcattagttgttgtgactggagggtgtcaggctcagtccaggtgaaagcaaataggttttgggaatcagggtgtagggaaatggtaaagaaggcatcctccatggtgctgacatcctccatggtgctga

SEQ ID NO: 651240 - DNA, 878 bp, Homo sapiens
aaaggaattgatatatttgtcatagtttacaaaaaaaccacaaactttagcactgacgcaggaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaaatcatgcaagcttgggaaactctggagagaggctgcctttctggttccatctccttgggtgtgaggatagaatttcgaacaccaagagtcaattcccttgacttgcagcccgagtaaattcaaagcctcctcctacggtcagaagacactaaagggaatattttgcctcgctgcaattcattcaggaaaacaccctgctggggggcatcttatgacagcactggtcttctgccaggagttaaggtgaacatttgatagcttcttaccttaaccagccaaaaaatttttctccaccataaataaggtctaattaaattgtattaatgagaaccttctgtctaaaactgtaaatggattgcccaacactgtaatcttttcatagccttatatttttctaatgtgcgtagactatcttggcctgacgggcccactccactatttgttttgtcaacatcaaaaactgcctcaatctgttctctttcttcctatttcatcgtttccacatctgtgaacctcacactccccgctttttcctcttctcaccaatagctcctttcagaaaaagccgtatctcatccccccacaaaaaaaaaaaatatatgtcttctcttgactcaaaatgtggaacttatcgcccctctccctttgtggaggttatctaataaacaccg

SEQ ID NO: 651241 - DNA, 822 bp, Homo sapiens
  misc_feature (243)..(243): n is a, c, g, or t
gaagagaaaatcagccgagaaggatagattaatggttagtaccaaggaaacatgaatgcagcgttttccagcttgtagaaagctccaagcaatctatgactgagaaggagaagcggaagctcctcaataaactgacgaaatcaactgatgagagttggaaacaggatagatgaacaagtcactaccaaaaagagcatggctggtgttgattctacctagactgcacatcgggaataacacacntagagaagctgctaccgagagcattcgtggagctgggagaaggacaagaattcaactttaatgtcaataagttaaaccagtacagccaacatatttctctttttgggcaaaccctgaccgggatgccacacgctagattcactggtgccatcagcgaagattgacattgacccaagatatccaggctggtaatggaagaaacggcaatgatatctacgggaaaacagagtctggagttccgtgttaacgggattacttcgaagaagatcctgaagagtgcagtggataaagagagacgaaagtctttagtaaaaccagaattatggagactggcagtagaagaacttggagaatagcctcaagaagacaaggaaggcctggaacgaattgcttaaaacgtactccagcgacctcctccttgctctgatgcaaagagccagaaggagacagcagcgttaatggatgatgaacaatttgaaactatgacctttgggaagcgaactcctacaagactgtcatcaatgtcagcagaaacttgagcaaagacctcaatccagccatccttggtagtaaattcca

SEQ ID NO: 651242 - DNA, 119 bp, Homo sapiens
tggcgccgtcctctattgctcccgctgtggcgataaacttgtcgcgtgtcttcctaaaatctctctttgatcctgtcctttgataacaccgtcagtgcctactactgggtctagacaga

SEQ ID NO: 651243 - DNA, 179 bp, Homo sapiens
gtaattcgcccaaaattgacgaaacaaaggagaggagaggcaccgatatatgtctctaggctttagaaaacatggagttgtctcttgcacattatgcgaatctataagaggtgatatagtagacatcaagggaatgggtacttgtcaaaaaggatgccccacaagtgttacatgcaaac

SEQ ID NO: 651244 - DNA, 469 bp, Homo sapiens
  misc_feature (459)..(459): n is a, c, g, or t
  misc_feature (461)..(461): n is a, c, g, or t
  misc_feature (463)..(463): n is a, c, g, or t
  misc_feature (465)..(465): n is a, c, g, or t
  misc_feature (467)..(467): n is a, c, g, or t
ctaatgtaattggtaccactgccttgatttatgctgagaaaccagccattgtacccacttttgcttttatataatcatggcaagtgtcaatgaaaaagcaggcaatgactttgtattactttcacaaatttttaaaatttttcatcagctttctcaggtttaattagtatgattcagaacagtgttggccaggcacagtggctcaggcctgtaatcccagcactttgggaggctgaggcaagcggattacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaantnangntntc

SEQ ID NO: 651245 - DNA, 164 bp, Homo sapiens
ctaaatgtccagaatgtaagatatttcatactgaaatctgattaccagaattaattacattagaagaaatattttaaaaagctcataactattacgtagcagatatgttttcaaagaacttgttataaggtgggtcttggtggctcacacctctaatcccagca

SEQ ID NO: 651246 - DNA, 116 bp, Homo sapiens
atgaggatagggagaacagttcgagaagaacgtagagaagaaatttgagaaatacacagaggtattcaagagccacggactcctggtctgagcccaataaagactgttaattccta

SEQ ID NO: 651247 - DNA, 507 bp, Homo sapiens
  misc_feature (10)..(10): n is a, c, g, or t
  misc_feature (18)..(18): n is a, c, g, or t
  misc_feature (32)..(32): n is a, c, g, or t
  misc_feature (52)..(52): n is a, c, g, or t
  misc_feature (112)..(112): n is a, c, g, or t
  misc_feature (133)..(133): n is a, c, g, or t
  misc_feature (138)..(139): n is a, c, g, or t
  misc_feature (161)..(162): n is a, c, g, or t
  misc_feature (211)..(211): n is a, c, g, or t
  misc_feature (229)..(229): n is a, c, g, or t
  misc_feature (438)..(438): n is a, c, g, or t
cctttcatanaaagggangaagggaaatgtcnagagacctatgtgaaccatngagcatctccattcttataataagaaagctgggtaaaatgagggctgaaagttactgggnctgcattcccagacgtgatanaagcnnaatctaagtcattgaatgtcanngcacaaaataccagggtcattaatggacccctttgctgataaaacaggnttggcagtaaaaggagcnccagccaaaacctaaaatggtgaccaagactgatcctctggtcgtcctcactgctacactcccatcagcaccatgacagtttacaaatgccatggcaacgtcaggaggttaccctatatggtctaaaaaggagaggcattaataatccaccccttgtttagtatatcatcaagaaataaccataaaaataggcaaccagcagcccttgnggctgctctgtctatggagtagccattcttttattcctttactctcttaataaacttactttcactttg

SEQ ID NO: 651248 - DNA, 278 bp, Homo sapiens
acgtgatttggaagaaagaattatccctgccagacggggtggctcacacctgtgatccccagcactttgagaggccaaggtggtaggatggcttgagcccagcagttcgagaccagcctgggcaacatggtgaaaccccatctctacaaaaaatacaaaaattagcttggcatggtggtgcaagactgtaccaagctactcgggaggctgaggtgggagaatcacctgagcctgggaggtgggggctgcagtgagcggtgatcctgaagtgtcaacgt

SEQ ID NO: 651249 - DNA, 538 bp, Homo sapiens
  misc_feature (89)..(89): n is a, c, g, or t
  misc_feature (208)..(208): n is a, c, g, or t
  misc_feature (261)..(261): n is a, c, g, or t
gtgatgttatcccaacaccaagtacacggctaaatctgacattattgatcttttctccctctaagaatatctttgtaggccataagtgngagatggcagatctcctgagcttcattcagtcctttatggaaatatttatgaaaaccctactgtgtgctcagtagctatcagagttcttggcatataaaagatttcaaaataaatttgnctagtattgctttgggggatgaggacttggtgatatcttcctctccccaaaanaaaaagtggtgtgtgtgtgtgtgtgtgtgtgtgtgtgtgtgtgtgtgtgtgtgtgtgtgagagggagagagagagagagagagagagagagtgtgagagtgtgtgtgtatacagagagagaatgtgagtcacagtcttatctttatcttctctcatacaatgcacgctatgtggaattgtagagctggaagtgatcttagctaacattctcccaatctcctacccaatacaggagcgtcttataacaataaccttcatcagagggtggaccgctaaa

SEQ ID NO: 651250 - DNA, 651 bp, Homo sapiens
tgagcccccccccccccccccccctcgatatgagatacaaaaatccccaacgaaggaggatatagtctagagtttccttatacgtggtttaatttcgttttatggagattggttacggtaattgtctaactagaaggcgcctccgacgtggttggttattagttcaaggacgcttttgactcctcctcgttagccggtgacgcttccggatatggtgtattatagtcttttacgttgaggtctcgtatctctatagtgtccttctattcttcttcgtcgtcttctagcgttacgtcgtagtctaaatccgcagaagaaggtttaggtactttttaggcttgagctaactcctatagcgtggcggaattatctttcggttccggcgactccttgtcgatcttaaaatagtccggttatggttaggagtatacgggggctacgtctatatcctcctagggtacttatgtctccggcttcttctcggggttccgttctgaggaagacggttctagattataggacattggagccggggtatcttcgtagtgttccggtttcgagcgcacccgtgacggctcctagttttgtatgggctcttaattgcatggatcttaattataatttagggcctcccgggcctcctagatgaga

SEQ ID NO: 651251 - DNA, 299 bp, Homo sapiens
agcggatccagttcctgtccccggcaggctccggcccagaccaggcccccggcctctcaccccgacctcaggtttccgccacagcccccagcccaggccctggtacacgcgtccggcccctgtccgtccgtgccctggcccccacgccgactcccgtccctcagatctccttttctggcgtcccgcgacgaccggtcccgaataggcccccgtgctgggcccttcttcagctgggctgcgcacctactccttggacgtagacgctgccagctgctgctcctgctgcttcttccggataa

SEQ ID NO: 651252 - DNA, 308 bp, Homo sapiens
ggctaccagcgcgttgcctggccactaagagcagccagagtgtgtggctgtgtgaggcgagaggggccaggagcaataaagcaaatcagatgtgggttctagagctgggtcgacatggtggcagggccagacaaggcccactgaaggacccatagggccctgtgtccttcgttaattcttctccggtcggtttctgttcaggacagctttaggggcaaattccagcttgtccttaaggctcaccacctgggtgtggtccttgcctagcagctcatccagcttgcggtcctccctgttcggtttatact

SEQ ID NO: 651253 - DNA, 717 bp, Homo sapiens
ggccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagacgataataactgacatggcaaaacacacggaactggcaacgtaggattacccattggccaaggaggctttggctgtatatatcttgctgatcactgacacttcttcagagtcagttggcagtgatgcaccttgtgttgtaacacagtggaacccagtgacaatggacctctttttactgaacttaaagttctaccaacgagctgcaaaaaccagagcaaatccagaaactggattcgtacccgtaagctgaagtacctgggtgttcctaacgtatcggcgggtctggtctacatgacaaaacatggacaaaagtcaccaggttcatgatacactggatcgcttcgcggagtgaccttcagaaaactatatgaacgcaaatgccaccacggttccctcggaaaactgtcttgcggctaagcttacgactcctggatatccctggaatctactccccgagcatgagtatgtgcctggcgcatatcacggcctcaaatcttcttctgaactacaagactcctgaccaggtgtactcgcgcagattatgggcctgctt

SEQ ID NO: 651254 - DNA, 1087 bp, Homo sapiens
ctaatcaggcctatcttcctgtatggtgaacggacacagcatggtcagcgtctccacaccaatctcagcaggtgtatgagagtgagaaagatgaagcatggattcctgtacatggtctatgcctcccaggcagacgttcagggatgcacacattgtccagttgtacaaaccgagaacaaaatgcagctcttctagaattgtttaaacccttaccaaggaaaaaaaagggatgttaccaactgagatcgatcagttcatccaatcacagatcatcatacagtagtgttcccacctaggagtgtaaggaagtagtgtttgtgtttcaagcagaaaacctgagctccaagtgagcacattcagcttcggcaactatattatttactgtaggctagcttgtacacaaattttaccagtttaaaaataaaatacttagcattctaagtagccaataaaatagaccttcaagttatgtgaatgctcttacactcactactaggaccttgtaattccagcagtaatttacaggctttcagagagaccctgagtcttctcttcaggttccacagaacccgcgccttacgggtaaagttactactcagctagcgagatctccctaagaggatctctaggactggagtgtgacgcgcaacccccggcacaacgcatatggccatcacagacgcgacctatacgcagggtaaacgcgctgtgtgagcaccacggcactgatggcaacagctgaaggtcctgaaacctacaagaccaaaccaagtcctccccaatgcagggctaacatacagggagagacggcccctcgcaagtacacaataaagaacacactccacagggaccgtgagacaccaccaacaccaggaccaccaccataccagaccgcgacacaaagggccccatcgcgaacacggtggcaagaaacaaaacaccccagaccaacacaagcgaaaaaccaccgcacctcggcagccggaactcaaatactgtgcaccagcgccaaccctgcgatcaacaggacacccgtccctagcctcaacaacacagccgagataggacgacgaccacacggtgaagc

SEQ ID NO: 651255 - DNA, 342 bp, Homo sapiens
ttttttttgagaaggagtttcgctcttatcacccaggctgaagtgcaatggcgcgatctcagctcactgcaaccttggcctcccgtgttcaactgattatcctgcttcagcctcccaagtagctggaattacaggtgcctgccaccatgcctggctaaattttgtatttttagtaaaaatggggttttaccatgttgtccaggctggtctcgaactcctgacctcaggtgatccacctgcctccgcctcccaaagtgctgggattacaggcatgagccaccgtgcccggctgactgctgacttttaaaagaacaatttcattaaggttgagaagttaataat

SEQ ID NO: 651256 - DNA, 1126 bp, Homo sapiens
ttttgttggctatgtggtgttgttgtgttgctgtgcttgtcttgtggtctgggggtgttccgtggttgtcatggttggtggtggagtggcggggttgaatggttatgttcagtgggggtgcggtgtgtggtaactagtgcaggtgtagtttggcgctgtgggtggtgtgttggtgccgccaggtagtaggcttggggggagtgagttaggtgtgggcaggtcgcctatgtggtggctatgaagttgtgctgtttggtcgggttgattgtttgtgtatttgattttggttgcttgtggggagggaattattcgtttgcgtttgggtatgcgtggttggggcttcgtttcacatgtctcaggttttgtaaggtgcttggatagagagggtcttgtataatttaacgtggggtgatatggtatggcttggataaggttgtccgatagatagttttgaatgttcaattggtgaatgagggatgaatggtagcgcctgggtaaatgtaacgtaattgagtgagcattattgtgagcacaggggaaagcgtgtagtggggagtgcaggtgggtgcgcggaaaagcgaagctcgcttgagcatagttaagtgcaattttgttgttgcgtctcataaattatctgagatgtatatttcttcgttggtattgttgggagaaatgaacagttttagtagatagtatttgctggtaggtgttgtgctgcttccgtgtgaggagtatcattatatgatgccgtgctgatcagttagcgtgtctgcgtcatgtggttggtggtcatggaggttgagtgtcttgttggtttggagcgagttttggcttgccagtccgcctgatagacatgggtttaaaaagtgtatgctaagtataataagctggatgaaagtatggagatgttgtgaatctctctaagaattgtatgcaatctgttgaaaggttatgtgttttatttacctgactatatggatagttatagaagtctaataatgttaagcatccagtaagttattagtatttttgtacaaatgctgtgtatgctgtagatgtctgtattattgagggtcaactcgggattttaagttccataaattaacttgtatccggatctcgtata

SEQ ID NO: 651257 - DNA, 793 bp, Homo sapiens
ggcttccggttctgacggacgcttcggccgtaacgatgatcgtgagacatcctgctgtacgggacgttgtctagatggacagtgccggtggcgcgctgctggatacctattaatgctcgacccatgtaaggactcgcatgatgttggggaggagtccagggcacgccctggcaccaggatggaccagcatcgcgggcaattcttgactggagtcctcagaatactttcgtacctctttcagtcgccctgtggaagcatcttcattgatgtctgcatgatgagtgctgctcagagtctcttgaatcccgagcgatgagaccaggaattcactttcccggttgatgccgcagtctctgttgcctccattcctgatgacttctagaatgtttctgatcagaaaatcagacaaccttcccagaaggtccaagctcgtggtgtggtgcgaaaacgtgttcgccgaggtgtgcctggttgcccaggtgcacgtccctgctctacaaagatgagtcgcgcttgagtctctgagatggcaatgcttgtctactgacaggggctccgggggagcgtatatgtagcggggctgtgctgaccgtttgcttcccctgtggatcttcgctactcgttttctatcccagagatctgagcccaagggtcggcttgtagttgaccccaggccgggttttgggccttccgcgtgtctgctgagtcctgccctctgtgcccgcggggccctgttgcgcagtggttccctccccggttgtgttgcccccggcgtggttaccttaggttggag

SEQ ID NO: 651258 - DNA, 115 bp, Homo sapiens
atgtatgggacggggtattgctatccactctacttatggatggcatctgaccccactgctgcaggagctcacgaaggatcactgggacacactggagttcttcctgtgcggcatc

SEQ ID NO: 651259 - DNA, 328 bp, Homo sapiens
aatgagaaggatgaaagaggaaagtgaagtgatacacacacaaaggacacccagagagagagagacaggacttaactctctttgcaggaatagttaaagtaagaaacacctggactgggtgcggtggctcacacctgtaatcccagcacttagggagcccgaggtgggcgaatcacctgaggtcaggagtttgcgaccagacctggacaacatggtgaaaccccatctctactaaaaatacaaaaattggccgagcgcggtggctcacgcctgtaatcccagcactttgggaggccgaggcgggtggatcatgaggtcagtatagata

SEQ ID NO: 651260 - DNA, 185 bp, Homo sapiens
  misc_feature (154)..(154): n is a, c, g, or t
  misc_feature (167)..(167): n is a, c, g, or t
gacttatcgacggttctccctcacctgtctttaatgtagtgtgacaattttccataataaactacttaaagagaagcttggtcaagaatggaatgaaatcgcaaaaaaacaaacaaaaaaatttactgcttaaaaaaaccaacactttcaccanattttatattcanaacaaaaccacacgggca

SEQ ID NO: 651261 - DNA, 445 bp, Homo sapiens
attgactgtgcaaaagaggaagagaaagaagtagaagtaaccagacatctgctaatcgcgtgccatgtgccaggtgctttacccaatcgctgcatgtgtagctcccaatgactctgataaataagatattgtaatatctactttatataggaagaagaatgaaggcactgagactataagtaaccacctccaaagctgggatttacaactcgtatctgggattcagaggcctgtgttctttccactacacatgctgtgccctatgattcaaggcagaatgtgataaatccttggggagaagctacagcaaggtagaagaggaagagaagagattgctccttgccctgagggtaaaggtacatgacaaaggtaggtcttagaggtcaggaaggcttacgtttgacagagatggcagggtgcaaaaaattgcacaagcagagcagaa

SEQ ID NO: 651262 - DNA, 1523 bp, Homo sapiens
gttcttttgggccacatcgtaagaaatctttgtctagccaaaagccacaaatcaatttctccatttccggcttctggcacagcatgtcaccagtgtcacacatgttcatcatttgggcactgttcatcctcaatttgcattcaacattgccactcgtcaccacatcatgcatcatttgcacattgcatgcacaacacattcagtcacacatagttcaatcatatttttcaacaagtcagcccaacatctatgccacatcttcatcatcatcacatcagcagcacagcactcagcaacacatccccgcacatcatttcatcttcctctatcactatacgtcacttacactcacacacatctcgagtcatatatacaggcaattctcggctttcgtcccagcatcacaccccattacaaccattgccccccagctcatcatgggtatcataaatactagggcctaagggtagcacagaacgaatagttgggcaaacccattttcacacgcaatagctgcaagcccagcacagttcacattcaccatcaacccaccgggcctcatctctctatcacagtggtacttctaccacactctggcaacactatgcgcgcaatccatacagcgcccccccagtactgtctgatctccttatccccaagattgttctatataaccgcaccgtagccacaatcaatactagcacccactagctctacacgtcattatgtcccccacaccatcattgtggcgcagcaacacacaacttccacaacagtgcgcacccacaagcaacatttccaacaaggcaagcttaacaccaacaatagcgctcacagaccacactcttcacttcaggcaccaaggctctgggtccccgttggaaagagtatttctaacgtaccacaacaccccacacatttcagcccccaccactgggagccaatttctcacaggaaaacagcccccacacccccttatacagccaagagctatatcccattaaggcaggattgccacttccatatacaacttaagtttaaatttaggaaaacaaaactaaggggataggaataagcctaacgagctacacgatagaccacgttactacattaatattacatcaaagctaccattcccgacagcagcaaaccaggccacgctcacccccctgccacaaaccagcctacccaccaccagcgggcacaccaaccaaccgcgcctggccaacaccaacaaaccaacctgtccacagcgagctcacgaaagcccacaaacacaacaaagacgcggcgaaaaaatataacaccaagcccaacggcaaacacaccacaagcacatacacagcacaacgcaccgcaccatcagacccaacccgaccgagctcaatcgaacacactcacaacacaacatcaatcaaacaacacactaaacaccaatacaccacaacccaccccaaaactagccccacaacacccacaacaacaacaccatcaaggaacacacccaacaccacgcgacacaa

SEQ ID NO: 651263 - DNA, 166 bp, Homo sapiens
gaccgagttctctctgtggggctggacgttgcacctcctaggccccagaaacgagtatcagggtcaggtcctctgtgtgcattcctgggggtcatgtaccagctgtgacgacgtccaggggttgggccgagaagcagacacccttggggaaactggctctgtccct

SEQ ID NO: 651264 - DNA, 608 bp, Homo sapiens
ctgcaatataagcaatgactgaaaataaagaggagaatatcactgaaacataaggaacacctctcttgctgcaaatttcgaaaactggcggtgccttccgttgtacagacatggcgtataatgttcttgaacaactaaataacgaggatattcctgctgtagcagtgaaaaatatcagtattgcgttaaaagcagatgcgaaagtacatagcccaaagttctgcaatgcaacaacccaaggactagaataacctgttcctactgaaatctgcctataatcaataccgccgcgacaattagtcctaagtctccagtccattcctgtgccttttataatggcttcatacctcttttcggaaataccaggaaaatatgatagtagtcttggatcgccactgtatatgttgatgcctaccgaaaaaatcaaaaaaacgtaagatatcagtacaatggaaaatgtcctttttgtagcagaaggaattgttttccttggatttatagcttccccactagctaaaaaagtcatctcaacaccgctaaacgcaaatgttgaaattagcattactgatgccgtagctaaaaatcggccttttgggcctgaaatgcct

SEQ ID NO: 651265 - DNA, 106 bp, Homo sapiens
taagaccttctgtctggaaacagccagaagtcacaaattattaaaaaagttttttgtctgtattttgagacaaagcctcactctgtacccccaacgtctgcagtgc

SEQ ID NO: 651266 - DNA, 454 bp, Homo sapiens
  misc_feature (32)..(36): n is a, c, g, or t
  misc_feature (65)..(65): n is a, c, g, or t
  misc_feature (101)..(101): n is a, c, g, or t
  misc_feature (107)..(107): n is a, c, g, or t
  misc_feature (185)..(186): n is a, c, g, or t
  misc_feature (189)..(189): n is a, c, g, or t
ggagacaccattgtcggaagctccccaaggcnnnnnggcgggggcgcttgggctgggcctgggcngctccagccgggttaacgccgggccttcggagcgcnggccancctgggaagctgctcaaggttgggtaagctgctgggaaaactaggtcatatgtaattcacatgtcggtcacacgtcannaangttgaggaacggtgtgtggaggctccagggcctgcctgttccaggtctatcactggtttctcccttcactctaaacaggccaaacgtaccaagaaagtcgggatcgtcggtaaatacggggacccgctatggggcctccctccggaaaatggtgaagaaaattgaaatcagccagcacgccaagtacacttgctctttctgtgggcaaaacccaagatgaagagacgagcttgttggggatctggcactgtgggttcctgcatga

SEQ ID NO: 651267 - DNA, 137 bp, Homo sapiens
agcagtcccctgcctgtcagctgcgtgctgcctaagccctcaccctgagatgggagccgtcttcccagcccaccatccccatcgtgagcctcattgctggcctagttctctttggagctatgttcgctgagactgtg

SEQ ID NO: 651268 - DNA, 103 bp, Homo sapiens
ctgcaggcatgctcataaggaatggttaaaaaaatgtaaaggaactcggcaaatcttacccctgccttgtttaccaaaaacatcacctctagcatcagtggta

SEQ ID NO: 651269 - DNA, 109 bp, Homo sapiens
gatcccccttgcattaccggggagggaggagccttccctcaggcagttggggtgaagccccagaacttgctgcaggtgcttcagaaggtccagctggacagctcccaca

SEQ ID NO: 651270 - DNA, 720 bp, Homo sapiens
  misc_feature (32)..(32): n is a, c, g, or t
  misc_feature (93)..(93): n is a, c, g, or t
  misc_feature (99)..(99): n is a, c, g, or t
  misc_feature (130)..(130): n is a, c, g, or t
  misc_feature (143)..(143): n is a, c, g, or t
  misc_feature (146)..(148): n is a, c, g, or t
  misc_feature (150)..(150): n is a, c, g, or t
  misc_feature (152)..(152): n is a, c, g, or t
  misc_feature (188)..(188): n is a, c, g, or t
  misc_feature (191)..(191): n is a, c, g, or t
  misc_feature (197)..(197): n is a, c, g, or t
  misc_feature (201)..(201): n is a, c, g, or t
  misc_feature (212)..(212): n is a, c, g, or t
  misc_feature (215)..(215): n is a, c, g, or t
  misc_feature (234)..(234): n is a, c, g, or t
  misc_feature (238)..(238): n is a, c, g, or t
  misc_feature (267)..(267): n is a, c, g, or t
  misc_feature (348)..(348): n is a, c, g, or t
  misc_feature (356)..(356): n is a, c, g, or t
  misc_feature (360)..(360): n is a, c, g, or t
  misc_feature (362)..(362): n is a, c, g, or t
  misc_feature (430)..(430): n is a, c, g, or t
  misc_feature (435)..(435): n is a, c, g, or t
  misc_feature (438)..(438): n is a, c, g, or t
  misc_feature (448)..(448): n is a, c, g, or t
  misc_feature (481)..(481): n is a, c, g, or t
  misc_feature (489)..(489): n is a, c, g, or t
  misc_feature (645)..(645): n is a, c, g, or t
  misc_feature (710)..(710): n is a, c, g, or t
ccccttcctggcattctgttaccagacctcancctggcttggagggcccaggtttccttgttaggccctgcctcgcaccaggcaacgctaacncaggangggaggcttaggctaaggcacatttacagtngagggcccacgcnatnnngngntcacgttccaacgctgcagtgcccaccatgtgaganttncggggncgtnggtgcagccantgngccgtcccttctacaagcnagangtgttccctgcccgctgaggacggaaggngactcatggggccagatcgcagccctgactgcacactcccgttttggcaggtaactaaaatttgggggggatccccaagtntcatatgnacanancctgctgcccctcctttgtcccgttcttccttccatggcaggggctatgtgggcaccgggcgcttttnctggnagntgcgcttgtngtgcagacctgcagcacagccaccagcagcagnaccgccangttgacagctgaccagaagttgacccgctccaagttgccctcttgcaggttgcggtcacgtgcctcgaaggcccgcagtagcgtgagcatctggatgctgcgctccagccgggtccgcatggtctcaatggactccttgatgtcctccattttaanatccagcatctcctcgggctccacagcctctgcacatccttcgacctcctcgtcatcctggaggntgtcaaagat

SEQ ID NO: 651271 - DNA, 647 bp, Homo sapiens
agcggtgggtatcctgaggcgggatgtgcgaggagtggggactggagctctggagcactatggggagcggacgtcctggaggcttaggactagtgaagccgggtacgaggtagtggggacgacgtgagcaaattcggtggatgccactgaggttggggtgcggtcacgggtggatctttgggttagggctagttttgaagcttgagtatcctcacgacatggcagctggattcctgagagagagtgatctgagagagtgacgaagacagaagccccagtgtcttttaagaatatggtgtaagatacttcttcaagattggacagctggggaccttcttcttgattacccttaaaccaacttgtagccatagagacacctcaacaaggttcccatttaagtagaagtacgtacgttgattttctgctcacacactttcctgaccttgcaaaccatgtatggaaagtgcccgatctgttgggaaaggtggagccgacgcagccagagccctgggcgttcacccagagcttccacgttcccctcgctttgggtcaccgtcgaaaccaacagtaacgggagcggcagtacgcggaaggcagtgtaaggcaagtaggcagtgggaaaacccttacaatggacaatatacaaa

SEQ ID NO: 651272 - DNA, 373 bp, Homo sapiens
gagtataaaaggctgattagagatcacgcacatcttctcaaaagtgcactcctgggtctagagaagcagtttcagataacatatgggcggggctgggctgatgcttgctttgagcccacaggagctccctttttgaattgtgtggagaagtgtgttctgatgaggcattttactatgcctgttgatctatgggaaatctaggcgaaagtaattgagaagattagaaagaattagccaaccaggctacagttgatatttaaaagatccatttaaaacaagctgttagcgtttcgttaagcagtacatcttgtgcatgcaaaaatgaattcaccccttccacctcttttttcaattaatggaaaactgaaatgag

SEQ ID NO: 651273 - DNA, 1218 bp, Homo sapiens
tttcgtgttttgtccgcaccacccgcctactgatgtatgtgtgttgctgccgggtcgcccccctggtttgttagtagtttaggaattttatccgccgcgctcgtctgtgtgttgttgtttgtttgtctattcactacgacttttctctcgggttctttttttggtgtgggatgcgacaacacccctagtgttatgtgatgtgtgtcctcgcgtctgtataggagtgttttctcacacccaccagcatctggtgttgtgtcgcgtaccactattatcgtcacaccacgccgcgtcgtcgttttgtttatatctctctctcgccgcgcgcgctctcgctgctctatagattactcatcgcgctgctctctagatgagtgggatgcgcgcgagcgcgcgctgctgtgcgggtggtgtccgcgagattatcttctcgctcctcgtctagtggtgtgcgcgctcgctgttgctctctcacgcactccaccctcgctacgcgagaaagagagagtgcgcgcgcacgcgcgcgcgctctctctatatatagagaaatatgattgattctcacacgcacggcgctcatctcgcgcgcgctgctcgcgctgctctctctcctccacgccgctcacacacagcagaggcgtgtgtgtgcgagagagagagagagtagactcctctctctctctctcacacacacaccacacatatattattctctctccgctcacacacacagatatactacacgcgcgctgtgtgtgtgtctctccgcactgctctgctgctgtgtgagagagacagactattactctcagcagagagagagcgccccaccacagtagagagagaggatatctctcctctccatcccccgcacagcacagagagagagagagagagagagagagagaagagagagagagagcacacacacaataggtgtctctctcgaggggtctctcccccgcgcggagacacacacagagagagagagattgagagagaaagaatactctcgcacaccacaagaggagaaatatttataaatatgatgtgtgatttcgcccaccgtgtttcccacaccctcctgggctcctcctcccccccaccacgggggggagaatttctctcacacacccccgggggcgaccctttttatattttttttgtgttgggggggttattttctccacaaaaagtgggggcgcaccaccacacaca

SEQ ID NO: 651274 - DNA, 115 bp, Homo sapiens
ggatttgctggtgcagtacaactaggcttaatagggataccttagaacttaaagtaaaattaaaacaaaacaaaaatcaaaatatgtcagcaaagaaaaaacagtaacaaaaaaa

SEQ ID NO: 651275 - DNA, 843 bp, Homo sapiens
tgtgtgcacctgtctggatgtgcggactcgcctgtgagcgtattcaatcttatgacggattgctctttcccttgttcggcaaggcgaatgtctgtcctatacctgtaacacccattttatcctggaaaggtggaaaacgttgcctcaattcttggaggttctacaagtaagactctgggaatacggacttcttgagccgaagggctagatgctgaaatgagtgaagtcatttggggctatgaggatggaaaaaaacgtataatgtatttaaacgcttgttgagaaagacataacattgttggagactccaacgggcagaacactacaccgtgaaagtttgttccctctgaaattcatgtagcagtgaacttgtgtccccagtgtggcagtatcgagagtttaggccttcaagaggtaattggatcacggccctcatgagggaatttatcaacctaatggattaatggattaatgaatcgtcatgggagagatattagtggtttcaaaagcagagaaagagagacctgagctagcacactcctccccttcaccatgcgatgcctttcactaccggtggcaactctacagcgagtcgccaccagcgatgagatgctcatcagatatggatcctcaaccctgaaaggcttcatctccatactgcttttgaaataatcattaaaactatacatttaacaagatcggagtcatatggtgcgcatctgccagtacagcaataatacagaggactaagcaccaagggaatgagcctagaccaagaaaggtactaccaactgggtggtgaagcactggtgaacaggtggaagaattaactccagcactttt

SEQ ID NO: 651276 - DNA, 284 bp, Homo sapiens
tttgggttttttcccttagcaaagggttttccccctttttcccccttgtttccaaaggaaagatttcccccccttttacggtggattggttttccctgtggataccccggttttgggaaaaaaccttccttttttggttgaaaaacccccgtgattagaaaatttttttgtttttaagcctggtttgggattccggatatacctgtttttgtaatagttttttttttcccaatgcttcccctaatactggttttttgtttattaattttttttttggcccggga

SEQ ID NO: 651277 - DNA, 322 bp, Homo sapiens
  misc_feature (73)..(73): n is a, c, g, or t
atcccgtagaagagtgtgccatactcacttgaggatcttccttacagtctagcattctagaggaaggcatatnacagttaaactccaccattttgcctcttaatgtgcatgcttgagctcactcacccatctcttcagatcttattgggaagctgctgatcaccagttgcaggtttttttctatctatatagagactgcctttccctttcactggctgtgaccaattactattttagagaaacatttaacaacctcctgtccatcacctgatggtcacctgacattcctggtcaggtggaaccctctcctgccctgctcatg

SEQ ID NO: 651278 - DNA, 257 bp, Homo sapiens
ctcagcagctcgtcatccaccaggtgggtgagcacaccatttgatgactgctgatgattgtcgtgaaatataataacagtggaagtccagaattgccccgaagtccagaattgccccgaaggtccacgaacttgccccggaagtccagaacttgccccgaaggtccagaacttgccccgaatgtccagaggttgccccgaaagtcaaggatattgccccggatgatccagacattgccccagagatccaagaattgc

SEQ ID NO: 651279 - DNA, 130 bp, Homo sapiens
  misc_feature (118)..(118): n is a, c, g, or t
acttgttctctcgctagcagatgatacacagaataatttctgaaaaactgaagagcaattttattttagaaagtaatgcttaatgcttacacgtcgaatagccacaaacaagcatatnatattgaacaag

SEQ ID NO: 651280 - DNA, 245 bp, Homo sapiens
  misc_feature (236)..(236): n is a, c, g, or t
gtctgctctagaggacccccacgcgcaccgcgagtccaaaattaaaaattgtgtattgagggatactataaagagaaccacagaagtgggagaaaaatattttgcaaattatgtatctggataagggattaatggccacaatatatgaagaactcctaaactcagcaacaaactgattcaaaaatggggaaaggactttaatcagacttttctccaaagaggcacaaattgaccanacagacaca

SEQ ID NO: 651281 - DNA, 495 bp, Homo sapiens
gctttgaacacacagcgaaacgaacctacatccgcttcattgacgcttcgcatacggcgcactttcggatcttccatgaacactactggtttatggaggagatctcctggctgccgagcgggctcgtgcagaccaagctgcgccgagggttcggtcggctgttgcgccaggtggtcaagaagcgcagaccggaggggatcgttcctgcatgggggagcgcctattgggcgctcacgcgcgagtgctgcgagttcgtgctcgagtacatgcgcgagcgtcccgacgtggtgcggtgggtgcgcacctctttcgcgcccgacgagcagttcttccacacggtggtggcgaactcgcgattcctgcaccgctcggacgggttcgtgccgtaccaggcgccctcggtacacctgctgtccaacctgcacctgattgcgccggggctgcgcaaggatccacaccgagcgcgattacgacgatctggtcgcgtcgccgaaa

SEQ ID NO: 651282 - DNA, 277 bp, Homo sapiens
ttagatcgagctcggcccgatacctaattacgcgggtacgcagtaaaacctgggtctgaacgtcaaactcttcgcgattgactaaatccatgcggctgaactgcgcctgcaatacctgacggattttcttttcggcatcttcaccaaactcacggatccctttaggcatagattcgtgaacctggcgggcaatttgttcaatttttttcgggtcaatcatgttatttccttttctcgaaggaggtgcttttccttagtgtaatcgctgatgctgttt

SEQ ID NO: 651283 - DNA, 157 bp, Homo sapiens
tggctgcacctcatccctccagcacgctgtgccccctcaagcgcaccgtgtagaatatcatggatcctttgttcaggttctcttgagatgatgaagtgaacgatgtgcgcacgctgctctcaggacgttcgccaggcccttgcctatccccgtgagc

SEQ ID NO: 651284 - DNA, 441 bp, Homo sapiens
ggctcgtgcactagtacggcgcagttgctggactatcggttacggccgccctatttatagctaattttttacaggagatggagtctcactctatatgcccagtgctgcagtgcagtaggtgcaatcttggatcacatgcaacctactacctcccaggttcaagtaattctactgcctcagcctctgagtcgctagggcctacaggtatagctccaccaaaccctgctaatattgtatttttagtagagacagggttaggccatgtaagtccgggccggtctaaaactcctgacctcaggtgatctgcccactttggactcccaaagtgctgggattacaggcgtaagccaccgtgccccggacctctaaaaccatttttaagtatgctgcagagtgtagtacatatacactgatgtgcatacaatctgcagaactcttcat

SEQ ID NO: 651285 - DNA, 956 bp, Homo sapiens
  misc_feature (531)..(531): n is a, c, g, or t
gccgccaacatgggccgcgttcgcaccataaccgtgaagaaggcggtccgggtcatcatagaatatgtactacactgcgcctgggcaacgacttccacagcgaacaatgcgcgtgtgcgaggagatctgccattatccccagcaagaaagctccgcaacaacgataccgaggttatgtcactgcatctgatgaagcgaattcagagaggcccagtgatgaggtatctccagtcaagctgcaggaggcaggacgagagaacatggacgagaccacattatgttcctgaggttctcagcctatggatccagcgagacttatctgaagtatgatcctgacactacagcgaagagtgctgcaacgcttgtcggacttcggcacgtgctgtactcaagccttcatggtcactcgagcctactagttgaggtagtgaactttcaaatagcgcctcgtggagaccatgtatcgaagtttatgtcctgctagtcgctagtaattgcatttatccacattagaatcgttggtgaccaacnagcctagaaagaggagcagctataaccaggtacgaagcgttgtatgtaatacgctgggtgtgacgcggccaaagggaggaccaatggcactgtggcaccgtgtcggctcccggatagacgctgtgtgcactcctagacccacctagggtttcccttgtgttccggacaagctgagggccaagcgtctatcttcccgtggtgtctatcgccaataaaaaggccgaggttgagctgctttcccatccgcagaaaagaaagctccaggggggttaaacctcggggagtgtacccgatctccgcgagagaaaaaaccatgggggttcggtttaaccccaaggccaggggaatccctgggggcccccagttccccccaatgttggaagacggccagcaggaaaggcgcggcgtctatttcaacaattccg

SEQ ID NO: 651286 - DNA, 430 bp, Homo sapiens
acactacaaaggttagtgtgcatacaaatatagctgtcctttcagtagcctcggcacatagcataggcgctagtagaataaccttctgtagcagcaggtacggaaagtatggagcactcaccagtggtacagagcacattaacgaaaagacatgagagtggatacggctacttaaatgcaaaatgtctaggacagaactgtaagttcagttcagttactaggaagcagacactagaacttgatataacttccaaaagcgctcactcaagtagtagtccatattattctaagtgacaaaaaggtgctaagttatttacagatatcatggttgtacagtaccttttagatctgccatttcggtttcagattgtccattacgaatgaactgcactgaaattctttacctgatacttacgcaattcagttatgc

SEQ ID NO: 651287 - DNA, 160 bp, Homo sapiens
atgaccccaaactatgccgcaaaccaatccaatcagtaccacttatgtctgagaggaataacagatgtggaaccttatatctaagagtaataacagtgggagcatgatctgtaagtcatgtgcgttactactgtcggcttaatattactatttgcgcgga

SEQ ID NO: 651288 - DNA, 128 bp, Homo sapiens
gcagactgaggagcttatggtgtgggtgatcacggcccccgcagatggggctgatggagcagccccgttcttcacctggcacaagagcaagaagacggacatgctggcttcgtgaaggagatcctggg

SEQ ID NO: 651289 - DNA, 967 bp, Homo sapiens
  misc_feature (380)..(380): n is a, c, g, or t
  misc_feature (420)..(420): n is a, c, g, or t
  misc_feature (426)..(426): n is a, c, g, or t
  misc_feature (442)..(442): n is a, c, g, or t
  misc_feature (451)..(451): n is a, c, g, or t
  misc_feature (466)..(466): n is a, c, g, or t
  misc_feature (520)..(520): n is a, c, g, or t
  misc_feature (629)..(629): n is a, c, g, or t
  misc_feature (644)..(644): n is a, c, g, or t
  misc_feature (646)..(646): n is a, c, g, or t
  misc_feature (649)..(649): n is a, c, g, or t
  misc_feature (652)..(654): n is a, c, g, or t
  misc_feature (662)..(662): n is a, c, g, or t
  misc_feature (666)..(666): n is a, c, g, or t
  misc_feature (673)..(673): n is a, c, g, or t
  misc_feature (700)..(700): n is a, c, g, or t
  misc_feature (703)..(703): n is a, c, g, or t
gatgccctggcgggcgtagtgcagttgggtgacacggcgtcctgctttggcgcgtttggtgttagtacgccgctaaaacgcagttcgtcgaggccatcatctgccagccgcgctttagtgtaatcggaactgcgcacggtaagttcttcgagtatcgccgcgcgcatcgatccacggctggcgtagttttgccagcccttgctgcacgttaatggcaatctgcggatcaccatacgggccggaggtgtcgtagaccggaatcgcttcgttttcttcgtactgcggctgttctttgctaccgccaattagcgtcgggctaagctggatctcacgcatcggcacgcgcacgccggggtgtgtgccagtgatataaatgcgtnttgagttgggaaaggcggtgccttccagggtgtcgataanaatgtngggcccgggcgcgtangttcgcggncgggtcagttatgtngcagacatagctcattccaaaaagttaaggacgtggcttgtcagacgacggatngaagcaagagacgatcgccgcaggggcgatgcgatacgcagattaactcttgttccccttcgcaggtataagcctgatcaggttccgcggatcccgaataaacggtctnagcagtaaggactcngnacngannntaagcccngaanggggcantgaatgtacatacgcgtaaacaggcanacntcaccacaggatgtcagagccggcggcgtcagccacaaagatcgctatatacagacaagggcacacaggcgccgcgagcagacaaacccgcgaacccaggaccacacgatcgagcggcccaagggaagcagaacccaacgagaatagcagacggaaaatcccgacacaaatcgcgacacatagacagcgcacacgcaacggacatcccgtccgacgcactcgcccccccaagagggacccactcacagacccgaaagcgagtgg

SEQ ID NO: 651290 - DNA, 290 bp, Homo sapiens
agtagatctggttgtgtaaatataagacgagactgagacaacacagttgcggaatcagctatgacttatacttacatcagatctttctaatatctactacttgggtttcctagctccctaacacactcctataacctgtattatgaattacatattacaagtcataaatgtgcctatggatatacagtacattctagttggaatcgtttactctgctagaatttaggtgtgagattttttgtttcccaggtatagcaggcttatgtttggtgcttcttggtgcggtcgtt

SEQ ID NO: 651291 - DNA, 130 bp, Homo sapiens
ctaccccgattctgaggatccccagtgacggaatgaacattgatccgatcccatggatggagaagaaaggtggacagccgtgttcgtctctcatgtcagcctagggctgggaacagtatagtgaggactt

SEQ ID NO: 651292 - DNA, 284 bp, Homo sapiens
  misc_feature (256)..(256): n is a, c, g, or t
  misc_feature (263)..(263): n is a, c, g, or t
ggtatggcacggcatgatacgcttgatagagtcaccttctcctgcaggaatgtacctatcctgatgtttctctgccttgctgtggagtggacgtctgcaatgttgatcactatgatcagacccaaaccagggctatgcaccaaagagaggctcacctgtaccactgaacttacggactcatgtaacacagatattgactgcacggaactccataagtgctgcttttacgcctgtcaaaacaagagcatggatcccnttttatncagaagaagtgcatggatccc

SEQ ID NO: 651293 - DNA, 344 bp, Homo sapiens
aatcttagagttattagatacaactctaagggtgggtgtggtggctcacatctgtaatcccagcactatcagtaggccaaggcgagtggataccttgagcccaggagttcaagaccagcctgggcaacatagtgaaaccttgtctctacaataaaataataaattttaaaaacctcaaacaataaaaacggtgcatttagtacgaattatgatctgggtacacagaagagactaaaataacagaacttagagacccaggactttatcattaagagaagtgttgagtgaaccaaattttaattgggtgattgatcttcatatgagtatcaaataactgaaaagag

SEQ ID NO: 651294 - DNA, 946 bp, Homo sapiens
aaggtgtgtgtgtgtgtgtgtgtgtgtgtgtgtatagctatgtcttctcctatagaatattatagtggaagagataagaagggccttcacttataaaactatcgtgtttataaagagagaagtattcttcgtgatatatgagacactttacccatcatattatctgtgcgccaggtgtgttggaacgtcgcctataaggcatctgatcagggattatggtcttcccgcttctgacaattgacgatgagatgatcatcagaagcattctcatcagaaagatgtgatggtcatctcctctttgccgaagccatcctggtatgaaaccgaagaggagattgatgagaaaatcctggtggctctgttgtggaggaaactaaacattcccttgatggctctcacgtctatgatcagaagcactttaaattatatatttctcatcctataacgcttaatagtaggaaaggtttcttcaagcaggatcacagtgtagtctatctacatgctgaaaaatatagcctttaacatcatttatatattataacctctgtataatagagcataagtccatttctttaaaaatgttttccccaaaaccataaaaccctatacaagttgcttctagtaacaacacgtgcacaaagatgtctatgtcagctggaccattaacgtcgacgtccacgaagaccaaaaaaaacacaagcaacgacaacacaacaaaaaaaacacacagaccacaaaaacccacaaaccacaaacacaccacacaaaacacgaagaacaacacacagatggcgaggagaggcgcggcacgcgcgcgggaagcgcagagcagtaggccggtggggccgcgcccgcacacgggagaagaggcaggagccggccggggagagaggacgcccgaacggagcggggggacgaaccaaaaaaaacgcgggcgcggaccctc

SEQ ID NO: 651295 - DNA, 437 bp, Homo sapiens
cccatggtagaaggggcagatgggcaaaaaaaaaaaaaaaaaaaaaaagggcaaatgctgtgtgtagcccctctcataaagggcttaagctcattcaccagggaaaagctttcatgacctaatcacctccaaagaccccacctcttaatactattgcattgcagattaagtttccacatgaattttggagggatacaaatattcccaccatagaaaatagggaaaaaggaaaagtaaatattttttgggtctgtctgcttttgctcagtgtaatgtttttgaggttcatttatgttgttgcatgtattagtaggttgtatctattggtgcatagttattccattgtatgtatggaccacacttttcatttacctgctgatggatattgcattgtttccagttttgggttattatgaataaacctcctgtttccctta

SEQ ID NO: 651296 - DNA, 186 bp, Homo sapiens
cgcgcgacccacgccttgacgctgctctgccgggcccgcgctcctcctcttcccgggctgttcgctcacgcttgccttcttcccttcgctcgcggccgggggtctccactccctcgccccgctctcgttggtgggccggtgggtggcttttttcgggtccctggcgcaccctctctacttcccgcc

SEQ ID NO: 651297 - DNA, 155 bp, Homo sapiens
ccttggtaattttgggcctcccagaagctagtgactcacttactgttaacgtgtgggtgtgggggctggacatccttgggaacgccctgaggagttgctagaagcagggttcctggtctcctcggaggctgggccccccaccagtgcctcgtgcg

SEQ ID NO: 651298 - DNA, 1308 bp, Homo sapiens
  misc_feature (106)..(106): n is a, c, g, or t
gatgcttctatgctccgtctcataaaagaacttctttagcttattcactgaatacatctgcctcgtactattaaatccttcttctcctagtttttgcttccctagntccatggtgtgcccctttcttccctattcccatacactcaacactatacactactccttaactatctatatcactttcatgtaccgtactcatgcgtatatattatgacacattccgctctgacaccttattcctctagaaacgtactacttctaatgcactagagtatgcactttccattcgtgctcgctcgcgcagattcccatatcgatcactccgtataattcatatatgagcaccgaaagtgatacagatcgtattactcacttgcacacatgtaaactcgaatacacatattctacctttgtgacacgacgcaactgtgggagctagtactcgtaatagaagtgtacaagcctttgacatcatgtggaacgtgacctacggtacttatataatatatacgctcattaattacactccacgcccacaatatgaattctctttagaacacaccttgtgcagagtcatgggtgaagcgtcactatgtacagtttaggactaatgcgggaagttagatattacacacagaattttgacatgcccaccacattacagatcttcacatcaacatgtactcatccaacgatatgaacgttctttgcctatcttcaatagcagggctcgtttcctcactaacgaagcacgcggcgtttaaaaacaactagtagtgtcacatatcccgggcaggtactttaggcctaggggtccaaactttgcaaccccgtgttaacatcagaagcacggttgaagtggtgagtatctccctgagtccaaaaaagcctacatgacaaaatcttagtagcaagataaacagcgggtagtaaaacacttgtctgcaatgggaatcctactgacacttgatataactctccctaaccagttggtctttaggaaaactaggtggcggacacaggaaaagttagtagcccctgacgtcaagaacgaggccccatggtaattaatacagccacaggtggaaagaacagggcaaaacataggacgaataagaaccgacgctaccaatcgcgatacacccatgggacaaatagcacccatacagtaaccacggtgatgaacacaaaccaacagaagaaaagagaagaagacgcatgcaagcaggaaaaacagatgcacgaaccgcaggagcaagtgacacccaagtaaacccgtcaagacaatcacgacaagatcgccagagg

SEQ ID NO: 651299 - DNA, 282 bp, Homo sapiens
gccacttttgtgcatttatctttgttaggatcaaagcacaagctcaccatcaatgagcctggacaaaaagggaagctgactctcactgcattccttaaactgatatgtatatggggggggttaggaggcttaataaactttagtctgttattttgtttctgtttatacaaagaaaaaaattcagctttcatgggtctgatcccagattggaaaatatttctatatggcctgtcgtatctcgtggaaatgaaatcactgtgtatcacctagctacaggccaca

SEQ ID NO: 651300 - DNA, 712 bp, Homo sapiens
atggcacatgcagcgcaagtaggtctacaagacgctacttcccctatcatagaagagcttatcacctttcatgatcacgccctcataatcattgtccttatctgcttcctagtcctgtgatggccctttgtcctaaacactcacagcagaagctaacctaatactaacatctcagacgctcaggagaagtagaacaccgtctgaactatcctgacccggcatcatacctagtcctcatcgccctcccatccctacggcgatcctttacataacagacgaggtcaacggatccctcccttaccatcgaactcaagtatggtcgaccaagtggtactgaacgctacgaggtacaccgacgtacgggcggaccgtaatcgttcaactccatacatacttcctcccattagttcctaggaacctaggcgagctgcgactccttggatgtagacaactcgaagatagatacttctccgatgtgtgataggcccccctattcgttattatatacattaccattcatgcatagaaccgtatcgttgactactgtcgaatgagcctgttccctgcacaatttagggtccttaacagaaccagattgtcatagttcccaggtacgatctcaaaccaaaagccgactttcacactgtcatacactgagccgtgggtgttcatactacgggtcaagtgcctctgaaaatcctgtggaggcaaa

SEQ ID NO: 651301 - DNA, 141 bp, Homo sapiens
tcggcccaggtctatgttagccctcacatgccgtgttcaaagtgaggcaccaagtgcatcaggtacctgctgttcggatttaacttcatcttctggcttgccgggatcgccgtccttgccattggactatggctccgattc

SEQ ID NO: 651302 - DNA, 431 bp, Homo sapiens
agagcaccatattctcggacgctctaagccgtgtcgagcttcaatcatctccaccacacaggtacagcagacgctatatctggtaagtcgcccattagatgtcattgctggatataatacatacagagaacttgaccagtactttctcttgaattcagacctcaattttcaacactgtccactatcactagcggagcgaccatagattctagatcagagaccttaatctcgcgatcccctatgcccttcatgagagtcatacagccgaatcagcaaaatacaggagcttgttctagaatgcactagaaccaggttcaggaaagcatttaccaggtctccttaaacctctttcctgatgcttaccaacatgtcataagggctgtaactcttgtacctatcaaatacttactggaggtggggcacgctccgaa

SEQ ID NO: 651303 - DNA, 322 bp, Homo sapiens
gtgcacaatggacccctcgcattgtgcacatgtccgcagaccttgctgctgcttcaatgtacgcagtcgcatagacatcgccctggccatctaccatgtgatcatgagcgtccttgtgcgttcatcgagcactcagatacacgtgacccatgctgaggcgttctgcaatctctcccagatgggctacctcaggatcgctgatgtgatctccatcttgctgctcatcaccatgctcttcatcatcagcctgagcctactgatcggcgtagtcaagaaccgggagaagtacctgctgcccttcctgtccctgcaaatcatggac

SEQ ID NO: 651304 - DNA, 884 bp, Homo sapiens
ggtaacgatcgtgacgggctgaccgagcatgacactgctccactatgcgtgcaacagctggggcccacggagtcgtgggaccccgcggctagccgtgtcgcctctcggcagtcagctgctgtgcgctgggcgcgagatgtgacgctgcgcagccggtggaccaacatgtacacgcgcttcactacgtcggcctattttgatgtgcccgacctcgtgcgtgtgctgctgaagggtgctgaggccgctgagtggtgaactccactgtgcatgtgacttcaatccagcgagctcagaccctgcacatcgctgcttccatgcctgtgcctggtgcgccgccgaaagtgttatgctggatgccagcggtgccaaccctgtcgctgatggacatcgacacaggactagtgtgccggccgagagagtgagtcccaggatcctactgtgacatgtccctgggacaaaggcagaaggcgggtaccttggtggcccaaacggcagcctgcggacgcttctggcaagaggcacgctgccactatcttgcgtccctccccaaggttcacgcctacccaactatgacaagcgtcccagggcaatctcatgcttagcgcacttgggccttgctcctggggacgaccgggtgctgcctggattggccacgaagaccggccacactgccggaccctgtgtggaccacggaactcctgcccagcggcccagatggccttgcccgttggagctgcgacgaaccctgaggggcaaagaaccgactcggcaagcactcggggcccgtacggtaacttcattctgccctcccaagcaaggatctctttggctccgtgtccaacatctccaaggccgtgacgccaccgacctgctatgtgacctca

SEQ ID NO: 651305 - DNA, 550 bp, Homo sapiens
  misc_feature (246)..(246): n is a, c, g, or t
cacataactagtatgagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttggacaagattagagaatacaaatctaagcgacagacatctgangacctgttgatgctagttcagagtatcagcaagagctggagagggagctttttaagctcaagcaaatgtttggtaatgggaaatggattatttccacacttcacaatttgtggagtatcccaatatgaggtgtcctcgaaaaaccaccgaggtgctgaagataatgacagtatatattaatgcgtggtaagttgtcacggattagttgtacaatagttagaagttcagaaataaacatgatttcataactgtcaaatgttcttttaattctgagtccaaataaattatttgggtgatgtcgaac

SEQ ID NO: 651306 - DNA, 448 bp, Homo sapiens
cttatgagaaaggacctcatggaagcccatccgaagagccagcaaatggagaacctggtagaaaagatcaccaacagccggcctccctgtgtcatcctgtgactaagaaatgattcttggaagcttggttctggggtttaaacctttccttgtggttacgctaggaatccctctacctttagcccctcacttggccctaggtaactaagaccctgacttcactttgcctcttagggcacaaggagggactagacatttctgtgccaaaggcagaaaagagatgttctctgtgaacatcaccatcgctctcccgggatctgtgccctctgcagtttggtcctctccccagcgtggcaatacctttcagatgccacggttgctataacttattttccctgaatcctgggcagtgtcggctcttggcaataaagagtaattacaaatgcta

SEQ ID NO: 651307 - DNA, 969 bp, Homo sapiens
gagatgatcctcgtgagacatgatgaaactttccgaacgcatcagaggactccactcgtctataaacgctagcactcccggcgtaggtatgctgtccaagagctcgctgggctcacacatgacacaacatcgcacctgtaactgtctgcagccctgtatcaccttatagcttacagttcctaccacgtgtgtccattgtggcccgtgcttcggggagtggaatgaccgcacgtgttcctgtactagtcgttgcgtagacggtggcgtgatagctaggatgagacgagactagcggcgtgccagatgccgttactgctgttagagaagtgtcacgtggtagtacagccaatagtctgcttaggataacaccaaaagcgctgttatgtaaatgcgagccaagtgtctagctgacaaggaagaatattcgcttattctgtggcttctggttcacagtgggctgaaactctattaacgcatagagaacggtcttgattacgttgaagcgacttcgagactcccttctttaagaaggtggcatgccctattctctcctgggacgaggtatgactggtttcgatttaatggcccatgtgaaccaccgttgcgatccgtggtaatgggttaaatatcatgcactgttcgcggatgaaggcgaccagaatcggtgctcctatttacaacggtggatgaacactctttcccacgaggggctcgggagtccagcatggatggtggtagccgtgattgaaagcaaggtccaagagggccaagtacaaggatcctctcccaaacggttgtgaatgggcgtgggggaccagccgtttgtggttgccaaagaggggccaccatttggagtgggcacctggctttcctgaaaccgggagggctcaggcgggggcagcatttcctggagattacacatacagggctcgtggaaactctcggaatgtggctcataacttggcaatg

SEQ ID NO: 651308 - DNA, 463 bp, Homo sapiens
gagctcgattccctatccgtgtccggggttgggatggctcggagctttgagactgctgtgactgctgtactcgcggcacttgcggtgtaggctgaagagatggcggctgttgcagctgatgtggcgtgtgacgaggcatctgttgttttccttgtgagtaaagatccaggattcggagacagatgtcttccaacacgttcgaccgggacatcttgaacaaactgctcccaccatctactatacatggctttggaggtccattcttgtatttcaaatttgcacacacgtcctgcgagatacatcactgctactgctatgatctctggttcccactgcagtgacaaggtggtgcagagactgtcatttacaaatgtccatgccatttgaaccaacttttgaattttgtttttatcacctttgagttgctttgcatattttagtaggaactggtatggatgttctc

SEQ ID NO: 651309 - DNA, 221 bp, Homo sapiens
catcttagactgtaagcatgttttatggcgtcagagaagcggtgtagtatcccgtataagagcctacaacgttggggcctaggcagtagttgtatctagcctagaatttttcgtatcggtaagcagttaggaatgccattgcgcttagaatgggtacaatgaggagtatcctgaggcatgggggtcaggggttgaggtcttggtgagtgttttacgtgggg

SEQ ID NO: 651310 - DNA, 688 bp, Homo sapiens
gcgcggaagctatcggtcactgtaatccctatcaaatatcaatgacatctgcacagaaagaggaaaaaaatcctaaaatttatatggaaccacaataagaccaagaatagccaaagcaatcctgagcaaaagaataaagctggaggcatcacattacctgacttcaaattatactacaaagtgatagtaaacaaaacagcatggtgctggcataaaaacagacacatagactaacggaacagaatagaggacctataaataaatcaatacatatacagtcaactaatttctgacaaagctgccaagaacatacgttgggaaaaggatggtctcttccaaaaattgttctggaaaaaccagataactatatgtagaagaatgaaacagatcactatcttttgccatattaaaaaaaatcaaaacaaaatggcttgaagactggaatctaagatttgaaactattgaaactactagaagaaaacgtgagggaaatgctccagaaccaaatatttcttagtaagaccttaaaagcacaggcaagcaaagcaaaaatggacaaatgggatcatgccaaagctaaggaccttctgcaaagcaaacaacaaagtgaagagacaaccatcaagtgggggaaaatattgcaactaaccatctatcacagataatagcctataataggagccaacat

SEQ ID NO: 651311 - DNA, 405 bp, Homo sapiens
ggacagtttacaaaggatatacagattctcctaacttgttcggccaaattcttgagaggtgttagaagcgatgagcatcccaaagtgtatatctatgctccagtatgtggatgatatactagtgtcagggtaacgctgtaccaacaagtatctggcttttccatcagccttctcatgcatctctgtggagagggactatgtggtgtggtggcacacatctgaaatcccagctacttgggaggcttagaaaagagaattgcttgaatgcaggaggtggaggttgcagtgagccaagatcgcgccattgcactccatcctgggcaacaagaacaaggctctgtctcaaaaaaaaaataatgtaacaagctcatgtatgggccccacttttacattgaccaggggctc

SEQ ID NO: 651312 - DNA, 276 bp, Homo sapiens
  misc_feature (4)..(4): n is a, c, g, or t
gtanccgcagccttcagcagcagcagttcttcagcaggtctgctggtgcttctcttgataaagcacacttttttttggtttcccccgagacggagtctatgctctgtaggcccagagtcggtagtgcaagggcatgatctcggatcactgcaacctctgcctcctgggttcacgcaattctcctgcctcagcctcccaagtagctgggattacaggtacccaccaccacgcccttttaatcttggtatttcaagtagagacagggattcctcacgt

SEQ ID NO: 651313 - DNA, 386 bp, Homo sapiens
tgactttgacgttagatgaatagcacaatagatcataatggtcccaataagtgacagctattatattagtgaacttggtcccggcagatttcaacatgcatcaaggctgaggggagagaataaatattatttttcttctgaattaagatttgagtcccgaggtatctcacagatgaaccattacctttatttggagcccgggaaagaaaactctcccatttatgggcacatatcccagtgagctaactaataaagtgatcatctttagactgccacaagcacttttggcaaagcagccaaaataattctttaccacagagggggtgaaagaggagtatttcaaagaatctatgcacttaggacataatatttacaaaaggtgctat

SEQ ID NO: 651314 - DNA, 322 bp, Homo sapiens
cattcaccatcaaatcataatgagggatggaactgggattcaaatccggttctctctgatgccaaaaatggtgcaatttaacgaggaccaagttacacccagaagatggagggatcaaaacatgtggattcccttttctggcctctcatgtgggaatttcaatagctttcactgcctcagagcaatcctaaactccctcccaggttgccttgcaatggcccccttattcgtggggatgattaggaatctgcatttttggaccacaagcatctataaagagttgtgttgatcaagaaataaaatttactaggtcataaaaaaa

SEQ ID NO: 651315 - DNA, 607 bp, Homo sapiens
gggaggaggggaaatggattcgcctctcctacagaaattctgaattcatttacagttctatgactattgattatatgttgatttgatacacggttcgggattctagtttagcggaaaatagtgtttatgtccaggttcgtggataaactatttcatccgctgtgtcctccccaaaacgactagcacacgagagcagagctcctcatttcagtaatacagcctctcatatccactggccggccccgtttacacatcatggtctccatgtgtaaccgcaaagtcaattatgtttgacacgccttgtggtgtgcatgttatggggcacaagttatgatttacacggaagcaactgccaaatctgtggtgcaaccactatctccagtgaaatattgtataacagccatttggaactactggaacagacagtggctttgctacagtactcttccttattgcaccatctgttgtatgaacgtagaaactaagcatcagaatttagtgaacgaagaatatgtgattttgccttttgctctacaatactgagatttggggaagcaattctttttttaaaaaaatttgaataactatcttttgataacacattcgg

SEQ ID NO: 651316 - DNA, 434 bp, Homo sapiens
  misc_feature (383)..(383): n is a, c, g, or t
  misc_feature (385)..(385): n is a, c, g, or t
  misc_feature (405)..(406): n is a, c, g, or t
tacagacaccttaggcaaacatttaccaaaataaaggatatgccgattagaattgaacccctggcccaataaattttccccccagggggaaagtaaaaatttttaccccccgttttttttttggggggggttccccccccttcccctctttgggtttgggggagaccccgaaaaaacttttttgggggggaggagaaaatatattaacccccccacaaagaagggggttttttaaaaaaaataaaaaaaaccccccccttttttttttaaaaaagggggggatattttttttgggggggacacccccccccccgccgggggggggggtttttgcccaaaaaaatatttttttttttttttttttttgttgcccccctcccccncncccccccttttataatgggnnagaaagaaaaaaagactttttttttttt

SEQ ID NO: 651317 - DNA, 1163 bp, Homo sapiens
gtccatcgttgattagcagcacgacgctttaggctgacgccactgtctgcgcaacataaaggatatggcagagtagatcattgatgactgtgagcgcgaagagagtatagatatcggcaagtcaaaacgagtgacaaaattatacacgcaaatcagtaactattggcaagggattaagctcctatttagctctctgtcactaaagtgtagtcatatgtagaaaattaacctaggcagatggtactaggaccagagagtctgagcatcgcacgcgacaaatcccagactgacgtctatgcgtaaaacacacgctgacggaccacacacgcagatcctatgttctctaaatagttgggaggaattccatagagttggatggccgacaaataccatagcacggagctctgggggtaataactggtcagaaccagagaatgagatctcttatccgttgacaatctcttgacgatgggctccagccacgtagacccctctaaaatcccctcgtttgtaagagggtcatagcatggtgagcttccacagattgatacaagtctatgtgtggcaagcttagggaacaacaagctagttccgcagagaacgtaagtaatgtaacatgctgaacctaggctgtacaagctgactcactacttaaaccaataaacgttccaatgctacacaacctcactaacgtaatcaaattacaaatacattttatagctgtgatcaccgtcagtggccacagtggtatcaaatctactcagacctagttgaagaactaaagtgagtatgactaaatattgacggttttgtcccttgcgattaggcataccgtcagagtaactgaatgagtgaagcctggaagaagcccgaaggggtacgaacaagcaagaggtcattgttaccgcatgtggaccgcacgcaaggcctccataggaagggaaaaccaagaagaatgagaactgagccgcgcccgtgcgaggagggtacctgaaaacacggagaagacaccgtggcggctccacagaatacggggccccagccgcagatgggaaaggggtgaaaaacgaaaggcccgaccggggataaaaccagacgcggggagggccgcacaaacagggcaacaggtgcacaacggggagaagaggggcgccaagaaaaaa

SEQ ID NO: 651318 - DNA, 135 bp, Homo sapiens
cagggagagctgtatgtaactcaggggcgagctgcgcttgagtgcttacatcacagtacagagccacattggcaggtgaaatatttgcttttgatgtcccagaagcggtcgcaatagtcgaacccggggatcctc

SEQ ID NO: 651319 - DNA, 928 bp, Homo sapiens
  misc_feature (309)..(309): n is a, c, g, or t
  misc_feature (851)..(851): n is a, c, g, or t
  misc_feature (862)..(862): n is a, c, g, or t
  misc_feature (880)..(880): n is a, c, g, or t
  misc_feature (885)..(885): n is a, c, g, or t
gctgctgcacatcaggctgatggcagctaggccctaggaaggagccaggggccatggtgggggctctgctttcccacagggctggcacagaggaggcctagacatatgttgctgaaagagtgtcctaatactagagtggcatgcctcgtgtctacaaaacccttatatgtcacctctgctgtccttgaccgatggcaggggaactcccattagaatgatgatgaatcccctgcagaggggaggctggcagggacaaattccctaaaagagggaccaagcgtcagctccaattgcatcttaaaagcaaangtgaagtaatgcacagatggaaatttaaaaagaaaacaagcagtatgactcaagtggtgtttttcacagtcagaacttgaatatcagtagatttcgtcatttgtctattccttttgtaccagaggcatattgttaaattggttaatggaaaggaaaaatgttgaacagataatgttattctttatgagacgtaccatctgtgtattgagctctgaatgtccctggatatggaagagaggaaatgtgatggaatttcaagtttgccttctttgctgtctttatcttgggttgagtatgacaaacataatcacatttatctcctggagcataaagagttttaatcaccctattaaccaggatgacatttttcacagacttaaaaaggaatagaacagacattatctccctataagcaatccatttcatggaggctgagcactagaaatgctttaaaggatggataacgcaggccatttccatttcctgtctaagccaacattaaggaggctttcggtaaggctgttgcttccactgggtggtgntaagctttacncttagagctcagcgcccnaaagngctattagagaagccccgggcaggggaggagtggctttcgaga

SEQ ID NO: 651320 - DNA, 404 bp, Homo sapiens
  misc_feature (14)..(14): n is a, c, g, or t
ggtcgaccggcgtncggacggtgtacaccccacagaacggaacagaaatagtggcaggcctgctgggtattgaagcgataactcttcagcacgtcggcccctttcaggatcttcaggcccgtgagggaacggtgcccataacggcgcctcgctcttgcaaagtgaacagttgcatcgtttcggatcaaccacgccgttcggtagttccagctcaagcaccacctccccacagtggcaggaagcgttgtgaaccggtttgatttctgtctcaccaatacgcttgatcatcggtttcgtccttgtacggcacggttgactccacagtacccgcagattaccgaagcgccaggctgggccgactctgattgaccagggtcgggaggctacgacgcagcgctccgtcg

SEQ ID NO: 651321 - DNA, 1525 bp, Homo sapiens
  misc_feature (1)..(1): n is a, c, g, or t
ntgtcccctcgtgtgaagttgtgtctgctccccggggatgggcttctcactcgcgcctggattgactgccctcgcgcgcgcgtgccctgatggtgttgtcgtgggggagctgccagggtcgtcctccctgattgtgtgcgcacacggcacgttgttccccgaaaggcccctgttgtgattttctctttggggacaatgtgtggagcagcacgtgctgttgtgtggaaaattagtgggagcccccgcgggattgtctagggggagacctgtgccagagttgttggggcggctaatgcatggccccgtgtgaaagttttcccgcagtaaaattgtgtgttccgagaagacattgttgtcgcctgaaatcctctttttttgtggaacggggaacagaaggagtgttggtcgctactaactagtgggggggacaccccacttggggaggacccccacctcatgtataagtaatgtggagaaagtcgtttgggttaaccagttgcacgtcgccacacgtttgtgagggctgcccctctgccctgcagatttattttttagcgggaatgcttgggttgtggtgccacaccacacatggtcctgtgtcgtggggtgtttgcccttcgtgatattttgtgtagcccgcccacccttgaggtgtttcttagcgcttcgttggcccacaagtgtgctcgtctggtggacctcctggaaggctgttcccaccggctttcagcggacacctggttggagcacagccccccctgcctagatgtcgtgtgccaccacttcttgtggcggagagtttttttattatcttcaaatcttctggggtagaagagcacacacttgtggccacccccacgcacccctgtgtgtgattatacgggatagtggtgcgcttgttctgtggcgtctgcggtgccccctcacaagacgcgctgttgagagagtgttgtctacacggcacacacacagtatgtggtggccgcacggtgtgtgtcccacgtgcccggctgagccccacatctgtgttgtgtcgcgtttgtgtgagaaatattgtcgcgtggccacgctcttctaaatatccacgagaacgcttctaccgcggttctcgagccacgctgtaatatattatgtccacgcgcgtgccacactgttcccacgagagggcctacacactagaatgtatatttgggcttctatatgagaagacacgcttgtctgaggagaatggtaatgagagtgttccacgaactcggcacgctattgcccagatgggagttaatccacgtgggaactagctgtgtacaccacgctcaattgtttgtttcttctcgagaaaatgtcactgcgaggacccacaaggaggccccacgaggtacaccacgtgttgttatggagttttatgagtgccaaagatgattattgacttgtgagatagcgttagcgttttggggggcccctagttccgtgagaatgtttaagtttaccactagcccttcccccgttaaacaaaagaaaaaataaa

SEQ ID NO: 651322 - DNA, 456 bp, Homo sapiens
  misc_feature (1)..(1): n is a, c, g, or t
  misc_feature (15)..(15): n is a, c, g, or t
naacacccaaacccnggtaaatacactacggcaaccataaataaagctacagatcggtatggctgatgaacatagaggcaaattttcatttaagaaagatcattcacaatgatccaagttgtctatattttagacactcgggcatgatttaaaatacctaaaatgataaatataataaatcaaagaacttgacttaaagacaaagatcatatgattatctcaataatgtataaaaagcctttgacaaaatccaacccaacttcatggtaaatattctgtagagaacaagactggaggaacaaaactcaatataataaacattatatatgagaaacccctggccaaaatcaccctaaatgtagaaaagttagaagaaattagattaaaatcaggaatgagacaaggctgtccaccctctcctgaagaaataatctcttataaacatcacctgtcaat

SEQ ID NO: 651323 - DNA, 621 bp, Homo sapiens
actctacaggactcacatgtagtgaggaatcaacaacagtcactagcagccaggtgcactggaacagcactcttcctacccgctctgaacttagttcttgttggagaacctacaacgtcaccatcagttcaggctcaacggaaacaacagcgttacctggcagtaacacaacagcagggctgagtgagatatctaccaacttctacagtagccccaggatcaccggaaaaaaaaatctccacctgccagcacgacaagctcaggggtcagtgaagaaatccaccacctcccacagccgaccaggctcaacgcacacaaacagcattccctggcagtaccaccatgccaggcgtcagtcaggaatctacagcttcccacagcagcccaggctccacagacacaacactgtcccctggcagtaccacagcatcatcccttggtcccagaatctactaccttccacagcggcccaggctccactgaaacaacactcttacctgacatcaccacagcctccggcctccttgaagcatctacgcccgtccacagcagcactggatcgccacacacaacactgtcccctgccggctctacaacccgtcagggggtactgagctcgaa

SEQ ID NO: 651324 - DNA, 892 bp, Homo sapiens
  misc_feature (846)..(846): n is a, c, g, or t
  misc_feature (858)..(858): n is a, c, g, or t
agagtccattagttatatatatttcttttctatattcacttcatggtcataatcaagaagtctattaagtgtctgattaaaaatatcaaagagttgcagaatttaaagtgaaagaacttttgggttaactgataatgctgccacttcataaacttaggaattcattacattgaacgctatgtgcttttagtttctttgaaaatttactgaaacatgtatctaaaaattcaattatagaatgctagacttcaaacaatagttctctagcttcaagtttaaaaccttcatgtctttcttgggcttctgttacttgtaatatcaacctagtgcttacatttgaacaaaactctctttttagttccaactctatattctccttgtgactgttgttgctccaaagcagggtttatccacttctgcactattgacgtcttgaaccagtctttgttgtgtgggctctcctagacattgtaggaagtttagcagcattccctagtttctgcttattagataccaacagcaagccatggttatgacaaaaatgtcttccgttattgctatatttctcctatgggacaaaatacttatcagaagtcaaatttaaccaggtgttctgaattttatctgacaactttatcactggggttgagaaccactgattcaaagtcctcaactttaactgtacatttagatcccctgagggcatttagtactgatgagttggcctcacacccacatattgatatcattagtctgatgaggtttggacctaagtactttttaagggtttcccagggtgtttcagtgtgcattcagggttagaacctctggtcggtcctaaaactncagtaatagttngtgggattagaggcctcttaagggaaataagagt

SEQ ID NO: 651325 - DNA, 517 bp, Homo sapiens
  misc_feature (103)..(103): n is a, c, g, or t
  misc_feature (230)..(230): n is a, c, g, or t
  misc_feature (277)..(277): n is a, c, g, or t
ctgaggaagccagacaccttttaacaatgcactctcttgggaattaacccattcccaagaaagcgagaactcgctcttccagcaggaggacgttcatctattngtgagggatccgcctcgatcatccaaacacctcccaacactgccacattggcgatcaaatttcaacatgagttttggttgggacaaaccacattgaaactgtagcacagagcaaagcaataggaaanatacaggtgatttagtttagttttttgtttgtttgtttctttgtttnagggtagttttatgcaaattttaattctggctgttaaatgagaaagcgattttgtacatttactacccttcaagccagcagagcatgaagaaactttcatcttctgagactcgggtgctatttcttgccctcccatatcaaagctaattttataagtactgcagccgggagtcttagtcccataaagcactttgtacaattcttattaaaaacccaggctgtttgtttagcctccccttc

SEQ ID NO: 651326 - DNA, 352 bp, Homo sapiens
tatgttgattggtgtaaaatgatatcagaatctgacccactcttatgtgtgaaaaaagtgtgtacagagttgaggatacatatgtcacttattaacatgtaagattcttgcctagggggcaatgctgaagttagctttatgtatcgagtcgagactctgggctcgcagtacctgtcattggatatgtgcctccagttccaggtttcatttttgttcccactttcgcatctgaaaaatcactgccagttactcagtgagtgaagtaaagagatggcacttgacctccccaaaaatatatcattatatggattttaaacatagggaagagtgcgagctttgggtaccgagctcg

SEQ ID NO: 651327 - DNA, 252 bp, Homo sapiens
tactgtcctgtgcgggctttccctgtgcgtttacgcgcgtggcccactaacgagctgctggacgtgccgtcgctgtgccaccccctcaatgcccacagagctgccccctctgcatattgtcaggctccttcacactgtccaacttgactctcgccgattttttgtcataacacgtagtacatctgtcatagctcgttctatcttagaagcttttctgtctgggaggaaccccagctctgaaaggcacccacg

SEQ ID NO: 651328 - DNA, 88 bp, Homo sapiens
tcgatacgacttttttttttcatgttctccagatgtcctttatttatattcgtattcataagttctcatactacttctgtcgtctctc

SEQ ID NO: 651329 - DNA, 124 bp, Homo sapiens
ccttggtgatgaggccctcacagcttgtgcaatggcattccctatcgataccaaacatcttcagcagctcagccggcttcccacttacttggtacccggttaactgccaggtgggtatagaact

SEQ ID NO: 651330 - DNA, 244 bp, Homo sapiens
tttgagcctgccggagggcaagggtcgaaaaaacggattgggtcctgggcctttgtgatgaggcaggcccccctgtcggttttggcttgctgctaaaattagggccttttgttcgcccccctcccccccctacctggaggggcccaggcttggggactttgagctgtgttaaggagaacaagggcaaggagacctccctttgtgctccctccctccctaataaacatgagtttgatgttttcca

SEQ ID NO: 651331 - DNA, 524 bp, Homo sapiens
  misc_feature (106)..(106): n is a, c, g, or t
  misc_feature (118)..(118): n is a, c, g, or t
  misc_feature (126)..(126): n is a, c, g, or t
  misc_feature (157)..(157): n is a, c, g, or t
  misc_feature (160)..(160): n is a, c, g, or t
  misc_feature (184)..(184): n is a, c, g, or t
  misc_feature (197)..(197): n is a, c, g, or t
  misc_feature (209)..(209): n is a, c, g, or t
  misc_feature (212)..(212): n is a, c, g, or t
  misc_feature (220)..(220): n is a, c, g, or t
  misc_feature (232)..(232): n is a, c, g, or t
  misc_feature (234)..(234): n is a, c, g, or t
  misc_feature (242)..(242): n is a, c, g, or t
  misc_feature (248)..(248): n is a, c, g, or t
  misc_feature (250)..(250): n is a, c, g, or t
  misc_feature (252)..(253): n is a, c, g, or t
  misc_feature (258)..(258): n is a, c, g, or t
  misc_feature (261)..(261): n is a, c, g, or t
  misc_feature (270)..(270): n is a, c, g, or t
  misc_feature (273)..(273): n is a, c, g, or t
  misc_feature (288)..(288): n is a, c, g, or t
  misc_feature (294)..(294): n is a, c, g, or t
  misc_feature (299)..(300): n is a, c, g, or t
  misc_feature (304)..(304): n is a, c, g, or t
  misc_feature (311)..(311): n is a, c, g, or t
  misc_feature (315)..(315): n is a, c, g, or t
  misc_feature (322)..(322): n is a, c, g, or t
  misc_feature (325)..(325): n is a, c, g, or t
  misc_feature (330)..(330): n is a, c, g, or t
  misc_feature (333)..(333): n is a, c, g, or t
  misc_feature (337)..(337): n is a, c, g, or t
  misc_feature (342)..(344): n is a, c, g, or t
  misc_feature (346)..(346): n is a, c, g, or t
  misc_feature (351)..(352): n is a, c, g, or t
  misc_feature (356)..(356): n is a, c, g, or t
gagctaccccaatccctcacagcctgaccctcctcattccatcagatgcatttgtagaatcggggcaaatttccttatttatttatggcccatgcctttccccctnttcatcctgatnccgttttnctttgaagagaccccagtaccaaaaaacagnctncagaagccaaaaccatgcctgganctcccatagcttntcctttgttccnganaaagttcnctgaaaaaaaantnttttggcnttttgngngnncaaanacnacaaaaccnggnggggaaacgggaatntttttngcccnnaaantgttttnaaancaaaaanaanggggnttntggnggttnnngncgccnntttntatttaaaggaagaaataaatttggcaaaaaaataaaaaaaaaactcggggggtggccgggaccccaatggccctttaatgagtggtattaaaattcatggccgctgtttaaaacttgtgggaatggaaaacacctggggtaccccacttatattggcttggagaatt

SEQ ID NO: 651332 - DNA, 628 bp, Homo sapiens
  misc_feature (409)..(409): n is a, c, g, or t
  misc_feature (448)..(448): n is a, c, g, or t
  misc_feature (477)..(477): n is a, c, g, or t
  misc_feature (491)..(491): n is a, c, g, or t
gaatgattataacaaagaaacattcaccttgaagcataaaatgatgaacagatgttcccttgtcgatgtcattacaatagttccacgtcttgtcctggggacccagctttaactttagcatctggtatgtgaacttagtggcagttgatgatccgttgatgatagtacaaccttgtctcaacctggtatagcaagtaccgggaacaggaagctattcgcctttgcctaaaacacttcagacaatcacaactatacacgaagctcttgcagtcccactgccaaacaggagcaaaccgaaggacttggcaccttgggaaaactattcccgagtgctttaaacgagagtatgtcatgacagagcgtggtgtgtgaacgggtgagttttgatgcttgcgaagagttgattganaaggctgtaaatgatggcttgttcaatcagtatatcagncaacaggaatataagccacgatggagtcnaatcattcccaaangtaccaaaggtgatggggaagataagcgtccaggaatgcgaggaggccatcagatggttactgatgttcaaacagagactgtgtattgcgtttggtggctgggatggaacacaagatcttgctgacttctgggcgta

SEQ ID NO: 651333 - DNA, 407 bp, Homo sapiens
aacagttctttatatattttagatacaagttctttgtcaaacaaatgttttgtagcttctggggaaaagaatgaaaaagaaagtttaaaagaagacaggactgggacagtggctggctgagtgtggcggctcacgcttgtaatcccatcactttgggaggccaaggcaggtggaccacctgaggtcaggagtttgagaccagcctggccaacatggcgaaatctcgtctctactaaaaatacaaaaattagcccggcatggtggcgtgcgcccgtaatcccagctactcgggaggctgaggcaggcgaatcgcttgaacctgggaggcggaggttgcagtgagccaaggtcgcaccactgcactccagcctgggcagcacagcaaaactccatctcaaaaacataaa

SEQ ID NO: 651334 - DNA, 500 bp, Homo sapiens
tgcaaagcgtagtacccaaacaacaaccttcaatcactgtaagttttaaatagaggtgaaaaaatgtagtcgatttttctcaatttctactttatacttctctgtaaactgacagcagtagggctaaaaaacaaaggtctgattcctagcatttctcattatacatatcccgtattgctctcttgatatttcactgatacatgtatcttctttgatccctgattatagatattacatcttctagttcctttttgtattttttttttttttttaaattaaagacggggtttcaccgtttgggccaggatggtattaatctcctgacctagttatccacccttctcggcctcccaaagtgctgggattgcaggcgtgagccaccgcgcccggacttttttttttggaaacagagttccactctgttccacgggcgggattgcaggggcgcaatctcggcgcactgcaccctctacctctggggtacaacgcttggggcgggg

SEQ ID NO: 651335 - DNA, 296 bp, Homo sapiens
  misc_feature (75)..(75): n is a, c, g, or t
  misc_feature (80)..(80): n is a, c, g, or t
  misc_feature (94)..(94): n is a, c, g, or t
  misc_feature (153)..(153): n is a, c, g, or t
  misc_feature (192)..(192): n is a, c, g, or t
  misc_feature (251)..(251): n is a, c, g, or t
  misc_feature (259)..(259): n is a, c, g, or t
aatggtgagaggtgggactacatgggcataccggagctgtgtggtgtgtggcgtgactgggcaccaagatgcctnactgntcagctgacaacanttcgtctctgggctgtgacagaaagcagtggcccttctcaagccaattcggctgtccgncctgcggttttgactttggggcaacatcatcatgttctncacggcaagagatggctacagtgctttgtgagttttttacctgcgggatccggcagttncaacaatnagcctacatgaagtccttgaatgactctaaaatcacc

SEQ ID NO: 651336 - DNA, 836 bp, Homo sapiens
ctagttctagatcgcgagcggcgccctttttgtctttttggcattaaaaatgtttaatatgtttaaacactagaatgacgtgccactgaattaggcaaggtgggcaaaacaaggtctgttacaataaaatacattagacatttaaataaataaccttaaaaactatgctgaagggacataaacccagctcgatggaatcgtggaacaaggtttccctgcacaagcgagtacggggcataccgtcgtcgtgaaaacggagtgtaaacagaacgaaccagtcacaactccttaaagaagaagccaagcggggacgggggcataagggtggggagaggctgggaatggggatggggtgaacggaggccaaagggggggtgaggggacagtagccaaaccaagaacgaaatactgacgtgagggtcaccaacgactctggctcagggtgcaggaaaacaattgggctccatgcaactaaacatttagcacggttgattatcaaaagttaaaagtcccggaatcatctagtgcaacaatgaccaacaaacatacagtgcttactcgtcccagtttctctcagggaagaacgaaacaataaaccccagccaagcaaactatttaacaattgttcccccttaaaaaatcctggtctggcgccaaatatcaaacttatgggcttggaacaaaatcggtcctggccggggcctccaaactcaatgtttttctgatatattcacccaagggatagaaggtaattcacaccctagaaacactgggcaccatcgccttttttgcacatcccttacgaacacaaacatttttggccataacaccacggg

SEQ ID NO: 651337 - DNA, 4928 bp, Homo sapiens
  misc_feature (4917)..(4917): n is a, c, g, or t
cagaactattctccccagtatgattcatatgatgtcaagtcgggcggagtagcagtaggaggactcgcaggctatcctggaccagctggccccccaggcccccccggcccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagaccgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaccctggtgcaaatgggcttccaggagctgcaggagaaaggggcgccctgggttcccgaggacctgctggaccaaatggcatcccaggggagaaaggccctgctggagagcgcggtgctccaggccctgcaggccccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggacctcctgggccatctggtccccgaggtcagcctggtgtcatgggctttcccggtcctaaaggaaatgatggtgctcctggtaagaatggagaacgaggtggccctggaggacctggccctcaaggtcctcctggaaagaatggagaatacggacctcagggacccccagggcctactgggcccggtggtgacaaaggagacacaggaccccgtggtccacaaggattacaaggcttacctggtacaggtggtcctccaggagaaaatggaaaacctggagaaccaggcccaaagggtgaagccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggaatagctggccctcgtggtagccctggggagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggccccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgttaatggacaaatagaaagcctcattagtcctgatggttctcgtaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 651338 - DNA, 347 bp, Homo sapiens
gcaaaatatcgaagtaatagctcattccggctaaatcctggccatatccatgtgggtttaataagaatatgtgtggtgaccaaatcatccccaggggaataccacagttctctgtaaacgtaagctattaggcattttcaactcacctttttaccatgagtaattccatatactggtgatatgatttgtcgctggagcgttcgtgttataatccgccgtgaggtgccaactttcctccacggctatttatataaccgttattgatgagcgcacgccttttttttttaacagatttagatattgataacgatgagcaccactctaagactagtcatgaaagttgtaat

SEQ ID NO: 651339 - DNA, 4219 bp, Homo sapiens
cagaactattctccccagtatgattcatatgatgtcaagtcgggcggagtagcagtaggaggactcgcaggctatcctggaccagctggccccccaggcccccccggcccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagaccgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaccctggtgcaaatgggcttccaggagctgcaggagaaaggggcgccctgggttcccgaggacctgctggaccaaatggcatcccaggggagaaaggccctgctggagagcgcggtgctccaggccctgcaggccccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggacctcctgggccatctggtccccgaggtcagcctggtgtcatgggctttcccggtcctaaaggaaatgatggtgctcctggtaagaatggagaacgaggtggccctggaggacctggccctcaaggtcctcctggaaagaatggagaatacggacctcagggacccccagggcctactgggcccggtggtgacaaaggagacacaggaccccgtggtccacaaggattacaaggcttacctggtacaggtggtcctccaggagaaaatggaaaacctggagaaccaggcccaaagggtgaagccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggaatagctggccctcgtggtagccctggggagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggccccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgttaatggacaaatagaaagcctcattagtcctgatggttctcgtaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttattttttacccattcgcatttcaaatgtcctgataagctaggcgggtccgagcc

SEQ ID NO: 651340 - DNA, 227 bp, Homo sapiens
tatccccttcgtgtgtcatcccctatgtgtgtcataccacacttcgtgtgacaggttatcacaccatcgctgggccctttgggcctgcatgtagtgtgggaggctcctggtcagctcctcacgtgtggtaaatgccacacacccttgacagtagataagcagacgactaggttatcctgttctcttgagcttaagtctcacttcggctccgacttttcctctctacc

SEQ ID NO: 651341 - DNA, 5008 bp, Homo sapiens
  misc_feature (4997)..(4997): n is a, c, g, or t
cagaactattctccccagtatgattcatatgatgtcaagtcgggcggagtagcagtaggaggactcgcaggctatcctggaccagctggccccccaggcccccccggcccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagaccgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaccctggtgcaaatgggcttccaggagctgcaggagaaaggggcgccctgggttcccgaggacctgctggaccaaatggcatcccaggggagaaaggccctgctggagagcgcggtgctccaggccctgcaggccccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggacctcctgggccatctggtccccgaggtcagcctggtgtcatgggctttcccggtcctaaaggaaatgatggtgctcctggtaagaatggagaacgaggtggccctggaggacctggccctcaaggtcctcctggaaagaatggagaatacggacctcagggacccccagggcctactgggcccggtggtgacaaaggagacacaggaccccgtggtccacaaggattacaaggcttacctggtacaggtggtcctccaggagaaaatggaaaacctggagaaccaggcccaaagggtgaagccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggaatagctggccctcgtggtagccctggggagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggccccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgttaatggacaaatagaaagcctcattagtcctgatggttctcgtaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctcatattttttgctgttccaccaaataaaacaaaaagcatttgaattgtatttggtggaacagcaaaaaaagagaagtatcatttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 651342 - DNA, 1240 bp, Homo sapiens
cagcatcagactgtcgacatccagaaaatgtcgaatatactctgaagggacgcacagttatcgtgaacggtgccccagacggaacccatgcgtgagtgtgactatcaatcacatacaatgtagaactacagcctatctatgtgaaagaaaaaaaagaggctccggtgtagacaaatgtgtgtggtgtaacagaaaggaactggctaccgttcggactataatgtagtcatgtacatgaacatgatacaagggtgttacactgggcttccgttacaagatgaggtctgtgtatgctacacttcccacatcaaccgttgtaaatccaggagaatggtgtctctatgtatgacatccgaaatatctatgggtgaaaaatacataccgacagggtaacggatagagaccagtgtgttagcattgtatccagatatctacaagcaccaagacaatgatgaacttaataccttgaaatgtgaaattgacatatgacgctatggataatcaaagtaacaagaagagctctaagatatcagacaagaccaacaaaaagtataaaaacaacggataatccagagcaaacttaaatgggatggtaatctaatagtctactgaacaaaaggaaactagatcaagcaagtgctgaattgaaatacagcactctaaaggaggttaaccctagtgctaaccagaacagaatgataggccaagaagtgaaccacctataaacgaaacctatccttggatggactcgttgaaaacttgactggcacatacaaaggcacctaatgcgacactatgcgaacacaacaaaacagtcgcagatcaaaaacacaaaatcagcaaaacacacatgtagacaacacacattggacagcaacagcgacaaacagtagaaacacacaacgcaggaaacaagccagagaacgtagagagcgaaaacaaaaaacaggaaacaggaaaaacaccatacacaagataccaaaaccaaagagcacaagaggaagaagaataacgacgaaacaaaagaaggaacacagcgaagaggagccaaacaaaaggagggacaaagccaccaacagaaaagccacagaaaatagcacggagacacaagaagacacatcaaaagcagcaggaagacgaaaaagccacaaagaggacaaagacccacatatgggagaagcaaaatacaacgactacaacaaccacacaccccaacaagcaaaaaaggcatgcagtcgaa

SEQ ID NO: 651343 - DNA, 3791 bp, Homo sapiens
  misc_feature (3780)..(3780): n is a, c, g, or t
cagaactattctccccagtatgattcatatgatgtcaagtcgggcggagtagcagtaggaggactcgcaggctatcctggaccagctggccccccaggcccccccggcccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagaccgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaccctggtgcaaatgggcttccaggagctgcaggagaaaggggcgccctgggttcccgaggacctgctggaccaaatggcatcccaggggagaaaggccctgctggagagcgcggtgctccaggccctgcaggccccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggacctcctgggccatctggtccccgaggtcagcctggtgtcatgggctttcccggtcctaaaggaaatgatggtgctcctggtaagaatggagaacgaggtggccctggaggacctggccctcaaggtcctcctggaaagaatggagaatacggacctcagggacccccagggcctactgggcccggtggtgacaaaggagacacaggaccccgtggtccacaaggattacaaggcttacctggtacaggtggtcctccaggagaaaatggaaaacctggagaaccaggcccaaagggtgaagccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggaatagctggccctcgtggtagccctggggagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggccccccaggtcccagcggttctccaggcaaggatgggcccccaggtcctgcgggtaacactggtgctcctggcagccctggagtgtctggaccaaaaggtgatgctggccaaccaggagagaagggatcgcctggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 651344 - DNA, 1323 bp, Homo sapiens
  misc_feature (1312)..(1312): n is a, c, g, or t
ctccgatcagaaaagcagatacaaaacaaacaacaacacacttggtcccttcagaccacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 651345 - DNA, 979 bp, Homo sapiens
  misc_feature (968)..(968): n is a, c, g, or t
tggatccccgacttgccattgtcttccccagttatttatttccaaaatgtttggaaacagtataatttgacaaagaaaaatgatacttctcatattttttgctgttccaccaaataaaacaaaaagcatttgaattgtatttggtggaacagcaaaaaaagagaagtatcatttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 651346 - DNA, 211 bp, Homo sapiens
gtgagattgtatccagcacagcctggccccaccctcccttatcaccgacagtcttgcgtatattccgacgtgagcgatagtaaggtcattcgcacatgtaatgactaatacaccgcctaaatacttcaacatacgtctcctaagaagaagcgtgttctcgtacataaccacagtacctatgtcacacccaagacattcatcaatgatgcag

SEQ ID NO: 651347 - DNA, 341 bp, Homo sapiens
ggcccccccccaacccccttaaaaacaaaccttggggacatggcccattaaggatcagggagccccccatttggggcttatctggtcccattgtttccaaaccctttcatgggccccactgagggaagtttaaaacctgaaaaggggaccttttttttttttaggggttagaaccaaccatataaatgtaaaaaaaaagttttagaggtctgttttccaaccctgctagggggttaggtaaccttagccgctttaaatttgaaaagcttttttttagatcctgccccctttcccggacctttttaggagggatgtagtaaaaaaagcttttttttaagcca

SEQ ID NO: 651348 - DNA, 146 bp, Homo sapiens
cccattgcggttggggtcacaatgctcatgatgcgggcaattctgcttctccctgggggtcgttgccaatatctatataaccaagctgatgaggtagagaaccagattctgtaccgggatgtccagggcatcaggcaggagcagat

SEQ ID NO: 651349 - DNA, 217 bp, Homo sapiens
atagctcggtaccacagaggctgtggacgaggtggtgatcacttgaggtcaggagtcagagcaggctggtaacatgtgaaacccatctctgaaatacagaatactaaaaataccaaaattactgcgtgtgtgtgtgtctgtaatccagctactcaggaggctgaggcaggagaatctcttccacctcccgggttcaagcaattcttccattcagcct

SEQ ID NO: 651350 - DNA, 117 bp, Homo sapiens
ctagcatatatagcaaggtactaacccctataccttctgcatatgaattaactagaaataactttgcaatggagagccaaagctaagacccccgaacctatacctgcgaacctatga

SEQ ID NO: 651351 - DNA, 1683 bp, Homo sapiens
caacttggaagactgtctatatataacttcataactagtaattggtttcccccaatgaaaagtaagctcctaactgttctttaacgtgcaactgacacactaacacaaacattctcagcaactttaacttaacagacagctccacgtagcagctcagtctttgcgcaaactacatacacttaactctagcaactccagctctacctactacagcgcattctctcactctctaacttctccttatcctcctctctggcatactagcacctctcactctactagctcatattctctgccctcactcatctcctggcaccattacacctccctacgcccacaaccctcctaacacgcgcacgcctcctcagcctacacatgtgcacgcctaccactctctgtggatacccttcaacttctcacacaaacccactgctaactacgcgcctctccgactccccatcctctccctaacttgcttctacacacacgcttaaacctctagcctcgcccctctctacttcacttgcagaaccaacccattaacctttcccaactctcaacacccaacacgcttcctccaaaccacctttccacactcacactcccgcaaccactgacaccgcttcgcgcttccccagcagaatcaccactccctccttaccacacacgcacgcccccttccaaacttgcttccacaccagctaacgcagccccccaacaaccttcttgcgcccccttacgccctctgccacacttccccctctccaccccttaaccaacccctccaaaccctcctccacacccaaacctctccccggccgccgcgccgcatctcccctccccgcacggcacacaccccttctaacccttgcgccccctctaaccctcacacccacctggcgccacttacccactttaccccacacgccacctgcgccgccctctctctacacacaccacagtttccaacaccctacttttctcaaccacaaaacaactctcactcctacacttcccattcccccttactacgtcctttaaacacacaaaccccttttctaagagagtctgattccactagtcctctgaagtcttctcccttctttgcaacaacctctccacgggtcaacacaaaaggcctcttcagctccaacacttacaccaagactacacaacacattagcgcaacacgttaatctcggatccccttacacacctccaacacggcacatcaccactttgcgacctccaacactctgcgctcacacctcgcacacgcacgacgcctcactctacaaacactctctaattcaccctaaatcctatattcaggcacattcctggcaatttctctcacaaccgtaaacttctacaccccccaacttacctacttctcgcacccactttgaggcccccacctacttttccgctccaacacaaattaacccaggcctcccacccataaataacaggggacacagtcacactacgctcaccacgcacctaacactcaaacactatgcgttctcacttctcacaccgactccactcgtcgctcacacaaccacacacattcgcccacccctcaccaacatcaacccacacatcacccccacaccagcctccagcccactcccactacaccacctaacaacccatctgccgccgcccacacacctcacc

SEQ ID NO: 651352 - DNA, 329 bp, Homo sapiens
atctcttagaggatcccattaggtccttctgcgtgtccatcatgatagacgggacgcggtgcccagcgagggcttctcgcgggtcagcctcctcaggtcggctacccaggcatccttcctgcgcgctccgctcattccctggcccggcactgcccgcgcactgcgcggactccgcctcactccatcccagggtggaagacccagccggcaaagtgccgcttccccctgacaggggtcctgctacctccctgtggcactcacgctgaaccgcgcctaaatgcgtaccgatgctcgatcttcgttaaatctctagtcatagctcatgtcct

SEQ ID NO: 651353 - DNA, 445 bp, Homo sapiens
ttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaa

SEQ ID NO: 651354 - DNA, 885 bp, Homo sapiens
  misc_feature (30)..(30): n is a, c, g, or t
  misc_feature (268)..(268): n is a, c, g, or t
  misc_feature (272)..(272): n is a, c, g, or t
  misc_feature (370)..(370): n is a, c, g, or t
  misc_feature (379)..(379): n is a, c, g, or t
  misc_feature (387)..(387): n is a, c, g, or t
  misc_feature (400)..(400): n is a, c, g, or t
  misc_feature (430)..(430): n is a, c, g, or t
  misc_feature (435)..(435): n is a, c, g, or t
  misc_feature (442)..(442): n is a, c, g, or t
  misc_feature (449)..(450): n is a, c, g, or t
  misc_feature (453)..(453): n is a, c, g, or t
  misc_feature (512)..(512): n is a, c, g, or t
  misc_feature (517)..(517): n is a, c, g, or t
  misc_feature (524)..(524): n is a, c, g, or t
  misc_feature (529)..(529): n is a, c, g, or t
  misc_feature (537)..(537): n is a, c, g, or t
  misc_feature (540)..(540): n is a, c, g, or t
  misc_feature (552)..(552): n is a, c, g, or t
  misc_feature (559)..(559): n is a, c, g, or t
  misc_feature (571)..(571): n is a, c, g, or t
  misc_feature (580)..(580): n is a, c, g, or t
  misc_feature (592)..(592): n is a, c, g, or t
  misc_feature (596)..(596): n is a, c, g, or t
  misc_feature (606)..(606): n is a, c, g, or t
  misc_feature (642)..(642): n is a, c, g, or t
  misc_feature (677)..(677): n is a, c, g, or t
  misc_feature (800)..(800): n is a, c, g, or t
  misc_feature (808)..(808): n is a, c, g, or t
  misc_feature (833)..(833): n is a, c, g, or t
ggatcttaattacatatataattatcaaangatagtccttaatttccaaaaaaattcctcttttgaaaatcacagaatcagaaagcataaactttaaaacaagttctctgaatatttacaatgtggtataaacattatagaagaccatggatattaaattgcctgggtgtggctaatcagcaaggcgtattctttattgcatatttaactcacatatgtgggattttaaatatgacagactactaaaattcaaatgcatgtatctgcnagcngggcagggggtaaaatcatgaatgggacagggcggtcagcccaaaaccatgcaattaggttgtgggtttattattttcaaaagtgaaatttctatgtnccatttganactatgtngcatattcatttngcattcacattaaacccccatttgactctnacgcngattcanggggggnngtncaacattcactcagtggctaggtccacaactcaactctcaatgttagggcggcccggcnacggnggtagcnacgcnaaccaaanggnaatggacatttngtcactngccagccctttngttacaacngtgtggtaattncccnagggcaattngcggccgggtaattttcggcggttaaggggcttccnctggggggaaacaccacaaatttccgagtgtgagngtgagtccatggtggtataaatatatatatgcataattacacaatttacactgcacacatcgtttacaggggacaattaactgagagggttaatttaaatgaccatacaaaatacttcagtanacaaagtntgacaggcagtatagaaaacattcntagactcctagaaataatctgaattccttacattctgaagaaatatcatttc

SEQ ID NO: 651355 - DNA, 213 bp, Homo sapiens
ggtcgacaacagaatccgatcctgagatgatccaagtcaaacagaaacttgacggaaatagtagagtctgaaaatgatgcactctgcgcacacatatacaagacacacacacacacacgaatccacgcacacgaggcacggggcgtgcgggctctcggtctctggttgcacgcccacaccccccctactcctgtattcagatgccctccatgg

SEQ ID NO: 651356 - DNA, 214 bp, Homo sapiens
cttactgattacatattcttctccttgatgggttctaaactgtaattatttatagtagtgtatatggatttatagatgcacacctattaacttgtacacatctaccttgaggtgataattttaaatgggctaaataatcttattttctgcccctcttctgtactttcccctttttgtatttctaccttcatttggcttacttggataggggtga

SEQ ID NO: 651357 - DNA, 729 bp, Homo sapiens
agcggcatatttgataagatatgacacaaatggcactttacttgtgatcttccttccctaaatccataatacgagtcttatcataaagaacaacaacaaaagaagcacactaaaatatgagacatattctaatacaggatagaggaatattttgcaaaatacccaaccagtatttctcatatctattaagatcatcaaaagcaagggaagtccgagaaacagtcacagtcaggagatgcctatggaagcatgacaactaaatgcaatgtcatatcctggataggatttggaatagaaaaatgactttagctaaaacaaaaacacacagaaaaaaactgaataaactatgggctttaattaataataatatcaatattaatcattaatgaaaacaaatacaccataatagtgtaagatgttaacgataggagaaactgggtgtaaggtatatgggaactctctttttaaaatttttcagttaatctaaaacagtactaaaaattaaaatctattttttaaaaaatgtgatctctgataataatgccaaacttccctttaaaagagccacatcacgccaggcatggtggctcatgcctgtaatcccagcacaaagccctgaaccaggcttgggtaaaactcttctagttagaaatagtctatgtagccaggcatggtggctcacacctgtaattcccagcactttgggaggccgaggtgggcggatcacct

SEQ ID NO: 651358 - DNA, 423 bp, Homo sapiens
tgtgggtggaatgagggacgaccatatttatttcagtcagatccatctggagcttactttgcctggaacgccacagcaatgggaaagaacctatgtgaacgggaaaactttccttgagaaaagatataatgaagacctagaactggaggatgccattcatacagccatcttaaccctaaaggaaagctttgaagggcagatgacagaagataacatagaagttgggatctgcaatgaggctggctttaggaggctcactccaactgaagtgagggattacctggctgccatagcgtgatgaagatgtgctcacacactcgactttttcatgtttaaagtatgttttgtttgtgcagacttatttctacatggtttagtggattcacattttaaaaataatcataataaactgttaaaaccaaa

SEQ ID NO: 651359 - DNA, 150 bp, Homo sapiens
  misc_feature (16)..(16): n is a, c, g, or t
  misc_feature (19)..(19): n is a, c, g, or t
  misc_feature (22)..(22): n is a, c, g, or t
  misc_feature (38)..(38): n is a, c, g, or t
tgacggcctgcagganctnatngctgcaggttgtcctnccttccgcccacgagtgcgccatgtttcagcggcgcagttgtgggagaagccacgtcgtgtttcacatgtccggagtcgaatgcatttgtaaatccctaagtcaagtaggct

SEQ ID NO: 651360 - DNA, 303 bp, Homo sapiens
ggactctgtggtgtgtgaagggagtgtgagcccgattggcgtggaggggtgtgtgtgattgtgtgtgaagagttgtgcttgggtggagtgtgtgtgtgaattgcggaggggctgtctgccgacgagctggatgtggagatgcgtcgcacgccgattgggtgttgtagtgctgttgggagtcggagaggagtggtgtgtgtcgatgcgttgtggtgtgtgaagagggaattgccttgggcgtcggctgcctcaccggctgtgtctatgccatgtctccctgagtgtgatggccctagtaatgcc

SEQ ID NO: 651361 - DNA, 920 bp, Homo sapiens
agcggctcgcgggccagccagccagccagccagcctgggcctggcggcgggcaccaggcctgtcccgatgccctggagccagtgccccagtgatgaactggcttctcgctggtgcgagctgtgctggctcttctgctgcccaccctgccctgagcctgcatcgcctgccaagctggccttcctgcctgccctgagcccacctacacggtgctggctgcctggagcagcgctggctgcctggctgcgtccctgccccaggccaactggcccagggcttacctgcctgcactgcctgcctgcaggcccatggcactgtgcacctgcaagacagccgcgacggaagggggctggcagggccggcaggaggccccgtgttgctggtgcagagaactttgacagccatcgagacagatgctgccgccagaaccagtgtgctatgataagcttccaggcaatgcctagctaatggccttgggaaccagcccctgtttactgaatgagttccctttactttacattccttggcgggccaaactgtggccactgtggggaacaaacactggaggcatctcgtggctttgccagttggtttcccagttgcacggctttgttgcgttggcactctatcacatgacacctggcatttaccacttgccttagagtcccttttcgttccggcgaaccgggtgacacaaacggcacgggatggtgaaacccatggggggccccgcatgtaattggcttgccgaagtgcttatgatcgtaaccaagttgtgtggcccgttcacggagaagtacaaccggtagagatacaagacgggtggcgaagccaaggtcctttgcgttcccgataacgtgcacaattacactccgggggaaattaacaggcgtccggatcaaagaccgtccgaggagcataa

SEQ ID NO: 651362 - DNA, 492 bp, Homo sapiens
tactaagttatatccttgagcaagttggctgtttcctgatcaaataggaggtcatttgtgagcaaaggtcatccatacagcatttcatatggattaagccccatttttttaggagaatttcggattcttaacaaggccatgggtgagagctaggctatgggagatgagtttctttcgttagtttccttaagtgcctcttgagctgttttgtcttcttggccttccctgaggattgtggcctccaggtgcagtgacaggtgacattgtatccctagcgccctagaaattccctgagttattgtggccttaaaagctggaccattgtcactttgtaagctttggggaagcccaaatctaggaattaggactttaaccacttaccaagccttctctgtcttgtagggcaaagggcttctaatcgcaatctctcgtgacaggtgtcaaccactaggcccaaccaacgttagttcgacacattcccttttgaactta

SEQ ID NO: 651363 - DNA, 260 bp, Homo sapiens
cttgccatgtcactttgattccccaaaacttaactgctaatagctactgtgactggtaaccttattgataacataaataattgattaatcccatacttaaactagtatctacatattattctatgcattcatgacatacctaaccttttcttgatttttttttttttaatgtttctaggctacagggttcatctgggtagttttttcattttggtcacaattcccaaaaaaaattttccaatatgtgtattgggaaaaaa

SEQ ID NO: 651364 - DNA, 143 bp, Homo sapiens
gtcgggagaagggagggagagaattttattaaatgtgacgaactgcccccccccccccccagcgggaaagcggcaaattttttgcaatttttggcggggtttccctggtccggccgggttaaaaccctggattttctggtaaa

SEQ ID NO: 651365 - DNA, 1094 bp, Homo sapiens
  misc_feature (585)..(585): n is a, c, g, or t
cccacgcgttcgagggctgtggtgaccgggctggttccactagtgggcatggaccataaaacgacgtgatcctccactgtgctcccgtctgcaccacgtccagtggttgtggtcaagcgcgctgctctgtcctctctgggtgggatgccatcctgtgtgtactgatgcctgagttcagccctcatgtgaggtttggtgaataagttcttacatgcttctgtaaacgccgcttggcatcaatgtctttatgagctatgttgccttatcaagtatacaccaagtctgcatggcacgatacatacagcacgagtgcgagtttgtcacccaacggcccgtcgagcgtccccatgtgcacttatccattggccgtgggccatgtgtgtgttgcacatgcaagacaaaaattagagacttgcattgtggtccttcatgggctcgatcatgaccccgggcaccactcccaggcttgcttggagaacgtaggaaagaacaatcgactggtgctcactagccgcttcgctggtaggtccgagctatctcgcgaagattgatcgctcgacgaagtcgggctaggttgtgcttctntgctccaaggagcccccttgtatcccactttgcactagtgcctgtccctttgtcccaggtgatatcccagatgggggtcgaccctccgaacttggtcggcctggaagctaccagggctgtccgcattgagttctccatgtatacatatccactactaagtagaggaaaataccatgacatctcgtaactccgcaatcgcacgtgccagtaaggggagcaacgcatgaagggagtgaaccctaaaggttgacccaccccaggggtctgagagaggaaacccagtgacgggggggaaggcgagacattgggttgaaaggagagaaccccatgccgctagtattacgaagaaaattacctagggacagttataccccacgtaaaagaaacccttaaagtacattgcatttcaccccgtgggtaatgggcctagggttttacctggacaaagccgagaacaaccgcggactcgatcaaaagcgaagttgccccaagaaacatgggaatcctga

SEQ ID NO: 651366 - DNA, 100 bp, Homo sapiens
ctactgtctgcccctcacaagacctgctcaccaagacctgctcctgcttctgccttctgcaaatggctgcttcctgcttctgcctcctcaccaagactct

SEQ ID NO: 651367 - DNA, 435 bp, Homo sapiens
gtgagcggaagtgtgtgaagtctcccggcgataggtcttagtggtagcgggctggggcgtactagagcaagggccctaaatcttggcgctcagtgtcctggaacgccggtctatcccacccatcatgcggtccccaggcctcccttcctcattccttccatgatatcgtctgcggaggttgctgggatccccaatgctgtgctcctgaatccgggtctctaacggatgtgtccgtgcgacagtcattagattaatactcttgctgtggcacttgatgaccatgggatgatggggggcctcgtggctatccaggccctggcctgtcctgcaggctctacacgaagttctcttcctcttctgcagactcaccacctggcggctcctcaggggtgcctgcgcagctgcccgcgtggcgcacgccgatggagcggccca

SEQ ID NO: 651368 - DNA, 606 bp, Homo sapiens
  misc_feature (142)..(142): n is a, c, g, or t
  misc_feature (150)..(150): n is a, c, g, or t
  misc_feature (152)..(152): n is a, c, g, or t
  misc_feature (163)..(163): n is a, c, g, or t
  misc_feature (196)..(197): n is a, c, g, or t
  misc_feature (226)..(226): n is a, c, g, or t
  misc_feature (234)..(234): n is a, c, g, or t
  misc_feature (254)..(255): n is a, c, g, or t
  misc_feature (262)..(262): n is a, c, g, or t
  misc_feature (286)..(286): n is a, c, g, or t
  misc_feature (288)..(288): n is a, c, g, or t
  misc_feature (299)..(300): n is a, c, g, or t
  misc_feature (302)..(302): n is a, c, g, or t
  misc_feature (311)..(311): n is a, c, g, or t
  misc_feature (328)..(328): n is a, c, g, or t
  misc_feature (335)..(335): n is a, c, g, or t
  misc_feature (345)..(345): n is a, c, g, or t
  misc_feature (350)..(350): n is a, c, g, or t
  misc_feature (356)..(357): n is a, c, g, or t
  misc_feature (367)..(368): n is a, c, g, or t
  misc_feature (378)..(378): n is a, c, g, or t
  misc_feature (380)..(380): n is a, c, g, or t
  misc_feature (386)..(387): n is a, c, g, or t
  misc_feature (389)..(389): n is a, c, g, or t
  misc_feature (391)..(391): n is a, c, g, or t
  misc_feature (406)..(406): n is a, c, g, or t
  misc_feature (451)..(451): n is a, c, g, or t
agcggctcgcgccgcccgacgacctggacctgttccccacgcccgacccccactacgagaagaagtactacttcccggtccgcgagctggagcgctcgctgcgcttcgacatgaagggcgacgacgtgatcgtcttcctgcncatccagnangacgggcggcnaccaccttcggccgccacctcgtgcagaacgtnncgcctcgaggtgccgtgcgactgccggcncggccagnaagaagtgcacctgctaccnngcccaancgccgcgagacttggctcttctcncngcttctccacnngngctggagcntgcgggctgcacgccgnactgganccgagctcancaacntgcgtnncccggcgtgnntggaccgccncngactcnngncngcgctgcgcacgccncaggaagttctactacatcaccctgtacgagaccccgtgtcccgntacctgagcgagtggcggcatgtgcagaggggtgccacgtggaagacgtcgttgcatatgtgtgatgggcgcatgcccacgcctgaggagcttgcgcctgctacgagggcacggactggtcgggctgcacgctacaggagttcatggactgcccg

SEQ ID NO: 651369 - DNA, 148 bp, Homo sapiens
ctatccagcccaaaacacctaagaatggaggtaaagcgaaggcccagcacagtacccagaggaaactgccaagccaaaagatgactaaagaaatacaagttacggtatctggtatctagcatgtaaaatcttcagctggtggatggtc

SEQ ID NO: 651370 - DNA, 991 bp, Homo sapiens
  misc_feature (991)..(991): n is a, c, g, or t
ttaaggctctcctcggtgtccacggcaccctctttccttggttgcagcgatcctactgccagaaattcgccatgtctattctcaggatccacgccagagagatcttgactcccgtgggaatcccactgttgaggtcgatctgtacaccgcaaaaggtctcttccgagctgcggtgcccagcggtgcgtccactggcatctacgaggccctagaactccgagacaatgataagacccgcttcatggggaagggtgtctcacaggctgttgagcacatcaataaaactattgcgcctgctctggttagcaagaaagtgaatgttgtggagcaagagaagattgacaagctgatgatcgagatggacggcacagagaataaatctaaatttggtgcaaatgccatcctgggagtgtccctggctgtctgcaaagctggtgccgtggaaaagggggtgcccctttaccgccacatgctgacttggccggcaaccctgaagtcatcctgcctgtcccggctttcaatgtgatcaacggtggttctcatgctggcaacaagctggcatgcaagagttcatgatcctgcctgtgggggcatccagcttccgggaagacatgcgcattggagcagaggtttacacaaacttgaagaacgtgatccaggagaagtccgggaaggacgcacccatgtggtgatgagggtgggtatcggactaacattcggggaacaagaagcctgggagcggtcaagaagggagggaaggcggtaactgacagggggctcggcggagggggcgccaagatcaaaggctgcaggtgacggatcaagtctcgggacccgggttcacccgccaccggggtggaacatcgcgaaacacggggaaaacgtcgagagagggggcggcaaacacagtagggggagacacacaacggagggggaagagcacagaacaacaaaccacgaggcagaacgccgtcccacacaccaccacgcn

SEQ ID NO: 651371 - DNA, 159 bp, Homo sapiens
aggctgacgtcctcttcaccaggagcagcagcctgagcactatgaggtcagcccaaggagctcgctggagagatacgatggtatcgggcctcccttcagcgtgcatcttcaggatccagaacttgggcttgtcccccatccacgggatgatgatgaaga

SEQ ID NO: 651372 - DNA, 356 bp, Homo sapiens
gatgaccgcgttgccggcggtgcgcgcggtgatatcgagaccgtcgaggatcgggacacccgagctcaacagcgttgacagcgttcgacagaacgcgccaccgcgatcttgcgcatcatcatcccgagcaccggcatcttcagcatgatgccgtcaatcctgtactgccctcccaccgtcccgtagtacgtcttgaacgcatagcccaccgcgaagatgccgacgatgatgaatggcatgaaggcgacgaggaagtcgctgaggaagatgacgatgcgcgtcggcagcggcagcttcgcgccaaggccggcgaacaaggccgcgaaagtcggaatgaccttccagagaatgacgcc

SEQ ID NO: 651373 - DNA, 113 bp, Homo sapiens
aagaagattgcggatgagaatgttttcatgttacttataccaacattagttcttctatagggtgatatgattggtccaattcggtgtgtgaggagttcagttatatctttggg

SEQ ID NO: 651374 - DNA, 393 bp, Homo sapiens
ggtggtggtttgtttggttcgttaggtaatttaagttacactttaaacacatagatctagaggggagaagtacctcagaggacacatctccaatctaaattaggtcccactagtatgaaccttcacagcccctaattcttttctgtagcacttacctcaattggtaatggcatggctgtgtgtgtgtgtgtgtgtgtgtgtgtgtgtgtgtgtgtgtgtgtgtatcacctcttttctcccccaatagactataaactgcctgagggtgtgaatcaaatctgttgcgctcgcgtgtctcagtacagatcgtgcgacatcatacgtgtgtgagaacatatcgataggaatgaatgagtgaggatcttggggacactcctatcacttccctctgtc

SEQ ID NO: 651375 - DNA, 915 bp, Homo sapiens
  misc_feature (636)..(636): n is a, c, g, or t
  misc_feature (673)..(673): n is a, c, g, or t
  misc_feature (724)..(724): n is a, c, g, or t
  misc_feature (734)..(734): n is a, c, g, or t
  misc_feature (740)..(740): n is a, c, g, or t
  misc_feature (744)..(744): n is a, c, g, or t
  misc_feature (751)..(751): n is a, c, g, or t
  misc_feature (769)..(769): n is a, c, g, or t
  misc_feature (775)..(775): n is a, c, g, or t
  misc_feature (782)..(782): n is a, c, g, or t
  misc_feature (796)..(796): n is a, c, g, or t
  misc_feature (800)..(800): n is a, c, g, or t
  misc_feature (811)..(811): n is a, c, g, or t
  misc_feature (817)..(817): n is a, c, g, or t
  misc_feature (819)..(819): n is a, c, g, or t
gcctttagcagctgaaaggggatttaggcccggaagatccgagtccatccgcggcggggagagggcaatgcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagacagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgcttccaggaaattcagcctcaaaaccgtcctgctggttgctgaaccanatgatcagtcgcatcgaatacattcattcaaagaacnttcatccaccgggatgtgaagccagacaacttcctcatgggcctggggaangaagggcacnggtgtncatnatcgatngggctggccagaagtccnggatgncgcaccnccagaatccccttngtgngaacaaactcncgggangnggcgggacgcgcccactaaaaaggagcttgtgttgtgagcccacaaaatctggggctgtggcggcgaatgtgtgtacgggcgccccccgagagagg

SEQ ID NO: 651376 - DNA, 191 bp, Homo sapiens
aaccctttggaaggggggtggcagtttttcctttttggccccccccccggtttttttaaaaattgggcataaaccggggatttgttttacccggtcatttttttaactggggggccctatagtttggtttccttggtagattttgcctttttcaaggggcccccacccgccataaacttttccctttttga

SEQ ID NO: 651377 - DNA, 464 bp, Homo sapiens
  misc_feature (40)..(40): n is a, c, g, or t
tataagtactttgtcactaatgtcacgtcattgtcataanacgcagtgcactatcacatcaacctctggtctcaccagtcggcggaggtatgcacagcagtcaaccatttcaccataggtttcaagaagagttacaactgtgcataatcggtgtccaaaaagggtatgaagtgatttgacacaagtttcatctgactcatcagcaacacatgctttggcaaatgcagttcctgcagtcaatagttatccatgatcttcaaatggacacggctgaagatactgagcaaaggcagtcaacaccaaggcatagaaattttcgtctcccaaagctttaagccgatgagcatccgcactagtgtgagcatcacgacgaaacacacccctgaaataagccaagttaaagagaaaaagaagggtaataaaggttaaccgtctcagtgtatcacacgcgcgcggggtcgacc

SEQ ID NO: 651378 - DNA, 207 bp, Homo sapiens
tataacatacagaagggctattgtaagtaggtctcatgagttggagtgtaagataaatcatgctaaggcgaggatagaaaccgatatcgccagatacgagatagtataggattgcttgaataggctagctaagtagtaggcctctgccccacggtagtcaatcagcgccatcatagatgagcgctataaaccccacggaagtcatca

SEQ ID NO: 651379 - DNA, 451 bp, Homo sapiens
aaaatctggaacacattcgggcccgaggtccactgtttgccccccccgttggaggagttggccctgaacgagttggtaacgttaacgtgcttggcacgcggtttaagccccaaggaagtgttggttcgttggttgcaggggtcacaggaattgccccgggaaaagtaccttatttgggcattccggcaggagcccagccagggcccccccccttttgttgtgaccagaatattgggggtggcaaccaaggattggaaaaagggggaccccttttcttggatggtgggccaagaggccctgccgttggccttcacaaagaagaccttggcccgtttggggggtaaacccacccatgtcaatgtgtttgtttttatgggggggggggggggcccctgttattgagccgcccgcctgtccccccccctgaataaattccatgttcccccaagca

SEQ ID NO: 651380 - DNA, 301 bp, Homo sapiens
  misc_feature (33)..(33): n is a, c, g, or t
ctcggtacaatcagttaacaacaatatgaatgngcaattttatgttgaattttacaataatttttttttttgaaacagagtctcgctctgtcgcccaggctggagtgcaggggcaaaatttcggctcactgcaagcgccacctcccgggttcatgccattctccggcctcagcttcccaagtagcgaggactacgggcatacactaccatgcccagttaattttttggtatttttagtagagacggggtttcacccggttgggccagacgggtctcaaactcctgacctcaggtaatccac

SEQ ID NO: 651381 - DNA, 1468 bp, Homo sapiens
ggtccaggccgctggtgtggagatggtgcaatcgcatctcctcggggatgttggttgcaagcaactcctaatcctcgctaaaggcagtgactccgagacgcgccggtgggcgtagcagtagcgtcctgactactcccatgtctgtgctccgttggaggtcacgcgtgagctgaggagagacttgggaggtgctggtcctagggaatgctcaagtgggacctggctgctgtcgctatgcacagtgatttcctggccattcattctagcaccagtgctctctctagccccgatgaacagacaggtcctatggctcaagaaaagactagtgcctcaagtaccattttcttagggcgcgcatctgttgactcatcaggattcaatatcgccttgtgaccccacttgtatccgcgcgtcaccatccctactgaatcggtcccatcggggggcagggcccatttggggggactaggctagcttgccacaatgggcacttgaggggttgcccaattgcattcccgattggtccccgggcggacttgacacgccttcgagctaatgaaagctttcgctctagtgcccacgtgtggaatttacactttgtgccaccctagaaaaaggttcggaaccctttgcctgtggccagtggggcccctttggtccatgcgaacgccacggaagtccggacagtgccatgacaaccattctaagggtgggcactggaatggtccccatccaggaggtgtcaaaaggtctccggtcgttaccaaggaaaccccaagagcatgcgccatagtcctcacaaggggccgacccccacaggaaagacgccgccccccaacggtggggtggggcattctctacggtgccaagcggcgccaacaagcggggtccgcccaatggccctaaggaacgcgcaagatccacgctggtgcgctataaaccaagaaaaatgggttcgaaccaaagggcgccacattaattaggcgccgttggttagggtgccccactttgcgagcaaagaacggggcgccccttcccgtgtcgtaacggttagggcccagcctttagaagggccaacggaaacgtggaactgcggtgtggccacatgcgtagtagagcgccaagagcacaaatcacctatacgcccctttgggcgccttctccaaggcggagaacgcaccaatcgaaggcccgaacactttcgttatacgtgcccgttgaacacggggtggcgccggtccctcggttgttccccgccccgtttttcgacgcaataagtgtcccccaaactgtggggaatttccttggggttcacctaaacaccctaattccgcccgccgcccacagcgttggtttgccaaccttaagacgtggggggtgccccccagagtgactccaacgagacccaatttgtgttcctatgggcaagttattcccagcgggtaggcgcgcattaaaggattcagag

SEQ ID NO: 651382 - DNA, 379 bp, Homo sapiens
cctagatatgtatgaagtggaggtatcaggacaatcctatattactatttatggtcttatttataataaggatcctcctaagtagtaatgtttctggaaactcttaatgctgatccattctgagacaggcacgtgagaacttacttacgttcattagcaaatagtatctgcatgatgtggagggtccaaagaagatgcgcaccagtctacggtaaacatctagctaaggctgagtctgtatgacacatggagtctgcaggcatgtcggacggtcagatactgtccctaaccggagttgctgtctgagaatgctgatggataagggttaagcacctctgtcaaggagtgtggaaatttctgtgcccatttcaaggggatc

SEQ ID NO: 651383 - DNA, 1009 bp, Homo sapiens
agcggacttgctgctgatgaaccgtgggcaaccacgggtcggctgaaggatcccaaaatggttgggcgaaaagttgctctattcaaccattgactgtggtaacttttgtgtgagagttcataccccgagaaaccgaaaaggcagattgctaaggttacccgtaagacaaatccttggcaactgagagctctctaccatcacaaggtccggcatgctatgtaggcgtgaggaatcccatcaagtctatcgacctgggccttcactacagaaggcctaattgtcggtctagggctggccttggctgcgactgactgtctgatgaacgaacgattctaatagcgcatgaaaggctgtcccggtgccacgaggactaaaactagtacctgagccaggatggcaatgccggatgagacaacacgcacaggagtgtgaccaatcattgctgctgcagttggagtgctcgtcgtctcaagagagggccgaggcattggttgcaatgatgcagcagaaagcagtattggctagagaggatgcaatgacacgttagaattgccagtattgaatgctaggattgcacgcatttgaaggggactctgaaatcgaatagcgttttctcctaaggataaacgcatacattctcaagtaccatagcacacagaaaagtaatcccgcgtcactttgggcctccacccagaacccgaaaatatatgacggaaatctctcatgagagagagtttcgaaggttccccagggaaggggaaacgtctaccttgtggacccctttgggtcagttataaagccacgcaacttactatgagaagcccctttgacacgggagattcaactcagaatgttgaagttagccaaccgaaagacagaactaacacacctaggaaaaactcatatcccctaagggatgcggtcaggtggagatccgaaaggcgcacgcaaaagaagggaggggactcaaggaatagaacgaatgcctaaagagagtagaagatgcacc

SEQ ID NO: 651384 - DNA, 127 bp, Homo sapiens
gcttaaataaccagaacgtattttcacacaattctggatgcctagatcaaggtatgtgcagggttggcttgctttgaggcctctctccttggattgtagatggccgtttcccttctgtcgtcttctc

SEQ ID NO: 651385 - DNA, 130 bp, Homo sapiens
agcgaattctgcgcgcgcgtaggcttacatggagctagcttctggacactaccgattaagtggcccgagtagcatagtgggtgctcgactatcgagtgtgtagagccggtcaagaaggtgagcttcgagg

SEQ ID NO: 651386 - DNA, 357 bp, Homo sapiens
tgctgtattcacacactgcgtgtcgatgccatccctgtacccgttcctgtcgagacgtgcagcactgtgcttgactccaaatatcgcacagctgcagcctgatcgagtctcgaggatccaccagtacccgagctatgcttgcatagcctgcttgtcgacgtgtactcagtactgcggtgcatgccatccctgaacaagttccggggacacgtgagcaccgtgcttgagctaccaaatatcgtaaagactggagcctggtcgacgtgtatacaccaatgcggtgcatgccatccccttgtacaatgtaccgtcgacacgtgagcaccgtgcttgacccaccaattatcgttaagctgg

SEQ ID NO: 651387 - DNA, 221 bp, Homo sapiens
ctggtccccaaatcccaggtggttcagggaacaagccccctcaaaaaagtttttttttgaaaaacctttttttcccaattttccggtttataagacctttcctaatttatgggggttttaattgaaaataaacctgagtccccaaaaagctggttttttttcccttcctcccaaaagccaaagccaaataaaaaactaaacagcctttgtttgggtttgga

SEQ ID NO: 651388 - DNA, 206 bp, Homo sapiens
tggaccagcaggctgggcccagattaagatgtcaggtcattaagtgaaagataaagtgaggcctatattcaagttcagcaagataacaatccttacaaccaaggacaggagcttaagggaaaaatgacattccaaaataagagaccctcattatacctgaggcatgacatcttaatctgggcccagcctgctggtccggctcactc

SEQ ID NO: 651389 - DNA, 137 bp, Homo sapiens
actggtccgtcttgttactgctttgcaccgtggtcagagggactgtagctgagcttgatgctcccctgtgagccagcatgggctgtgatgtggctgagtcctggagccccacccagacctaaatgctggcacagagt

SEQ ID NO: 651390 - DNA, 124 bp, Homo sapiens
ctgtctgagcagctgggaacaggcacgcacacacgccggcaatccttgccatctttagtagagatggcatttctccacgtaggtcaggctggcctcgaactcccaacctcaggtgatctgccca

SEQ ID NO: 651391 - DNA, 231 bp, Homo sapiens
ggagctgcctctgtctgtcttctcaggacttccgagaggacctgccaaacaagtcgccccgccaccgagcccagtacaacacctatcccatcatgctcttctatacgtccaacatccacatcatcctgcaggctgccctgaccccaacctttatgtcatctcccacatgctctcagctcgcttcagagtcatcttgctgctcagcctgctgtgcacctggtcgaacacgtg

SEQ ID NO: 651392 - DNA, 399 bp, Homo sapiens
gtcgagctcggtacctacttttccacaggctgtctgtgctggatacagaagttgcgtgacattgggcacataccatctgcagcatctctttcttcttgcagccctcttttgagcaacggtatgtaaaaatctaagagagcaaagtgacttcaacaagcaattctttttttggagacagggtctcgctctgttgcccaggctggagtgcagtggcttgatcttggctcactgcaacctctgcctcccggactcaagcgattctcctgtctcagcttcccgagtagctgggactgcaggcgcatgccaccacatccagctaacttttgtatttttagtagagacagggtttcactatgttggccgggctggtcttgaactcctgaccttatgatctgcctg

SEQ ID NO: 651393 - DNA, 135 bp, Homo sapiens
gaggaccagaatcattccctgccctggtagtgacttggagccctgaagaagggacaatcatggagacacagccactgtgccctggtgtatcctgctgagcccctgcatatgcccctgagcctggggattgcacgt

SEQ ID NO: 651394 - DNA, 261 bp, Homo sapiens
agaacattcagagggttgggagaaaaaaaccaggggcaagccgggcttggtgccgtacacctgtggtcccagctacacagaaggctaaggtgggaggattgcttgagtccaggagttcaatgctgcagtgagctatgataatgccactgcactccagcctgggtgagactccttctccgaaaaatagagagagagagagagagagagagagagagagagcgcccacattctcatgaggacatcagcagtgatatttgtttg

SEQ ID NO: 651395 - DNA, 210 bp, Homo sapiens
gcaggtgtgtctgcccaggcataaagaaggaaaattggcatctttcccacctctaaattctgtaaaattatagactttgttcaaaagattcctttttatcatccccacgctggtgtaagtcggaaagcggcatttgtgttcgcgtgtgtagtccagtattagcagcgtgctctgccacccgtagctgtgttattgtgacaactctccctg

SEQ ID NO: 651396 - DNA, 286 bp, Homo sapiens
  misc_feature (202)..(202): n is a, c, g, or t
ctaggattctgccatttgtctgaaagctttagaatcattctacacagatgccaattttccatcaagttctgttactccacagccctgttaaaaattctcagcatggtggaacatgatccctgctaagaatacaaaaattggccgggcgtggtggcgcctgtctgtggtctcagctcttggggaggctggggcaggagaatcncttgaacccgggagtcatgggttccagtgggccacgactgcgccactgcacttcaggccgggcaacagagtaagactctgtctt

SEQ ID NO: 651397 - DNA, 788 bp, Homo sapiens
ctgtcataggggtcccatgctgacagattactcacctcagctccagcaagcctaaattgtcgatgttgtgttactggccaagaaagaagcaatgttcttcagtctcagaatgagttggtttatggggaaaagagaagagaatctaaaatgtaagccccgttgcggtcaccaccgctacagtacaaggtgaatttcttatccagacttgccgcacaattgatcaaatctatgctgaaaaacgtgactgaggacacacgcagtgttctgcgttcctcgatgccaggagtgatggtggccgtctctgtcaagcctggagacgctgtagctgaatgtcaatacatttgcgtgagagaagccatgaaaatgcagaatagtcttacagctgggaaaactggcacggtgacttctgcgcactgtcaagctggatacacattaggagatggggatctgttactgactctgtaatgaaggatttataacctgttgagaatgacccaatctaattaaccatttgcatgacgcttatacacacaattgattcatgccttatacaagaacacgtgtgcgcagctacatttacgtgcccatatcttcaacagagtccagaccattgttttgtcacataatctcccgtggaaatgtctattgatataaatacttggacatatgattaggacttcagctgcgacattcctttatggaaacattaagttactcaatgctgatcgcgtcgttctcttttattgagggatcattcctgattccggatcactgactcgctgcgctcg

SEQ ID NO: 651398 - DNA, 288 bp, Homo sapiens
ccgggcccggggcccggggaggcactcaccctgcttcatggatggagtggaggaggggacttgtaaatgacatcagtcaaacctgcttcaataacttctctgcacactcgcccacaccctgtcttccgtccttgtcctgtgacattttccttttgttccctccttcctaaagctgtatacacacctggaccttgttcattaacattaattgattcctcttgcgggtctctgacttgaacacctcttgtcttagacattctagctgtcttgcccattatattgctacat

SEQ ID NO: 651399 - DNA, 1004 bp, Homo sapiens
ttatgatctgcctgaggcctctctcctacccagatagcgatgttatactgatgtgtttctccatcgacagccctgattagttaactagaactatccctacgaaacaagtggagccccagaagtcaagcatttctgtcccaaggtgctccatcatcctggtagggacaataataaggatcttcggaatgatgatcacacaaggcgggagcctacgccaagcatgaagccatcgatccaggtgacatcacctgaatcacaggctcgagtatctggcgaaaactagtgcattggtccgcttgtatcggagtacactggagttagttgtccatgcgacatatgacccaaaatgatgtgagttgtaggatgaggtataccgacattgagcctgacgtccagccttgcatctgtccaccttagaacgtgggacagaaacaccatctgcggtgccgttgtcttagtgaaaaagccttgcatggtcaaatcctatcaagaccttagaagtggcggttatagagttatagataagtggccttgtattaattcaatctttagatgtctcgtatatactaggccctatagttcattattatcttattaggtttattcctaccgattacagagatctagaagtcatctggctctcaaccatgcactttcagaaagaccaagtactgattattaaccgattgtcctaccccgtctggccccacccaggggtcccttctgtgaactactgggtctattctgcatctccttctgcattcccgatctgacggagcagggcgctcatttcaatggctctcttaatttcttgctccttatctatgacagacgaaccgtttgggtaacttttgggcaattcgctgtgctccttttctctctcatgtgctgcccaattctgccactgaggtttcgggtgggttccccctcccgggttctcccacccctttgtggggttcgcggggggcgccgtttaacacaggcctcccccaaatcactgcctt

SEQ ID NO: 651400 - DNA, 202 bp, Homo sapiens
  misc_feature (3)..(3): n is a, c, g, or t
  misc_feature (23)..(23): n is a, c, g, or t
ccnatggcccattaatcccttancccttttgcacccagcttcttctggatgagttctaatagtgtcccttgggtcttacattggctataatctcaaagttccattttatgatgtccatggactcagttacatactgcaatataaccatacgtgccagctttttctggatctacccaaatttgataattttctccccaaactg

SEQ ID NO: 651401 - DNA, 206 bp, Homo sapiens
ctctagcgctaatgttgctgcatttatgagctcgttactttgggatcttgcgtgatccgggtgctgggtccggtccgcgcgccaggtgagccactgccacgctccccgcgccctgccactcgtggccccctccatcctcctagctcattgtcccgcgtcccccgacccgtttactttgaccgcgttccagtgcccttatcccgccc

SEQ ID NO: 651402 - DNA, 227 bp, Homo sapiens
tcaggagcgaactagtgtgcccagacttccttatacaatatattaatagcactacacacacacaaacacaccttaacaggagggcatcgcccttaatatgtagttcgacatctaggtctgaatatcatttcggaagtggttctccattaaatttatactatacttcaaaaaacacttagctagcactcatagaggactggtccagtccactcatttggccatgactg

SEQ ID NO: 651403 - DNA, 472 bp, Homo sapiens
  misc_feature (95)..(95): n is a, c, g, or t
  misc_feature (126)..(126): n is a, c, g, or t
  misc_feature (130)..(130): n is a, c, g, or t
  misc_feature (160)..(160): n is a, c, g, or t
  misc_feature (162)..(162): n is a, c, g, or t
  misc_feature (289)..(289): n is a, c, g, or t
  misc_feature (298)..(298): n is a, c, g, or t
  misc_feature (315)..(315): n is a, c, g, or t
  misc_feature (318)..(318): n is a, c, g, or t
  misc_feature (330)..(330): n is a, c, g, or t
  misc_feature (336)..(336): n is a, c, g, or t
  misc_feature (369)..(369): n is a, c, g, or t
  misc_feature (378)..(378): n is a, c, g, or t
  misc_feature (391)..(391): n is a, c, g, or t
  misc_feature (399)..(399): n is a, c, g, or t
  misc_feature (401)..(401): n is a, c, g, or t
  misc_feature (459)..(459): n is a, c, g, or t
tgatttgaaccctgcttcgacgtgtgtgtcatggcttaaaaatagctgctaatctgtcaacctgtcttgggcagaaacagcggcggcgaccacanagggagcgtcatggccgtgcgctgtctgcgngcgnatccgctttcggactgaggcccagcgcagntntgcaaagagcagctacctggcaactgaacccatcatcaccacagccactcctgcagctgccacggtttctgccacctctaagatgtgccctgggtaactggctttgggcttctatgacttttatggnccgcttctnccggagtagctcaaggnctnctgttcgaactngagggnacctgggaggagatgccaaccgtttcaacatcntttcctcantgtctttgggttnggagcggntnctttacacagggaaggacagcttttaaccttgccgacgaggttttggccagggttttntttttgggggacc

SEQ ID NO: 651404 - DNA, 118 bp, Homo sapiens
tccaaccgggactcctttgtagagaagggacagaggctcagaagtgaacccacttgcccaggtcactggggagaggttggagccttgagctctggaatcaggctgtctggattccaat

SEQ ID NO: 651405 - DNA, 200 bp, Homo sapiens
atagatgcgtcttctgagtataggctacaactaaaattttacgtggtttgtgcagtggctagaaaacattaattgtaagcagtttttcagaatttaagaactctcttagctttgaacatgtataatatgtaatataagcatagagacttgttggcgacgttatgtttatcacataaacataagaatgaaggcacaggagg

SEQ ID NO: 651406 - DNA, 1158 bp, Homo sapiens
  misc_feature (138)..(138): n is a, c, g, or t
cgtgtccggtctgtgtccggggcctgtagcatgagcgtaccggccttccatccgaccatccagagcaagcatagatcgcaggctgcttgagctttcggggcttcatctggaaatctaaagcgagcgtgcaggatttgnaggaagcagaactctggcaaggtggaacttccatgttggattttgacctcaaattattgaaggccctgtggatgatgtcgctgcgtgagatggagggatgactaaagcatgtggaacagtgtgcatgacacagccgtggatagtccctacctcttggatcctggatatccagacgagcaaagactcctttgcatggtagaaagcactaatgtgcacaaagactggtcgaaacttttcagccgagagggttgagattgctccggttctactcgaagcactggccacggttagttgacagtcggacccgtttctcgcaacagtgcgaatggggaactaaacgaaattacttcccttgtatacgactacacactaagtcagtaagttagctaagggcctctatagtttaaaatagtagggcgatgccactcttggctgcgcgagcccaatcccaagataacaattccccgaaaactcgacgcctgggagtcaaacgctatagaaacagatgggcactattccatgaacttggtaacactacgttcaacccgaaccttgtcaaaagacaacaaaggacaagcgacccccttttttaaaagaaccttaacatttttactcgcaagagggccaacatatgggttgggacattttggtcacaggacacgcaagctggaatcgactggccttattcaaagcaaggtacattggttgggcaaactaggctcggggcaagatcaaccaacaaggaaggggaacaaaaatggtgactatcccccccaaggactctgaacgttctgcatggcccccaacaagaggttggatattgggaaccggacagccattgggaacaacagaaagtcccaaacaatgggcacatattacacttgtagtgaagcccaaacgatatctttaaccttgtaaaaaaaaccccaggtacacaaggatatatagggcacaaaggagaaagacctaacttgcaataaaaccatatgtaaaaccacaatatatgggaggagcgattca

SEQ ID NO: 651407 - DNA, 862 bp, Homo sapiens
  misc_feature (476)..(476): n is a, c, g, or t
tcagccatgtgcagactagatgtatttcaatgctcgaccaagtttaacttttgtccaataccggaacatgagaattggggctgaaccccaacttccatgaaactttgaaggtgcccttttctgcacccttagtgcaatacaatggtgctgtaactgttgaagtggtttgtgaaccaaatgcttgatccacaccgcggcccatagagggtcataacaatggggtgaccgcatacacttgtgcgccgcccgttggcagtgtatgttgaaaacttctgctgggtttgctgcccacactatggggcaccgcttatcgcccccgccgccccacaggcacccactgtcgtcgcccacggtgcaccaggtgcccgcgtccctactcaccaccccaccaacacagtacgtgttgtctcctcgccttcctcgcttgtgcggtgcccttcttcacgtgtgcacaccaccgccccaggtttttaggnttttggccaaacacacaaatacacaatgggacacgggttgaaccagccccgtgggcgtcccatgtggcaagggaattttgaggcgtcctgcatctctagcaacgcacaccgatttttcttcatggccataaagctccggctttgtagattttgtgacccaaaccacggtgggttctcccattcccgttcaaaaccacctgtggccacaactcttggaatgggagggttggtttccccctacctcagagcttcccccaaggccacttatggtgttccccgcctcaattcctaattttctttgggataatgttgaaacttcacttttgttaacacacacggtgactcttgtcccagtttccaacgcccattacttctttagagtgtgg

SEQ ID NO: 651408 - DNA, 863 bp, Homo sapiens
ataggttctctgcttcgaattgggtaatcaagaacctcctatacttgactactaattagtcatcaccttcatgaatatcaccacattcgatcaggaagacgtacgaaaaatctctatccacatgtatcgaaatgcagtgtctgccggaccatattgagtacacgcgcggacggcgtcacgaaacctgctcaatactgattctttcattagactaagatactggctcattcgcttagtaaatagcgaatctggaagacttcgtcccctcggtattttggtcaccattgcgactgaagtggtatacaaaaaccaaacgtacaggcatagtacgaatagggtaagtcagtgtccactcgcctcgttaagtagatttccacctcatcacgtgaaactgcgtagagatcttggctcatatttaacgctcgacgtatcggatagtaaggacttagaacttgaaatcccgaaaacaagctcataattgatgccaaaattaaaagcacgtgttggtaacccccatttaacgatatggcaattatttgaaagaacataacagtacagtttgaagacgcttccccaaaaaagagaaagagagaacaacatgtggggcgaacaaaacaagtgcgtctcccgctcgagagagcagcactctcggggggccgctaggaaaaaaaggatggtcttgaaaaaaaacccctcccggatgaggaagcaaaccgccgcgccgagggtaaagacccaagggcgagcgctgggaacgaaaaacctccgagtatcccggaagagcaagaagcggcggcacaacaagagaaccttcgccgaagaggggctctccccagaaaaaaccagcgcccgggaggtaacgc

SEQ ID NO: 651409 - DNA, 109 bp, Homo sapiens
aatggacctcataactctctggaatgatgcagtgtaccaaacagtgaagaactgttgttgttttttactgatttacataactaataataatatcatagctaacatttat

SEQ ID NO: 651410 - DNA, 538 bp, Homo sapiens
  misc_feature (9)..(9): n is a, c, g, or t
  misc_feature (12)..(12): n is a, c, g, or t
  misc_feature (25)..(25): n is a, c, g, or t
gttaatccnatngctgtaaatagcntgtgtgatgtctttacggagaacaaaagagttgtgtctataatttcaactgcagcttttggaaaggtagcttttgttgctattggagcaacaatggttggcagcattacttttactagggaggaaggtgactacgttcagaagggcgaggagtttggctacttctcatttggtggaagcactgtaatttgtgtctttgagaaggacgtaatcaaactggatgacgatctcctagacaatagtatgcgttcacttgagactttggtacgggtaggaatgacactaggtgtatccaccaaaactgacggacgataaagctatcggctaccaattctttacctgcttcaggtaggggatctttattgtaaaccatgtaatgagcttgtgtgttgcatctctctctctctctttttcactcctttttatagagtaactttggatcgctctcccattaacctgttggttgatgacaatgaggatgtttatagtgatgggaaagtcattttgatcctgg

SEQ ID NO: 651411 - DNA, 1288 bp, Homo sapiens
  misc_feature (396)..(396): n is a, c, g, or t
  misc_feature (495)..(495): n is a, c, g, or t
ggggggttgtggagtggatggtttggcaatatggctggtggagccaggcgatccgcctaatgcttacttctactcgcgcagactacctttcggtgaagtcccatattcagtcggcgatcgatgtaaacgaggattcatagcaggtgcacgagcgtgcggcgaagcggctgactcgtcgcctgtgtgatcagagggaggtggccgaaacactgtgctagcatgttccaaagctggggatcattcgctcgtggtagacactaggagtacgcggagattaagacgtccgagacgatataggtgtgtgatggaagagaatttgccctatcgtccacaacgaccctctagggtgggtacgagttgctgtctgggtcaattataagtggcgcacacagatcngaaacgttgggagtagaacacaagtgtaaacacgtaatggtacacggcaggtggaaacaactactgggttcatgggccgagtctcatctccgcactggnacatactatgacaagcgctcaaggggcacatataaggcatctatcgctaaattcgcaaaaggattgcttatgctaggtgacacatcagtaatccccaagtaggagaaggtccattattcaacgtggtgagaaacgaatgggcaagcggtttcggttatgaacttcattctgtttgatgtagggcaaccccaggaaatttataacaggttcaagctttaagtgaaccaagaaggcgtagcttgacaaacagagagattacctaccccaaagggcgacattatacctttaggaaatgtaataaccacatactaggtgcttgagggcgcttgtgtggggggcaccccctggggggaataacaggggctgtttttctcaaccaatacagacctttgggctttcatattggagaaagaccggtcctgcctcccacggttttggcttttaattggcggcaacacagacaggggtgccacaaaaggacttggggaaggtttccatgactggaagtatatatcaccccgcgggtgcagaccacccaaagagtgtgttgtcagaggagtgttttcgtcaacggtattggaaagacacaccataagcagacccgttcccgagtgggcactccacacccagaaggcgctattgatggcgaaacacccttttgggtcaggcgacgtgagttgggattctggtggaggacgttcccaattgggttggggagccatttgacagagaccgagtggtgtcttcgaacgagtgcgcaggtgcggtgagatataaaaacatatgaactcga

SEQ ID NO: 651412 - DNA, 225 bp, Homo sapiens
tctgatcgccagtgaaggtaagcatttcttcatgtgtattatggctagctataacaaacccacagccaatatcatactgaatgggcaaaaactggaagcatatccctttgaaaactggcacaagacagggatgccctctctcaccactcctattcaacatagtgttggaagttctggccagggcaattaggcaggagaaggaaataaagggtattcagttaggaa

SEQ ID NO: 651413 - DNA, 454 bp, Homo sapiens
aagcttgacgcccactaaatatttgattggtttgtaggtgaggcatgagcactcctttgtagaagctccccatttccatagggtgctaaatacagcaaaatctcacttttttgttgttgttgttgtttaaatacagacgaagtcttgctctgtcacccaggctgttagtgcagtggtgcgatcacgagctcacgtgccaacctccaccgcccaggttcaagcgattctctttgcttcagccatcccaaaagtgctggtatttacaggcgtgaagccaaccatgcctgggatcttgtattttccccttttaaatccgaagatacttaggtggcaataatatttgggctgttccataattctctttgaaccaagttacttggtttatatatattcgagtggccaggagttaaccagtatctagtcacaccgtggcaatcaagctcggggtaccgag

SEQ ID NO: 651414 - DNA, 381 bp, Homo sapiens
  misc_feature (238)..(238): n is a, c, g, or t
  misc_feature (289)..(289): n is a, c, g, or t
  misc_feature (376)..(376): n is a, c, g, or t
gtgcgtttttgtaagaaagcggagatgccttcatgacgatcttctgttgccgccagcaaggtgaataactgtcgctcctgggcaagtccggcttgcaaagccacttcctgcgactggcgcaggcttgctttgccgcttgtaaggccagcggcgagtgacgtgccattttcgatgccagctgtaaggcgtattcgagggttaaatcgctggggaagacgtcgctaaccagcccggcctnctgtgcttgctgagcggtgatactttctccgctcagcaccattttgctggntaacgatttaccgacactacggataaacgttgcgttccgcctgcgccaggcatgatgccgagagtgatttccggcaacccaaaacgngcgtt

SEQ ID NO: 651415 - DNA, 553 bp, Homo sapiens
gcagacatgctctctagttgtgatcccgtgacaaagttcctaggcatatttgcgagtactcaacaccaactatcgatgggcgggggaaaatagccttgccatcactgccagttaagggtgtgggccgaagtatattgcgtcgatggtgggtggttggagggaaaggcgagagcgagtgggacctcaccaggagggcgggagaactcactgaggatgaggtggaacgtgttgatcacctattatgctgtaatccacgtccagtactagatgatcccaggactggttgctggaagagacgagaaggatgtaaaggatgggagatacagccaggtcctagccaattggtctggagccaacaagctccgtgagagacctggagcgactgatagaagattcgggcccatgagagggctgcgtcacttctggggccttacgtgtccgaggcctagctacgaccaagtaccactggccgccgtggccgcagccgtgggtgtgtccatgaatgaagtaggtctgtaggccttggtcgggttgataaatagttgatatgacc

SEQ ID NO: 651416 - DNA, 102 bp, Homo sapiens
aggacttccatctcaatggttttgaccacaatttctgtctgaagggatctaaagaaaagcatttttgtgcaagggtgcatcatgctgcaagcgggcgggtac

SEQ ID NO: 651417 - DNA, 187 bp, Homo sapiens
tgagatccgagaggcgcagcacttcacctcacagtggatacagtgtcagggtaccgtgggtaggtgtcaggatcagcatatgcatttgtagggatcatggattcaccgttcactcaccatccatgtgctcattgtgcaatgacggcgtgagactctcatggggcactacattagtcacagttccaat

SEQ ID NO: 651418 - DNA, 199 bp, Homo sapiens
cagctcggtaccgcttcgtgagactggtgatgatggaacagagtcagctctcacagagaggccggatgaaaaagccacatgatatgtaacaaaatgtatcccgtgcagttaaggtggggccaccaaaaccatcttttccataattttcatgttttcttttttctttttgtctttttagggccgcaactgcagcacatgg

SEQ ID NO: 651419 - DNA, 615 bp, Homo sapiens
  misc_feature (81)..(81): n is a, c, g, or t
cttctttctttccttcccgacccttttcgttctcttaaaaacacatcgcccctccagcatccaaccactcactcccccccncccccccttcctgggggggccgaaaactttgacattcccccttgccccccccccccaaacccccactttgtgaggacaaaaacccccgccctatagggaaataacctcctcccccccccagggggttctccgaaaaaaaaaaaaaaaagcccccccctccgagggcgggcccccaccaccgcccgccccctcctggaaaaaggcggccctcccatcggggggcccttttttttttcggggcccgcttgaaaaaacctccccgggggtttccctagagacccccccaattttccccggggcggccccccccaattcccccccccgtcgcgtgctcccccccccccccccgcaaccccgcgctccggtgcttcccttgggcccccccaatggggcggacactaaacaccccccccccgcggggaaagtctttgtcccacctcgccctccaataaggcgtgaataaataataacccccggcgccctctctgtacttccccaacacagttgggcccccccctccttttattgtggacc

SEQ ID NO: 651420 - DNA, 335 bp, Homo sapiens
ggttaaatttccaagggattctaaaaggtctctgtgcccaaattaaaagtttacctagatctctatcttgcacacacagctgctacataccggggtgagctcttttagctgttctataggtagctcgtctggttccggggttcttagctttggctctccttgcaaagttttttcgagtttaatccattatccagaaggtaatagggggttagcccgggttatttacgcttggcataatttcctcttccctcgggcctatatctattgcccgaggtctcaatttctatcgcctatcctttatacgggtatatggtttgtataaggctgtgtgacag

SEQ ID NO: 651421 - DNA, 454 bp, Homo sapiens
  misc_feature (448)..(448): n is a, c, g, or t
tacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattnataaaa

SEQ ID NO: 651422 - DNA, 115 bp, Homo sapiens
cgccttatacaaatgagtgggcatacacagtctgaatatgaaaataagatttcctctgaaaacacactttttggcacagattaaacaaaacgtatgtcgggggctgttggaatga

SEQ ID NO: 651423 - DNA, 494 bp, Homo sapiens
ggtagcgcctgcacgtcgcgcgcggtgttcgattgtcgctgcctggggaggaggagccgtgtggggcgccgccgccgccgccgccgcgggcttcgttcgtaaggaagggggcctaggcccgggcctgcggtggtgggggttgctgcgcgccggggggtcgctcctgctgtgtctttcctgctccatgcttcgcccaactttccccttggcaggggggggtggggcgcgaaaacgcggagcaggggacgagggtccgttgcagagatggaagagggcaaaagaagcgtgggctggttgtaaggagtagatatccttgaccggaatacgagcccagatcggatgcgtatgtatcgagcgagtcagtgagaagtactcttggaagctccatcatcctgaaaattattagaggccatcctggaagactgagaagagaagaactgcattactcgcaaaagccgagcagagagaagtcttcagggaatgagcacgaggtc

SEQ ID NO: 651424 - DNA, 158 bp, Homo sapiens
aagctgctgtgggtcttgcagaataaacagcctgtggttgatcctatctcaaccccaggctgggagctcgtcagagtgccacctggagctgtggaggtggcaatcagtgccaaccgactcagtatctacaggacagagtggtgctcgggatgacagga

SEQ ID NO: 651425 - DNA, 669 bp, Homo sapiens
ggagagagagagagagagagagagagagagagagagagatggctagaggcaggaatatgtccaagccccgcgcggtggaggcggcggcggcggcggcggcggtggcagagacggccccgggcccggagatggtggagcggaggggccgcgggggagggccccgcacgagagggggagaactgtatttacgcggggcatgatcaagatatctattctctactaggtgacgcccgaacaatagtgctctggatagtgctggttctcccctctttcagggaagaagaatctcatgattactaactatcacgaatgtcaatagtgccagggggaaaccattagccggatatctacagggaaagcgagaagagaaaagaatagtgctgggaacgcagtagcgggagcgccatgaatgtccgaggaacagaagatcaagagacgccagggaagagggtcccctgtgtatcttttccaaaccaaatatctgaagcagcagaatctccaaaaatctccatccctctctatcgtttgtgtatttcccaccaaagtgcagaccagtcggccagagcagacgcctctgaaaagagccctatcaggggcaaacagggccccccgaaaaaaacgctcggggaaaaagcgcaacagattcgcaaatcttacggatttcttccg

SEQ ID NO: 651426 - DNA, 401 bp, Homo sapiens
attccagggccaaaggaccggaggtttgcataccccccccctggatttgatttgcttccctttggtttcttgggttttggttttgctcgattttgtcctttcccccccgtttagttttgtccccattaccccaatagttttccaaatcctcccccttttaaaatggggtccccctgaaaaaccaacccccgggtttgccccccccccaaatcttgcccccgttttttatattttaaaggctttttgccccaccccgcccccatgttcacctttgggtcctttcccctataatttgagggggggtttccccttggccccccgtgttcccaattcccagggctattttccttattattgtaacggaaaaatctgtggcctagaataaaagggtttttcgaata

SEQ ID NO: 651427 - DNA, 108 bp, Homo sapiens
ccctggttacacagaggatgctatttattgggctcatttatgggctattctcctctgagctgtccagtgctgtccaccccctgtcttcctctgtgcgtgtccctgtga

SEQ ID NO: 651428 - DNA, 272 bp, Homo sapiens
aaaatggggggggggggggggacccccccccggtggggggggcccccccaacccaaagggggggcccccccggtttttagggggggcccccccttttgggggggggggaaaaataaaaaccccccccccgggggtccgggggggttggggggccccccaaaatggggttttcccaattttaaaaccccccgggttttccccccctttttttttgggggggtttcgggggggggcccccgggtttttgaaaaattaaaaacccccgtttttta

SEQ ID NO: 651429 - DNA, 152 bp, Homo sapiens
tctcctcctcctgggcaattctcctcctcctgtgcactgtgtctactgctgggtggagggggtcgggcgagcaggtattgtgcggcagccccatgatgtgggctcccctgccctctcttcacctagcagtagacacagtgcacaggagcgag

SEQ ID NO: 651430 - DNA, 436 bp, Homo sapiens
ctccatctcatcatgccacttagtatggcagtcgtccaggtaggtctgcacttcgactgtcacctccttcagttcctggctcatcgcatgccacaggccataggtctccagctacaggttatcccaggactcatgggtcacaagcccgagctgctcgtgcagcttcagtaaggtgatggtcacacagtggcagtagtcgagtagccttaggcctagatgttatggccaggcagagctttcaatctcaggcacatagtatctgcatatgtccttcagcacatgcctgtactcagaggactggtcgtttcactatgatcctaagggcatctgagcgtggttcgtcattgatgccagaaatgctgagcaatggctccccgtcagttaagagtcgcgcctcggtcagcacagcagctttcatcgtgaaggtccgtgtggg

SEQ ID NO: 651431 - DNA, 591 bp, Homo sapiens
ttggcgtggggtgtgatggaggggcaccttcagtctgcgggggcccctcagagtcggactgggaatggagctgactcgctgactgcggtgggaggggtaacatcacactgtcggacctgtagcattcctcctggaggcggtggggctccccctgattgagtgaggggctttccagattcttcagtgggtacttcactggcaaaccactcaagaggctagggattactgaacgagggtgaaagctctgtcttggggtgcttgtatacacaagaggacacgaggcataaatcgacatcctgacgggcttctgagggggacttcttttctgcagtgtagcataggtctgaagtctcgtaggcatatgtggatgcctgaggggttctagtgattttctctgcagtctcgtaacagtatgtggaagtctcaggggttcgtgttgtctttgtagatgtctcataggactaaccttcagactcagggaaactggtcatattctcagtggtttcataagagtagctggggtccccaagtgtgtgggcaccatcctcagagtcatcatagccattggtgatgtcatcccgcagcctttag

SEQ ID NO: 651432 - DNA, 218 bp, Homo sapiens
gcacgagctcgatacgtgttttgcatttatggtagcatcagtgactacaagctacttttgaagaaacacattgatattgaagataaaatccacatcgtacgatcggtttttattctacctggattaacggtaaagagtgcagaactttatggcgcttcccgtgtcattatatatacagacccatttgacgatggtaaagttcctgaggaaaatgggtt

SEQ ID NO: 651433 - DNA, 262 bp, Homo sapiens
  misc_feature (61)..(61): n is a, c, g, or t
  misc_feature (64)..(64): n is a, c, g, or t
  misc_feature (68)..(68): n is a, c, g, or t
  misc_feature (86)..(86): n is a, c, g, or t
  misc_feature (91)..(91): n is a, c, g, or t
  misc_feature (93)..(94): n is a, c, g, or t
  misc_feature (137)..(139): n is a, c, g, or t
tcttcccacaacactttctcggcctatccggaatgccccgacgtaaaaaaaaaaaaaaaanaanacanacaccacatgaaaacatnaaatnanntgtaggctcattcatttctctaacagcagtaatattaataatnnncatgatttgagaagccttcgcttcgaagcgaaaagtcctaatagtagaagaaccctccataaacctggagtgactatatggatgcccccaccctaccacacattcgagaacccgtatacataa

SEQ ID NO: 651434 - DNA, 515 bp, Homo sapiens
ttcctccagcattcccgatggagtctatgcagtcaacggcctcgttgaacatctagctcatgtctgcctagtggttgtcctccacagggatgctcttgtactggtagtgaccctcaaaatggttgggacaattggctgagacgttgatcaaggcagtcatgcacaaggcatccagcatgtccttgcgggaagcgtgatacgcactgcccaggtacagaaactgcaggatttccaccgggccaccctgatagtagagtgggcgtatgcaggatctgcacccagattccgcgctgtcagggacgctagtactcaggggaaggatgagccccatgggggtcgactgtttgttgcacagctccgggcaggaagctgaaaacgcttcgtatcctcctttgaggaagaagacttgcgcggcgcgcgcctcgcggcagagcgcgccggccgtcagggccagggtgccgtcgcgcttggccccctccagggcggcgctgcgctcgtactgattcaccacggcg

SEQ ID NO: 651435 - DNA, 422 bp, Homo sapiens
acaagtaaggcatgatgccaagggaagggggagaatggaaaggaaggtaggagggaggggcagaggggaaataaggcaaggtaggggaggaaagaggggaagggaagggactggaggaaggaatgagggtggggaagaaggaagggaggagaggaaagaatggaatggaaggagggaggaaggaagggaaagaaggagggaaggggtgggtgggaaggaaaggaagtaaggaaggaggggacagtagagaaatgagtggaggaaggaaaggagataggggaggaaaagtgggaagggttagggaggagaggaaagagtggaagggtagagaaggatggaaggaaggagggagggaagggagtaaagaaggaaatgaagaagaagggaaggaaagggtcgacgcggccgcgaatttagtagta

SEQ ID NO: 651436 - DNA, 122 bp, Homo sapiens
  misc_feature (80)..(80): n is a, c, g, or t
agaacaattcttttatttgaaaactgctggcatgaatttcctccttccctcaattaggccaaaaactcaacacgcctccngcacagtttctacaggaggaagccccagcttgtgggggctag

SEQ ID NO: 651437 - DNA, 168 bp, Homo sapiens
taccgttatgccgtgggaaaatggagcagatctaatctttagcaccctcatggctcaaggactcatctggcagcgggctcatgtttttcagccaagtagcttccagcttacagcagccctcaaatttggatatataggtatggtctgagctatgatatcaattggctt

SEQ ID NO: 651438 - DNA, 157 bp, Homo sapiens
gatgttctcagctccgagtcagacgaccccgttcccccacgatgctgtccagctgcctcctgagtgttgttgatgatcttgctcgatacaactggctccagtgttctgcctctactagtcttgtgtgccctgctcctgcagcagtggacccactcgt

SEQ ID NO: 651439 - DNA, 120 bp, Homo sapiens
gcatggctcgtggtcccaaggaaggcatcttaaggcgggttggcaacttccaagcatttggattgcttggataaaatatacccccttttttttcttcctggtccattcaaccggttccca

SEQ ID NO: 651440 - DNA, 399 bp, Homo sapiens
attgttgtcatagtactctctaatgatcctttattgtcacaatggacacatagaaatataaaggatcattagagagtactatgaacaacaatataccaataaatttgaaaatttaaaggaaatgaataaattcctggacacatacaacctataaagattgaacccagaaggaaaagaaaacacaaatagaccaattacaagtcatgagagagaatcagtagtaaaaggtctttcaacaacaaaaaaatccaaaaccagacggctttactgctgaattctaccaaacctttaaagaagaattaataccaattctttccaaactatcccagaaaataaaagaggagggaattcttcctaattcattctacaaggccagcagaaccctgataccaaaactag

SEQ ID NO: 651441 - DNA, 802 bp, Homo sapiens
ggcattcggtcgctcctctcacgcggctgcttatcgggaaggaaattgttgccaaataaagactgacacagaaaaccaaaaaaaaaaaaaaaaaaaaaaaaaaatttgtgggcggtgggccgagaaaggttttcaagaaccttcctgggtggggcggcggcggcccaagtgtggtgtttactttggacacttgggcataagaggtggtcccaaggagagaatcgtggcaagggattatgcggtctggtttctctccacaaataaaaaaagggcgccggggggaagacccgcggcttctcagagcacaattcccaagagggggtcccggaggggccatccgggttcttatacaacggcgctccagggagaggtcaggtatattacaaattccgcccgcgcgcgtgggaaaaatacaaaagacatgagcagagacgagaaggaaagcagctgagcgagcagagaggagaggcaacagaaaaccagaccagagagaacaacagaagagcaagagcagcagagaccgaagaagcgacggagctgggagatcagtacaagcagagaggatacacaggagaacgaaagggagggcacaaaagacgagacaaacacaaaaaacagggcaaaaagacacagaaaggaagcaacaacaacaactgcaaaacaccggaacaagagacaagcaagcgcaaacaaaccacaggaaaaatgggaaaaccagaaaaaaaggaaccaacagcagagacgcagaccacaaaggcaagagaacacaaaaccacgccacgacaaagagaaaacagaacag

SEQ ID NO: 651442 - DNA, 101 bp, Homo sapiens
caccattggtgaacattgccgtctctatctatcaatacaaataattagctcgagtacatgtgctgtctatggatgccttgtatactcacataggctcatcc

SEQ ID NO: 651443 - DNA, 426 bp, Homo sapiens
aacatgttgggcctcatgcacgggacctgcccggagacttcaggcggccttttgatctgtttaccacgtgagcaagcagctcggttttgtgcaaagataaagtcccccaaatatggtgaaggcccccaagcatggattattgggattgtagaaaagggcacccgcccagccagaatcatagacaaaccccggatcattgaggtcgccccccaagtggcccctcaaaatgtgaatcccccccccggggcccccttttaatttaaacaaaaaaaactgtttggttttgtttttaaatagatctatttcccttatcccttcaattaaagactataaacaccaaaaatttcattgtgtttacacatcggggtgaccttaggtcggtttgtaagtggatacaattaataaaataaaatcccttgcctttta

SEQ ID NO: 651444 - DNA, 175 bp, Homo sapiens
  misc_feature (3)..(3): n is a, c, g, or t
tangatgacttcgagcgcatcctgcaagaaccgcacgcgtcgctgaccgagcagtaccagccaccgctcaagaccgaaggcctgaacatcgcgttccaggctgacggcatcaagcgcctggccgagattgcctaccaggtcaacgagaagaccgagaacatcggtggcgccatca

SEQ ID NO: 651445 - DNA, 432 bp, Homo sapiens
  misc_feature (2)..(2): n is a, c, g, or t
  misc_feature (11)..(11): n is a, c, g, or t
cnattttgaantgttcccctttgcctgtgcaaaaaggttttcaaacttgaatgtgatccccatttgtcccattttttgcctttggttgcctgtgcttgtggggtattatcgcctcaagaattttttttgtcaccgggtgcggtggctcatgcctgtaatcctagagctttgagaagctgaggcgggtggatcacttgaggtaaggatttcgaggccacccttaccaaagtggtgaaaccccgtctctgctgggaacacaaaaattagccaggcatggtggcgtacacctgtagtcccagctattggggaggctgagacaggggaattgctttgacccaggaggcggaggttgcagtgagctgagatcatgcgattgcactccagcctgggtgacagagaacgactctgttcccccgccccaccaaaaaaaaa

SEQ ID NO: 651446 - DNA, 121 bp, Homo sapiens
ggggggggggggggggggggggggggcaccccccctcccacccccccccccccccggggggggggggggaaactttggtttttggggggttttttttttggaaaaaaaagggtttccccca

SEQ ID NO: 651447 - DNA, 1566 bp, Homo sapiens
  misc_feature (329)..(329): n is a, c, g, or t
tctgtatattatccagctgctcaaatcgctactgaagctcctgtgatcctgttcgagtgtcctgatgatcattgatagtatcgtgatgcgtcaatccctctaagaatcaatagtgtcctagtgcctaatgaatagacgcaacactcttcatagagcatcaagcacgaagattcacttatgcataaccctctgttgatctatgtaactcgttacgaggtttgccagtcgacggtccaaaacaaaggtgacatttacacatgcccatagtccaagctcctaacgttcgaatgtgtactctgagtagtacaacacaggctcccagcatcgcncatcatgacacgcacttgtccacatttcgcatttgtagcaaaaagtccacgcgcatgggtactgctcgcacacccagttgtacatcgtatccattctgtaaagtttcctatacatagtgtgacctacacaaaagttgggagcagatagatgttttcccatcccatgtgtctggcgtgtccacaaacatccaattgaacatttgcttgacatcattgttcacgagtcacagtggggtcgggttcaccacatttttggctaggaccattgcgtttggtgttccaccgccaaaccattgtacactttcacatatcttcgagggcaccggattgccctaggccgaaaggtcatccgattataaaaggcagaccccatagacaatgccttaatgccaacattggaccaagactttctaatggattgcaaagagactacctggttaagtaaaaacaacaaggccgtttgtaccacatggggaattggagtggctttcggcagaggaattcctagtgggcatgtaacggaaaagaccaaaggggttatttaggagggagtttacctgggtgaaattattgagcaggacaataaaaggagagtcgtgtgaggacttaatttgttccaacacaatgggtccacttgaaatacatgataggtgcacgtgtggaatttgtatgacatacaaagtgtgtcagcacggattactttttgtagtctctttggcagatttaattgattgaaacagttttctgaaggtgcaatgcgttatcagttgtgacgtgaagcacttggacgttgtaataaggttatcttgggtttgagagagagtttaagtaaggaggttaatacggtgacactcttctgatgtgcaagggcgtatttacattatgtcgcttgaaaattgtcctcgtgggcaatggtgtgcacttgaacagtaacatgacagactatatccttgcacgtgcaagtagggtttagtgaccgatgggacaggaaaagctggacataaagcaccatagtttggcacacacagaacacatcaaaagcgaatatactcagtgggccgccccagcccactaaatctagggctagaacatcttccgcgagacccgggccacaaacacgtgggagcaacaatcgggcacgtagtgactcaactagtgtgcaccagtgtcgccctggagcagagagaggagaagggtgtcgcacgcgacagaggagtgacccagtacattgacgtga

SEQ ID NO: 651448 - DNA, 153 bp, Homo sapiens
cccctatcgtactatagcagaagaaagaaaatacccaagattgtcattacttcattcacatttggcccagaaaataggtgcgcaaaaacacaacttatccacttgaaaaacctcattgcgtttaaacaaagccaacagaaactaaaatgagcc

SEQ ID NO: 651449 - DNA, 196 bp, Homo sapiens
gtccaaggcgagggcagcagacgtcagctgcagagtaaggctgacgccagccaccaatcccaaccccacctccaggctaatgcatgctacttgcacgtgctaaggcctaggaccaacctgcaggctgcaacatggagagtgttgagccctgtcacttcttacagcttatagttagtcctctagcgtctcgcgggac

SEQ ID NO: 651450 - DNA, 414 bp, Homo sapiens
  misc_feature (370)..(370): n is a, c, g, or t
cagattacccgcgtgagccaccgcgcccggctgcaaataagggtttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgctcggcggcgaaacacgatattggactaacatcttaattntgttataaaatctcacaaaccctctgacatagtctcagagatct

SEQ ID NO: 651451 - DNA, 582 bp, Homo sapiens
gtgtgtgcgcctaatctcaggtggtccacccgagacgcccttgagcgaccaaccctagtcccctcgcgctggccccttattcgctcctgacaagatgacaagacactaatcatgaaccaggaaaaacgtcgaccagacgtgcaggcacaagtgcgcattggtgggaaaggaactgctcgcagagaagaagacaggttggttcagtagcagacagccacagcagatgacgaagaacttcagttctccttagagacgtcaggggtaaacaattcatctctggctatggaagaggtgagatatgttatgcaaaaccaaggaacagtgatccacgtttaacgaaccgctaaaagttcgaggcgatcatcttggcgagctgaacgactttgtcaaccacttacagtgccgtgctggagacgaacgcagcatgagcagaagatggctaccccaggcatcttacaagacccgaggcgatgggtggcggagtacgatcactgagctgaggtcaggacgggagcacggtgtgccccgacagggctccattggcaccccaaaaaaaaacacacttccttggtgggacattgg

SEQ ID NO: 651452 - DNA, 414 bp, Homo sapiens
  misc_feature (279)..(279): n is a, c, g, or t
ggttgaagttaaccttcttattctgaggtagggaagaaaatgaggatgttctgccttttgctagactgaatactgtcctccaaaaattcacattcaccaggaatcccagaatgtgaccttattagaaaataggggcagggcatggtggctcatgcttgtaatcttagcactttgggaggctgaggcaggaggatcacttgaggtcaggagctcaagaccagcctggctagcatggcaaaaccctgtctctactaaaaacagaaaaattagctaggcatngtgcatgcacctgtaatcccagctacttcggaggctgaggctgaagaatcacttgaacccaggaggcagagttgcagcgagctgagattgcgtcactgaactccagcctgggcgacagagcgagactctgtctca

SEQ ID NO: 651453 - DNA, 371 bp, Homo sapiens
ccgtaagcacactgcaacactagtcctgtcttgaagaaggcaagtaggtttgtaataggcagacgttcattttaagaacaacctgactggccaggtgcagtggctcatgcctgataatcccagacactttgggaggctgtggcgggcaagtcacctgaggtcaggagttcaagaccagtctggccaacatggtgaaaccccgtctctactaaaaatacaaaaactagctaggcgtggtggcgggtacctgtaatctcagctactcaggaggctgagtcaggaaattccttgaacccaggaggcagaggttagcagtgagccgagatcgcgccactgtactccagcctgggcgactgagcaacacttgtctc

SEQ ID NO: 651454 - DNA, 148 bp, Homo sapiens
  misc_feature (76)..(77): n is a, c, g, or t
atcagggataaaatggagatttaaaccacaggtcttgttcacactttaaggtacatttttaggttattttattttnncacaatgattttttttggttggatttaatttgtgcctcctaaggacattctttgtggtggatactatactt

SEQ ID NO: 651455 - DNA, 121 bp, Homo sapiens
ggtcggtactgtggtactgctggaggtgaagaggtaggtctcagtgactcttcctggacttctaaccagcatggtgcggactttgtcagcctcggggaaaaggtgcacactttcccattca

SEQ ID NO: 651456 - DNA, 520 bp, Homo sapiens
tattcattggaagctcggtctccggctccaaggctgctgtcttgtgacaattctgtggaagactggatcacagaggagtgcagtgtccagccagctgactgtcctccacctcccaggtgcacaaggagtacagcaagtgcctgcgtcactcctactgctgcatccgatccccaaccgggggcactcacggatacctcaagaactcagccatgcgaagcaacacccgctattatacaggcacccaggtatcgggccagacaggactccctggggctgagtgtcggaacctggagcctgagaggtggggagtggcttggcctaggtttctgatcgtgatgatcaggtgagcagtctcagaaagacgccagagggtgggtggcccaaggataccctcacatatgggtagtgtacccagagccgaattcgcaggatgtggaatgacactgtgaggaaacagacggactcctccttcatgccgggtgacatcacccggcacccaagcctgacacgcagtgacacg

SEQ ID NO: 651457 - DNA, 522 bp, Homo sapiens
tattagattgcgggcgtcttctgcgtgcgcctgtaaagagtacgcgaatgtacatgtctcagagccattgtagagtgtgagttaacaaatggtactatgtgcgtgcgtcactggaagcagatgatcgtgtggtgacttgggtgtgaataacgcgatgtaacataagtaataataggaatcagtatactggaggtaataattggagtaagaatattggaggtaaattacaaggaaagtgttcatgctttcataggataggcaacacacgcctgcccgaccgtaacgagacaccccagaactacactgtcagtgtaacagtcgatcttcggtggactcaactccttcaaggtccaacagtacgaacaccttcccatatcttcatgcaagtgcaattcctgcacttgcaatcgaacacccccatgcaaaagtctctcccaccgagtggccagccacaaggcatcctatattcagtccaaacgcgcaacataaccttcgttgacataaattaattaaatcccgtag

SEQ ID NO: 651458 - DNA, 428 bp, Homo sapiens
ttttttagggctgaataatagtccattgtatttatgtaccacattttgtttaactgtttatctgtcagtggacatttgggttgtttccaccttttggctgttgtgaataatgttgccatcaacacagggatacaaatatctgtttgggtccccactttcactttcacttcttctgggtatataccaagaattggaattgctaaatcagatggtaattctttgatttttgagggactgtcatttgatttgattttgattttttaagggactgccatactattttccacagcaactgtaccattttactttccaactagtgttgcacaagagttccgatttctccacatcctcaccaacgtttgtgttctcgtttcatttgtttgttttgacaataactatcctaatgggtgtgaatggtatctcattgt

SEQ ID NO: 651459 - DNA, 902 bp, Homo sapiens
  misc_feature (414)..(414): n is a, c, g, or t
  misc_feature (799)..(799): n is a, c, g, or t
gacggcccgttttccgccagctcgccgtcgctaatggcgtcgctcaccgtgaaggcctaccttctggcaaggagtgacgcggcgcgcggagattcggccggcttcagctttcgtgttgcaagcccccggagccttgaggcggaaggcgaggggttggcgggagcgtctccggggccccttggcggagcggggttggttggaccccgggtgttggcccgcccttggttcccccggggcttgcgccctggggggggcttcccagggcgggacaactataaccgggggcgaaattggagggcgacggggggaaacctttgggggtttgtgcccttttttccccaggtgtggaccccggaaggccaatttgtggaccacattgtggccccatgtgctcacataacggggtagaagagnggacattgcacacaattttcttgagccggcggagaatttccttaacctattttataagcgggccgtcccggcaacacctcatagtacatcatcatatagtcgagcaagcaaacaacgagctgttttgtgtggccgcaggcgcgacacccgccggcacacttatgcggggcacccccccggttagtgacaagacaaagcaagcggtgtttttgcatcctatagaagacgcacacacctgatcgtcgcgcggtagatgatgggagcacgcaacgccggcgacgggtgcgacgcaccccaccgaagtgataacaggggcggcatgcacgactggtgagcaaacacatcggtgtgtggggacgacaacaaacgagccggcggtgttgtngactccccaccgaagagagaggggaacacaactccgccgggagggcacgccagcgagagagccaacgagacggggcgagggccgcgaggggacacattcccaa

SEQ ID NO: 651460 - DNA, 265 bp, Homo sapiens
  misc_feature (198)..(198): n is a, c, g, or t
  misc_feature (217)..(217): n is a, c, g, or t
  misc_feature (249)..(249): n is a, c, g, or t
gtgactagaggatccagctatcaagatctgactgcggggtccaccggccgcgcctaggttcaaggctcacgagcggcctctatagtcgcgcgtacgtccgggcgtatctctcggagtgtactccttatactgagtgtgacagctcagctcttgtcgcccggtgtgtggagagctgcacatcacgaggtgtgtgcccangaccggagagacggtccangcctctgatggctcggagatgatggaccgtgnaagggaagcgtctgtg

SEQ ID NO: 651461 - DNA, 239 bp, Homo sapiens
cttacatgtaccggggggagcctgggacattgtggtgcacgtctgtaatcccagcactttgggaggccgaggtgggcggatcacctgaggccaggagttggagaccagcctgagtagcgtggtgaaaccccatctctactaaaaatacaaaggtcagccaggtgtgatggtgggtgcctgtaatcccagatactcgagaggctgaggcaggagaatcacttgaacccggtacatgcaag

SEQ ID NO: 651462 - DNA, 254 bp, Homo sapiens
acgacactgtactccagacctgtgcaacagagcaagactctgtctcaaaaaaaataagaaagaaaataaggcagaatcgtatagaggaatcctgggaaattcggtgaattcagtgattgtgggcaaggaaattgtgatactaggcttgtgcaataaaaaaatggtgaatattgatcacattgggtaagttagggaagagagaagctaaattaggcaagatttagaaaagcacagatagtacagtgatcgaccaa

SEQ ID NO: 651463 - DNA, 314 bp, Homo sapiens
  misc_feature (54)..(54): n is a, c, g, or t
cgttatcttgaatatagatatgagtgttcagactcagactccatgtatatagtnaatatacaggtagcaggtacactgattggagatattatggggggagaacttacatgtgaaacttctgtacatcaattattatcgctgttgttattctacaagggtctagggagagaccctagtctgactgtagctgcagaacgtatcggtccttctcgctcttcagcgggagaaaacactagtaagttgctaaacgagtcaatcccctcattaaggacaactgaccgaggagggcgtgactcacccaagcatatataact

SEQ ID NO: 651464 - DNA, 264 bp, Homo sapiens
gtctcgcttgctcaagagcatgggtataggtatgagtcacgcacctcagttgttcatttaaatgggtgaatttatgatgtgtgaatatattcttctctcttttgagatggagtttcactcttgtcgcctaggctggagtacagtggtgcgatctcggctcactgcaacctctgcctcgtgggtcaagctgaggtggaggatcgcttcagccctgaggtgaggctgcaatggatggtgatcaagcactcactccagcgtaggtga

SEQ ID NO: 651465 - DNA, 210 bp, Homo sapiens
  misc_feature (63)..(63): n is a, c, g, or t
gggatacactgacagtaatgtgaagcgccacacttgcagatttcaggcccagcaggtcctggncaagtgccattccacccggaacttttaacccaagcggtggggaaggaaagccaaaactccaagctggcacttttttggggttctgggccatgacacttcttaggccttctgctgctgaacttttacagggacaaaaggtaccccacg

SEQ ID NO: 651466 - DNA, 260 bp, Homo sapiens
cactccaggttatcagacgcggacccatggtggccatacaaaggccttgtttatagggggacatgagtaacagtgcatacattaattctccaaactgtgtttgcgaggagaacagaataacaatacatgcgtgaattctccaaactgtgtttaccaggggaacagagtaacaatacatacatgaattctccaatactgtgtttgtcgagggggacagagtaacaatacataacttgaattctccaaactgtgtttataca

SEQ ID NO: 651467 - DNA, 803 bp, Homo sapiens
cttcggaactgacgagactcaaccataatagaaagaatggcagaactattaaccaccattcttcagctgtgctgtgattttcagaggggaatactaacgaaatggttttccattactcggtaacccaaaggtaaagacactcaaggcaagcagtatcattttctggcagagcatatgcatgaaaataggcaagattccctggtctattatccattctgctcaacttatcatgtactccctcttcttggtccagcatgctcactccttgctcagactcagatttatctgctgacttggacccatctgtggcccatacctggcacatggtgggtgaagacgctgaatctgccctgttcacctgttcccgaaccatgagtgcagagaacatggagctgaggtgggtgagttccagcctaaggcaggtggtgaacgtgtatgcagatggaaaggaagtgtaagacaggcagagtgcaccgtcatcgagggagaacttcgattctgcgggatggcatcactgcagggaaggctgctctccgaatacacaacgtcacagcctctgacagtggaaagtacttgtgtcatttccaagtatggtgactatctacgaaaaagccctggtggagctgaatcgttgccgcatcgcggttcttgatctctcacatccgatgtgacggcttatgagactggctggatcatctggactgcgctcccttgtggtatcccaacccataagtggccgaacaaggaaaaatccgttagaacctgtgttcactttagcctttttaacattgaactagacttag

SEQ ID NO: 651468 - DNA, 885 bp, Homo sapiens
ggccgggcgcggtggctcacgcctgtaatcccagctctcagggaggctaagaggcggggaggatcagccttgagcccaggagttcgagacctggcctgggcaaatatttagcgagaccccgttctcccagacaaaaggcaaacacaaaaacaacacaagaagcacaaaaaaaacacaaaaaaaaaaaaaaaaaaaaaaaacaaattggcggggcgcgcgggctctcgggcgcccctcgagaaaaaaacgtttctaaaacacacaccactttcgcggtgggggcgcgccgggggcgcccccagagaacgcggacagagctgtgagacactgtggggtgccagatcagcgatgtggtcccccaacaaggagagaacactctggggcgcaaatcgaacacgaaagggggggcgggggagttctctcctcaccccaatatttaaaaaaaagcgcgcccgggggggcgggccaccgagagaggggctgtccttaggaaaccaaaacccccccaacagaaggggagagtctcccgcggagagggcggccacacaagggggggcgatctctatactccacacaagagcgagagcgcgcccaaaaacgggaagcgcgcccgagaagcttattcaacaatttaaaggcgcccccggtccggggtggagtcccaacaggaccactagcaggcgcgtgactctacaacagacgaacctaaccgaacaataaacgcagcatgaaagcaaacacaacaacaagataaagaacacacgagcagagaaaaaaacacacaaacaacgaccaccaacacaccaaagcagacgcacaccacaacaaaacaacaacccacaaccaacaccaccaacacaacccccacacacgcaaacacacgac

SEQ ID NO: 651469 - DNA, 614 bp, Homo sapiens
gcttacatttaacttccccttgatcattcagcagccgttatcttgacagcctaccaaacagtggtatatatagtgctggaagtacagattaattatagttttagatgctatgatatgatgtattggagttttctttaacctggtttctaatatgactaacccaatcattttgtgggccattatgcaggaatatacaacttctttgggaaaatacataaatcacaattttaaaatagaaggtactgggttcttacttatgatgacttacatgattaaaatgattggcgggtggatcttgtgattcaagaaatttaagtaatgggtaaataatttcccacaaaaggggaaaccatactatactctgcttttcctctagcacaatagggtttctcctaagctttttactgggtcctaatctaaccaatctttaatattgggaatggccacagggtaagtctttgaacctcttaataaatattattaattcctttatggactcattcaggcttagggttttaaaattttttttttataaaaaaatcccccaattatatattaggttttactttacccctggtttaaattttactttaacaagccccaaaataaatttt

SEQ ID NO: 651470 - DNA, 485 bp, Homo sapiens
  misc_feature (153)..(153): n is a, c, g, or t
  misc_feature (189)..(189): n is a, c, g, or t
  misc_feature (191)..(191): n is a, c, g, or t
  misc_feature (280)..(280): n is a, c, g, or t
accttacatctcagctcgtaccctcgctgttatccttattattgtatcttatataagtgaaagatggaatattcgtaaatatccattgaatggttccatcctgccatcgcgatactgaacatctggtccagagcttcacgaaaattacaaatntttttcatctctatgcctctgttcaacttttcatcncntcaaccactgttttcacaccaagaccaccataacagccttagcattatgcatttgcaacttgcgtacctccctgatgtttcccgtcccntctctccctttacagaagcaattacttgggccaggcacagtggctcacctattaatttatttattttgagacagagtctcactccatcacccgggctggagcgcaatagtgtgatctcgacttattgcaacctctgcctcccaaagtgctgggatcacactactacagccggctgaatatctttatatctaggtccctgtaaagc

SEQ ID NO: 651471 - DNA, 743 bp, Homo sapiens
caaaaacaagaagaacccagtgtatatcggacaggtacctcactacccctgctgtggtagctcaactgccctcacaggtggacagcccacacagtacgtcagccacccggacaagtactgcttctactgccgggcgctgctgatgacctgtggctgggctgaagctgctgcgctcagccttactgctgccccccacagcagtacctgacgtatggccttcacctgtcctgctctatccacattatgactaccctgctgcctctcccagtggctttctagcttgactacttcctacatgtccctgcttatgcagcaagctgtgtggacttgctgtacaagctgcgttatctgttgcttgacctacatctgctgccctgtgcatgatcacctggggctcggctttccacgcttttgcccagcctgttttgcctgtgccacactcggccatgctgttcgtccagtgccctgctctcgttggctcttctccactgcctctcaacccactgctagtgcagtgccgtcttcatcatgtcctacgctcgttccctcgagttctgggagcgcgactactacactacactgtgttggctcacttccagcacccgcctggtcaccagctggacgtgacccctggcgctgatgaccaacaacctcaactccatcttctatgagcacttgacccgtacgctgcgcacacaactgtgtggggacctggtgctggccgctgggcacttatggcctga

SEQ ID NO: 651472 - DNA, 467 bp, Homo sapiens
ccgattgatggcggctgcaggcagcgactcctctgagctgagatttgaggccgtccccgactccttcctcccccttccctaccccactatgttgtgtaaatcgagcttgcccacttgcaccacgatcacattaaaagactacagtatagctgaactactgagagacgaaggaatgacgtgtgtacagcggtaagcagttcggaagcatatcataccggaattacacgtaagatccggacgccccatgaacaataaaaacaacaaacaaaataaaccacaacaagctaacaatggacaaaacacacaaagaacaaaataaaaaacagagaggaacaaagaaacaacaagaagcaagaaaaaaaaaacaacacaagaacacaaaacaatatagaaacatactaaaaaagagagagaaagacaaaaacacaacaacaaaacaaccaaaaaaagatcacgacaaacaccaa

SEQ ID NO: 651473 - DNA, 188 bp, Homo sapiens
tctagaggatccctgtgcaaagcacacccagttattacaactttaaaagataaatcgattggtgcaggtctgtaatcccagctactcgggaggctgtgagaaacgctgtgaggtggaggtggaggttgcagtgagccgagatcgtgccactgcactccagcctgggcaacagagtgagactctgtctc

SEQ ID NO: 651474 - DNA, 448 bp, Homo sapiens
gcaattccacgcatggggcagcatgcggcccagacagcgtgtcttagcaggatgaccggattagcgctcagaccatgcgatctggacagatgcctgcccgcctcagaggtaccatgcggcacacctgggtcactgccacagtttgcgcaccctgggtgcggggtgcggagaataggccagcatggcaccttcacttggcaagcctccactctctgcccagtgcccagctgggctcttcctacgcattcgcctccttctcttctagaagggcccggcctggctcttctctccgactcccgacccccgggtagtcctagagtccagcgggtatgccgggtactcccgcgtgggtcctcgagtgtacgagccagcttcacacctacctctgtccccgctggctctggcccctagctagtgactctcagccctgcgtgcatcgccatgcgta

SEQ ID NO: 651475 - DNA, 390 bp, Homo sapiens
aaaacagaatcactctggcaattgtctgcagctgccactggtgcaaggccttcccagccctagcctctagcacttctttaagtgccaaaaacagggtcattgtgtgtgttccttttttgatacttagtcatgggaggatattccaaaaaagaaatttaaattgggttcatagtctttcagaggagttccctttagtcctggaactttattgggggatattttgtgttcaggggaattgttttctctttgctgattatgttaccatgggactcctaaagcatatgcctccccgggttaaaaaagaaccaacatgtttttgtgaaagctcctgaagggccttgggaaatgagaaagtttttataagtaaaatgattttttaaatatcagcca

SEQ ID NO: 651476 - DNA, 352 bp, Homo sapiens
gcaaggagctgtactgggtctccagtctcctccctttatctgttgtgtatccctgtgctggtgcacactgcctcgtccactgatgtgtctaataagccggcacatatgtatgtcaattcttccggctgctcacttatccatgaaaaactcacttcaacataaacttgttccatttactctgtccatataaatctgtccatatcaactcagtcaggtcccacgagacaaagagcctgtgaagtatccttcatatggtcttacatggacttacgttggaatttgtagattcagatatatcaattgattctactcgaatccatcaatacatgatgtctccatgtcactaatgtct

SEQ ID NO: 651477 - DNA, 225 bp, Homo sapiens
ttgggggggggtgtttttttttgggggatttaatgctgaccccctgggacaaacacctgtttaagctcaaagctgggggtgggcttttggggcctttgcccttttccagcccaaaatttggggcctcccccctcttgtttggttggggacttggggcaggaaaggaatgctgttgacctttattttccctttccaaggggaagaaataaaggaaaggggttgcca

SEQ ID NO: 651478 - DNA, 184 bp, Homo sapiens
aaaccccccgtttttggggaaaggggctttttttggggggcccttggcccccgctttgaaagccccccccccgggtccccccccccagggggggaaaaggactttttttccccaaaggggaggggggggtcatgggtttcccctttttgggggccccccaaaaaatttgttccctttttgtgga

SEQ ID NO: 651479 - DNA, 436 bp, Homo sapiens
cgttgtatacctaccaatgacatctagttttctcccaagagaagttctagggccaggtacggtggctcacacgtgtaatcccaacacttatggaaggcggaggtgggcagatcacctgaagtcagaagttcaagaccagcctggccaacatggcgaaaccctgtctctatttaaaatgccaaaaattagccaggcatgatggtgcatgcctaataatcccagctactcgggaggctgaggcaggagaatggcttgaacccagaaggtggaggttgcagtgagccgagatcgtaccactgcactccagcctggcgggcgacagcagcagactctgtctaacacaaaaccatttacaaaacagagcgagaggggcgagagagagagaagttctagtaaatgcaactgtaatacaccctggtaggtatgatgaaggacg

SEQ ID NO: 651480 - DNA, 568 bp, Homo sapiens
taaataatgagtgaaggtaacagttatattattattattatttttttttggagacggtgtctcgcactttcgctcaggctgcagtgcagtggcgcaacctcggctcactgcaagctccgccttccgggttcgtgccattctcctgtctcagcctcccgactggctgggactacaggcccccgccaccacgcctggttaatttttttgtttgtattctgtctcagcctcccgactggctgggactgcaggcccctgccaccacgcccggctagttttttggtttgtatttttggtggggacggggtttcaccgtgtcggccaggatggtctcgaccacctgacctcgtgatctgcctgcctcggcctcccaaagtgctgggattacagacgtgagccaccgcggctggccaacagttatatttaaattttaaaaacaataggcagaggtgagaggggaggaacgaatagaaaagggagattccatactgatgagtgatatgtgagatattctgagtgagataactgcacagagcgagcttagtataagtatatatattaatatgattaa

SEQ ID NO: 651481 - DNA, 521 bp, Homo sapiens
acggatccttaggctgaggtcaagtccaagtaggaaattagtgagttaggagtctggatggactaggctggaagtaaacatggttaaggacatatagattctatttcgtcaattactgagaaccattaaaaaatttgagcaaaagacaatctcacaaggttgcaagtgtttgaggaaaaagaacctagcatctttgtgcagattaacagtggggagaaggtaagaagaaacagcaaatgctaagagaccattgggaagtaatttaagtggaaatgataaagacctgtactaagggtggtggctggagaacagaaaagatgggatgaaatggaggcacatgaagcagatagaattcagtgagtagctatgaaaatagaagggggaagtacagcctagtagaaagaaaatctgttcctcctcttcttcctcctgtgtaacccgtctccataaatggtaccatcatccactcagctgctcaaaccagaaacctaggtagcatacttaacaactatgaccttcag

SEQ ID NO: 651482 - DNA, 949 bp, Homo sapiens
aacctgaacctggccaaagcccacctgacggccttcaggtccctgtggttctgtggggaagcggcctcacgtcaccctggttccctccctgacttctccctccctactggacctcatccttcagccagtcctggtcagcccccggaccgcaccagctgagcagcgtcctcccgctacacccgtactgccaccagaccctatcaccgcgtcatgagcagcgccgctggtgccccaggctctctatatccctgctggaccaattcgctgcgcgctcgtaatcccacatctccaataccatggtcaagcgtaaagagatgcgagagcataccgaggccaatccccaggctagaagctttctttctcagacagtccctttggacgttggatgtctcccaaggcctcgcgtcattgcagggtggtgcctcccctagtccaccgtccccctgagctttcaacttccaagggtgcgtgctaccaactctccctttgtcctggggtgcgttctgcaggtcagtcggggctgttcgccagcagatgcaaggttcattgtcggtcgattgccattccaagcattcgtttgcgctggactcgtcgccccggaaaccaacgattgcgaggcgccacatttcccgtgcgaaatcatctaactggagtgcagccgaccgtggggacagatcagcctaggaaccccgctgaaggagagcctgactaagccctgttcagaaggacacaagagggacccctgtgccatccaacgtccatagttcatcggccttggggcaatcccggaccccagagtgttagcccaagagggcaggcgtccgatagggccatgaccgcggatcccaggacggcaactgcaagggggcacgacccaatgcgcggctgaaacctagcagcggcccgagacctaggcaatgaggaccctgtgccggccaaacggaaacag

SEQ ID NO: 651483 - DNA, 208 bp, Homo sapiens
gtaatattagggacatgaatgttagtacagtaattaccacacatggaaaatattgttcagcaggaaaagtaaaactttcaaaaaattccctaaagatcctattcaataaacaattttagatttaaggaaccacttacgcaaaactcgaacaaataaccgaaaactccacctaccgcgcaatactcaaaaacacaaaaatactactaac

SEQ ID NO: 651484 - DNA, 216 bp, Homo sapiens
tcatcttccttaccgtcctgactttgaattcctggaagcctgagcatttcctcctgtcttgtggcttctttcagtatagacataatcttgataaaaacaaactgggaaattaccctttgaaccaagcaatttgaggagtgtttttgaaactaagagactgggtttctaagagataaaatcatataactgctgttctttaaaattcaccacaggatc

SEQ ID NO: 651485 - DNA, 373 bp, Homo sapiens
cagttcctttttgggagcaaatgtaattaatttctcagttggattgaggtgatttgtgtgtgtttatgcatgcctgtgtgtgactgagcgtgtgtgtgttagtgtgcgtgcttgcatgcatgtgagtgcgtgggaagagtgtgtgtataaattgtgggtctcttcctgtagcccctgttaggatcaaatatcaagaaacctcactgatggctgggagagtctcttgcccaccttctccaccccggaaacccaggtctcggcacaagcagatcctcctcagagtctgtcagacacacacgacacagcagaccacacaagtccaactaacgtgtgggcggctgtcttctgccccagatgtgtccttggaacctac

SEQ ID NO: 651486 - DNA, 207 bp, Homo sapiens
aggtccggggctgcgccgtattcgatgttgaagcctgagactagttcggactccccttcggcaaggtcgaagggggtacggttggactctgctagtgttgagatacatcatattatggccaagggtcctgctggccggcgtactcagcggtgtacttgtgtagtgataagggtggagaggttacaggagccacttattagtaatgtt

SEQ ID NO: 651487 - DNA, 398 bp, Homo sapiens
gggggagcgaatacgggaagggttgtaatgggagtagtgctcactggggtacgtgttatagatgggagtagtttaaattgggaggtagattctatcgcgtggcatgcacgaagcctgcactatatggagtgaggtatcaagatatgtgtacttattgtggaagtatctctaaaatccactgtcttctttctgtctacactgcacctaagctaaccgttagctcaggccgctcaacaccgtagtgcctagattttagtgataaccgctacttctaccattctcctgcataaaacaccttttgtggtgtctgcctagctcacaaccttcccatcttctcagaatgtgtctccctctcccactctctgccacctcaaccacacacagagatcgggggaggg

SEQ ID NO: 651488 - DNA, 247 bp, Homo sapiens
  misc_feature (44)..(44): n is a, c, g, or t
  misc_feature (96)..(96): n is a, c, g, or t
  misc_feature (134)..(134): n is a, c, g, or t
  misc_feature (158)..(158): n is a, c, g, or t
ttgggcctgcgtccctcctcgtgacctcggccagctggacccanatgagggccacctctggaaccttcttcgagccctggccagccatctgcccancctcggagggtgggcaacctggtgcttcccgggtgganacacaggaccactcagtggggccntgtgtgggcgccgagacctgggtgtctgggaagtggggggcacggggcctccgaactatgaataaagctttgaaaggccaaaaaaaaaa

SEQ ID NO: 651489 - DNA, 731 bp, Homo sapiens
caggacttggactgcagcgatggcagcgatgaggaggagtgcaggattgagccatgtacccagaaagggcaagcccaccgccctggctccctgcctgcacggcgtcaggactgtctggggaactgacagaaactgcgcaactgcagcgtggtgctagcaggcgagctcgttgcacgctgagcgatgactgatccactcacgtgggctggaggcacccagatgtccgactccagcgagagtcggctgtgaaccatgaatctcccggagggatgccacaacatggggccctgtgacctgataggtcacctctctcagaatgcacaacatgggccctgtgacctggagagtgtcccttgtcgggaatgcaatcctcctctgccggaaccatctggaagcccaacgcctatggggttcatgagctgctgggtgctcagtgcaagcctggtcaccgcaccctcctccttttgtcctggctccgagcccaggagcgcctccgcccactggggttactggtggccactgaaggagtctctgctgctgtcagaacagaagacctcgctgccctgaggacaagcacttgccaccaccgtcactcagcctgggcgtagcccgacaggaggagagcacgcgatgcggatgggtaccgggcaccaccaggcctccatagacctgagctctccctggcaggtgaactcgacaccgagctcctgcaaagtgggcctgagattgag

SEQ ID NO: 651490 - DNA, 288 bp, Homo sapiens
  misc_feature (141)..(141): n is a, c, g, or t
ggtaaaatgccattctcatcatataaaggggacaggtcatcaatatatttaccactgttcttatccttggtaacctgactgaagtagtgtttgtcaggtttctccaaggttaagttttatttttccctttccatactgtantctttggaataaagtcactattggcagcccacacttaaggagtagggcattattacctccttgaaggcagagtattgacaaaaattatttggaatccttctgcagaggatatttgactcttattccccacttatttatatattcagt

SEQ ID NO: 651491 - DNA, 430 bp, Homo sapiens
  misc_feature (325)..(325): n is a, c, g, or t
gaattaatgaggtaattcgggcaaagagtagaatttaagacaaaacggaagctgggaagcttccttgagggcaggcaggaggtggagttgcagctgttggccggcatcacgttgctcgttgctcggcttatgggaggccgccctggaggcccggaggtcccaaggtccctgggaggactgggcccctcatgcctcgagcttggcaaccgaaaacccgagggaggagaagggacctgccttgagcttggcaaccgaaaacccgagggaggagaagggacctgccttgtgacatctctgatcaggttggggtgccccagcacaggtnaccagtttggggtttgggaagcaggattccgtccctgttccccgattgttgccacgtggtaggacacatagggacacagggatttctggggttctttgcccttga

SEQ ID NO: 651492 - DNA, 119 bp, Homo sapiens
ctcacgtgtgcgcccagcacaaactccctgcaggactgctcaggacccagaagcaccagcactaccagcgcagtgccagagcaggagcaggtgtggagttaatgcaaaaatggaacttc

SEQ ID NO: 651493 - DNA, 503 bp, Homo sapiens
  misc_feature (1)..(1): n is a, c, g, or t
  misc_feature (24)..(24): n is a, c, g, or t
  misc_feature (51)..(52): n is a, c, g, or t
  misc_feature (417)..(417): n is a, c, g, or t
  misc_feature (430)..(430): n is a, c, g, or t
  misc_feature (458)..(458): n is a, c, g, or t
  misc_feature (477)..(477): n is a, c, g, or t
  misc_feature (484)..(484): n is a, c, g, or t
ngatcaaacccaacaccaggccangggggctacaaagtccggcagagtcgnnaggaatgagacaagctaatagtacacaaagtgggtccagggggccaatgctagtatagaggctgtgaaggccctgaactctgggagcccacaccatttattggagattaaacaaagaagcaggtggtgaggacgtgctggtcaaaaggaagcagtcacatcaagtgtttagtttatagctgtgtcggtctagcattttctttgaagcatatggaacatgttctgctactcgagataatgaacatttccttctacctcaaggtacaatcagtttatgatcctgggagagcaagaagcaaggagccagcaagtctgggacacattccagaggccacgagggggttttatgtcctgaagtccctggantcccatcccaagnccatgagggggttttatggccctaagcnttaggttgtagttcggccngggcaanctttccacccctttagccc

SEQ ID NO: 651494 - DNA, 557 bp, Homo sapiens
tgtatgccggtggggatggaagtgggtactgagtttgaatatggagtgatagttcataggctttgcatgtgcgtgtgcacatggtgtgtgtgcagtgggtgtggtgtctggggtgtgtgtgccgtgtgtgcggtgtctgtgtgtggggtgtgtatgcgtgtgtgtgggtaaaagaaagagatcagactgtgactgtgtctatgtagaaagaagtagacataagagactccattttgttctgtactaagaaaaatttttctgccttgagaggctgttaatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggcggcagggtcctctgcctaggaaaaccagagactttgttcacttgtttatctgccaacctttcctccactatttgtctaatgacctggcaagtcccc

SEQ ID NO: 651495 - DNA, 241 bp, Homo sapiens
cccagtcttgaaggattagaaggagatacagggctgtatggggaggacacatgtaagtgctagaatcaaacactgaatgcgaaacaggcaactggcacaagcagcaagaaagagatagagccggagcatgagtggcaggaaggtggtggttttcttcactcggaatggctagatcattgggcagaaggatgcttgttgttccttctggaggcttcctccccagcattggaatgctgagctg

SEQ ID NO: 651496 - DNA, 147 bp, Homo sapiens
ggtaatactggacttctcatggtgtcatggcatacctggccttctggactacctggaccttctgcagcgtcccctttccctgcctctttctgctctatctccacctccttttcccagcctccagaaggtccaggtatgccagaaggt

SEQ ID NO: 651497 - DNA, 925 bp, Homo sapiens
actttatatcttcaggtattacatggcacacgtacggcaagcacaacatttggcagaggttgatccagaatgtcaaagataagaaacatgcagagtgcacatgcattcgtaactggagttaccttggtgttcccatgtgttcccacaatctgcaagcaagggcaaacccgttacagcacaaggcatcggtctgcagaagaaacttttcagctctctcggtggacaccattttatcaaagatattatggaggatgctattgataatagattagattcataaagaatggccatattgttcccagtgtccagcagtatggaatggttcaggagctgtaagtgctcgccagaaacccagagctacattatttagcaagaccgaacacatgggtcaaagctgattgtccccgtacatccggagggatcacatactctgaagctgcgtagtgcttatgaagtttctcaggcacataaatcctgtgaagttattataggtgtctacacatgtttgaagaaccaaaaagctgatggatgatataaagatgctgaataaaaccaaggataaagtctccttaattaaagatgacatagcaatttcctttacggcagggtatagagagttctgtagctaatattgtagcaactaaacatagcgaagaacacatgtcggctgtaccatgttattttaacacaatgtaaattattccatggcaactaaggggcttttacaaactaccattatctctaaagggaacctcggcccaatcgatccattcaccgggcgcattggtccacatctaggatacactccacatcattggctgggctgccccaggtcacctcgcattcgagcagcacaagggttacaaagtgccttcgtccacaaaggcgcacatcaacgtacacccttcgggagagcacacactag

SEQ ID NO: 651498 - DNA, 228 bp, Homo sapiens
  misc_feature (5)..(5): n is a, c, g, or t
taccncgtccagtgagttcaccctctaaatcaccacgatcaaaagggacaagcatcaggcacgcagcagtgcagctcataacgcttagcctagccacacccccacgggaaacagcagtgattaagcctttaccaataaacgaaagtttaagctatagctatactagaccccagggattggatcatatttcgtgccatgccaccgcggatcacacgacttaacccacag

SEQ ID NO: 651499 - DNA, 261 bp, Homo sapiens
  misc_feature (49)..(49): n is a, c, g, or t
cctgacattacgatcagcagcagtgctgtggctttcaaatggttttatngcctcttggcttaggctccttgaccgctgggcctatgcatctgacaggggtctctcctagagcaccgggtgtggccccaccccccggggttcccagcacccacttatgtctccccagcatagcttattagctcctcttggtcagagtagctgcaggagggggcgacaaaggtttcgtctagctgctcccttccactggcagcggcccactta

SEQ ID NO: 651500 - DNA, 317 bp, Homo sapiens
cccccccttttttaaccccttttttttggaaaggattaggaaaccgtccccccaattatttaaaaaatggttttaaattaaaaggctttgggctttgcaaacccctcctgttgtccttttagcaaaaaaatccccaaaagggggccccagttgtatctggaaagttagctgttcctcccctgccccgaagccttccttaaaaactgctttttttaaaaaagtttggttggggttttttttctgccccccttccccctttttttgaaagtaaattgccataaaacccccataaaacgtttgggggggttttttcttta

SEQ ID NO: 651501 - DNA, 117 bp, Homo sapiens
  misc_feature (29)..(29): n is a, c, g, or t
  misc_feature (64)..(64): n is a, c, g, or t
  misc_feature (101)..(101): n is a, c, g, or t
aagcgtgcacctgctcccgaattactcancgaaaaaaacgggctgagcaaacggccccgtgganggaaaaaaagagctcttctgaccatatccttcttaanacccgctggcatctcc

SEQ ID NO: 651502 - DNA, 195 bp, Homo sapiens
gcaggaagagaaagaaacatcgatccccgagtagcggcgagcgaaaagggaacagcccaagtacaaacgaagaaaagaacttagtcgaatcagctggagaagctgacccaaaggaggtaaaaggcccgtagacgaaaagggaaaagaatcagtacaaagagtaccacgagacacgagaaaccttgtgggaacaca

SEQ ID NO: 651503 - DNA, 231 bp, Homo sapiens
ggatttgctggtgcagtacaactaggcttaatagggacatgtccacttgcagattctacgaaaaaaatttttccaaactgctcaatcaaaagaaaggttcaactctgtgagatgaatgcacacatttcaaagaagtttctcagaattcttctgcatagcttttctgtgaagatatttcattttccaccctaggcctcaaagcactcgaaatgtccacaggcagattccaaa

SEQ ID NO: 651504 - DNA, 403 bp, Homo sapiens
  misc_feature (36)..(36): n is a, c, g, or t
  misc_feature (75)..(75): n is a, c, g, or t
  misc_feature (82)..(82): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (128)..(128): n is a, c, g, or t
  misc_feature (171)..(171): n is a, c, g, or t
  misc_feature (179)..(179): n is a, c, g, or t
  misc_feature (199)..(199): n is a, c, g, or t
  misc_feature (219)..(219): n is a, c, g, or t
  misc_feature (239)..(240): n is a, c, g, or t
  misc_feature (246)..(246): n is a, c, g, or t
  misc_feature (248)..(248): n is a, c, g, or t
  misc_feature (254)..(254): n is a, c, g, or t
  misc_feature (285)..(285): n is a, c, g, or t
  misc_feature (305)..(305): n is a, c, g, or t
  misc_feature (312)..(313): n is a, c, g, or t
  misc_feature (318)..(318): n is a, c, g, or t
  misc_feature (323)..(323): n is a, c, g, or t
  misc_feature (348)..(348): n is a, c, g, or t
  misc_feature (384)..(384): n is a, c, g, or t
gtggccctcaatcagggatcttgaggccctcgaganaaccaccaccatgggatagaggtcgatggccccgtctgnaagctgntgcagcanaaantnttcattgacaatcccccttcttgtgttttatnagcttggcctccaccacagtggcaaatttttctttttttcgtnttgccagntcgctacttcgactcaactncgggtggataagttcgctgntttttaggttgctgctcagnnttgggngnggggtnatgtgtttggttggttcttctagaaggaggncagcattcccaaagggattntttagannactgncaagnccagagagtcctttcctttgtccanacagccctgcagagccacaaaaagccgaagaatgtnatttgttccctcaaagatt

SEQ ID NO: 651505 - DNA, 1416 bp, Homo sapiens
atttttcctttcttctctgtcttcttgttcgtgctcttccttgttttttgtgtcttttttgttgctgtcgtctgtcctttgtcggttgcttttgctcgttgcttgtttctctctcttgtgtctggttctgcctggtggtcttattgtttgggcgttcgttctgacgtgcagttcatgccgagcgaggcatgagtggaagagaggattgactgaatcttttcttctttttgacgctgtgtctgcctcgtctgcccgtgtgctctacgtctatcttcttgtctgccacgcgcagtgagacctctggttgtgttgcagttctttctttgtgagtgctgtgtaggctctggcggtctggcaggtggtgcgttgggtctgtggctgaggcgggcgttcgtttgtgtcctctcgttcagtttttcgtgctttcgcgcccccgtccgctgtgtttttgttctgctcctcctctcgtcgggctctagttttttttgttcgctccgtgtggtggctgcgcgggggcggttcgtgttttgtttggtcctgtaggggtggctccgggtgccgctgttggtcagcctctcggttgcccttagggcctggtgttggtttcggcgtggagaccgttgttgcgttgtgtggtggcgcccgctcgccggggcgagtggcgcgttgtcactgtgggggccttcatggggtgtcgcgagacgaagcggggggggtttcgttctctcgccgtgtggtgttccggccgctattgggcccgggggtgcgtccccctggggggtcgcgactcgtgcgcggcccggaggtcgcgcgggtgtcgctcctgcggttgtgtcctgcgggggggtgtggtatatgtgggagcgtttggttgggccgcgcacccgcggcttttttttgcgtctctcttcttcggggattttcgccccgcccacttgcagttccgcgggtattcccctcgcgtgtcgcttcgcgccctcctctcgctgactctctcttctcttgttctctctcgcgggtggggtgctcacgtctctttttctttcgcttcacccgcgcgcggtagatattttctatagtagtgtgtctgatcggagattgttgtagaataacctcttctcctgttctgagaaggcgcgcaaagtccccgctatatatatatatgagaagaaaacaccctctcctcgatcccctcgcggtggggaactatattatgggaggtgccgccccccccctctccccaccaccatctctcctgagagagaacccctgagaaacacacttaattcttgcgagcaccaacaaaggagagagcgagtagtcggagcactcccccgacgtgagtggtgtgttctcaggacccacaccccctcgggtccccacactggactcgttttccacagacaaaaacagaga

SEQ ID NO: 651506 - DNA, 304 bp, Homo sapiens
agctctcctatagatcagtatgaaaacgtgaaaaattctacaaaaatcaaggaatggccaggcacattggctcatgcctgtaatcccagcactttgggaggccgaggtgggtggatcagtggtcaggagttcgagaccagcctggccaacatggtgaaaccctgtctctactaaaaatacaaaaaaactagctgggtatggtggcgggcacctgtaattccagctactcaggaggcagaggttgcagtgagccaagatcacgccactgcacttcagcctggtgacaagagcaaaactccatctc

SEQ ID NO: 651507 - DNA, 1316 bp, Homo sapiens
gtggacgtaacagcaatggcggaaggagaacgatgtgccgcgctgccaacgtcgaagcggcgacggctgggaaaaacgatcttgacgaacgctctggaaccaggaggttgtgactcttgaaacgttgagaaatactacattcaacggaacgaccgctgcctgctgactctgagggccacccgttcgcgacacgattgctctgaactgtcgcccgacccaggtgactagttcggcactcactgggactggtactttcaagacctctgccaccaccacgccacacctacttcacaccacgacttcgcctgcagctcctactcgaaccagcttatcacgtgaccaagaagcgagaacggccacgccacggaactcacctagttccggactactcgacactctgtacacttacccctccttattgctacaactcacgtaacacactctcccactctacgcaccactcccctctacgcctgggatcacactcttacttggaccaccccacctcgggctcgccactccttcccaccctcgcccacggcccccgcgcccttctactaccaaccctgcactacccactgccccactcccctgcacctcaacgcctacattccaccccacgggcacattggctatccctacgaacacacgcggccgcaccccatcgcacactccccctctcaaccggctggaccttcaaggccgcaaccatacccccactgaaagccgctcgcaacgccctaccagggctgccctcgacgttccttcgcacctcacgcaacacggacaaccaccttaacatcctcacacgaaacgtgcccgtactagcccacgatcacccccttgccctctcgcgacaccgcctcccagcacgctggcccacctgctatgacgctcggcaaccccccccttgcacaccaggctcgacacctccacgtggccacaatcttcctcgcgcaacctaccccacctacttctctaatccaaacccaccaatgcacccccaacttcccaactttatcaccaaatccataccacacactaccatccattctacacacaccgagcttaacacacattccacctccccactctagcccttcacacccctgcccacacacacacccacaccgactatcatatacacacacacaccacccaccattcgaagcattcccaaccaccaaccacaaagcaccacaacagaaaacacacataatacacacacacacctaccatacctcacgaacacacataccaactccgcaactcacaacaacacccccacaacacatattacaacccacatcccacct

SEQ ID NO: 651508 - DNA, 109 bp, Homo sapiens
tgcgtggagagtcatgcgtgaggctgtccatcgttgtgcaagcttcatggattgtgcaaggatccaggttgtgctgtgttcatgtgtgctgtgcatcgtgtgtgctgtg

SEQ ID NO: 651509 - DNA, 143 bp, Homo sapiens
tagaatcgagctcggtaccggccccctgggggaattggaagttattactgtacaccacgtgatacttcttcctcgcgtacttttggccagagtgacccggctggagatcatacggaacgtgtgagctgcaccattcatgtctt

SEQ ID NO: 651510 - DNA, 820 bp, Homo sapiens
agcggagtgtctaaatgtctatcttcagatgcagaggttgtggtacggaaccacaaggccggagacgctgcctggagatgtggctgtggccgtgcatccagacgactcgcgagtacacagttgcctggtccgttgatccctctcccttcccttcagcactctacacgggcgaccagtcttcgtcaccccgttgatggggcgagctcttcccctcatcgacagactatgcgtgtcagccacagtgtgggcacgtggggcaggtgaaggtgactccgagcgtcacagatcctgcacgatgctgagatggcgggcccgacatggcgttgagccccttgaagtgtcattgcggaggatgggaccattggactcccttctgcggggactgggctgcaacggtcttcgacccgctgatgtgggccccgggcaaaagtataagtgtctggtgctgtagtgaatgtggggcctgtttcccgggggcctccagaaacactcacattgggtactggcccaatctgcgagacagttcttggggatgtgactaagaatacctgctgacaaggaaaacagttgcgttctgtcctgcttgccagggaaaattggagggcccgaagcttgcccaaaggatggtggaagctctggtggggcccttggagagcttcaagtccgcttccctttccaacccaggaaaggaacactgaggccatgcacctgagtgatcacccaagtacttagcggggaacgtagggtgatggtcatccccagaggagaggctcggattggtgggtggacacatagaagaatttcacgaggcactaccctg

SEQ ID NO: 651511 - DNA, 116 bp, Homo sapiens
aaaaaaaagaatttaacccttacatgtgtaaaggtttcatgttccctgtgagtgaaaatttttacattcatcaatatcccttttgtaagtcatctacttaataaatattccagtga

SEQ ID NO: 651512 - DNA, 302 bp, Homo sapiens
caatgtcgaaagcccaaagactttactttaaagcttaggcctcttgtgccagttagccaagatgtgaatgcaaaggaaaagttcttgaggaaattaaaagggctactccaatgaacacaaataattaaaagcaaaagaagcttattgttgatgggagagggtttattggtctgtatagaggatcgacccaccacaccattccctgaccaaagtctattccagtccaaggctctatgctctcatttagtaggttaaaaggtagaacctcagagaaagttgaacctcacagttgtcataggtta

SEQ ID NO: 651513 - DNA, 86 bp, Homo sapiens
caatatgtaactacggagctgtagtgccattagaaactgtgaatttccaaataaatctgaacacttgtttttattaaaaaaaaaaa

SEQ ID NO: 651514 - DNA, 815 bp, Homo sapiens
agtttgacgttctgtgttctccccgcccgtgtccgcccgaccgcgcccgctgatgctggcgctgcgctgctggctcccgctggctcggctgctctccgtcccgctgctcctgtgcctgctgccgcctccccgcgtgccctgctgcctgcagcaatggtgctccttgtgctgcacctgtcctacttccctcctcactcctgtgtgaaccctgctctgttgtacctgggactgtggactgccaactggtgtgaagcctgctctggcctgctgtgtgtgcttggaagctgaatggccagatgtcgtcccacaagacacgctgacgaacttcacgatgccctagtagcaccttggtgacgaatgcggctctcgtgctacacaagggctccaacctttccacaaggggttgactcccttatcccttcacttgttgccacttgctgtggctgacattacaaccaaaaacaaccaaatggggccacagcggccggcggaactgtccccacttcctttaactgagaacatggcccgtgtatctccccattgaaccaggcacgaaacctttttaacccaccttggacaaccgccaaaccaggttgggtgcggccccatgacgttacttccccatagctcccccataggcgccttaaaataggccatcgggtcactacaaccaaaccaacactgtgccttcccccaagagtacataccattcccttggcacccataacacgcacccagacgctggatctgggcaaagtgaacaagcataggtatcgtgagtcccgcgggccacaggtcaacaacgacggggcaag

SEQ ID NO: 651515 - DNA, 179 bp, Homo sapiens
ctacagatctaattcggccggggcatccctgatagtccgttggagaaagttcagagattcacttaggagatgtgacttgaagccatgagactggtgttcagagcttacccagcccaacccagcaggctctgcccaggctggagtgcaatagtgcgatcatagctcactgcagcctcaaa

SEQ ID NO: 651516 - DNA, 674 bp, Homo sapiens
ggctccccgctcctcctccccagccatggcgtgcacgttctgcgggctgcgtgctacatggctggcgctgctgctcactgacgcgctcatcttcttcgccattggcacattatagcatcggatgagcggaagactgattacaagactcctatagaccagtgtactaccctgaatccccttgtactcccagagtacctcatccacgctttcttctgtgtcatgtttcttgtgcagcagagtggcttacactgggtctcaatatgcccctcttggcatatcatattgggaggtatatgagtagaccagtgatgagtggttccaggactcgtagtgacgcctatcaatcatcatgaatgcagatattctagcaatatgtcagaaggaaggatgggtgcaaattgaggtttttatcttcgtagcatttttttactacctatatggcatgatctatgtttggtgagctcttagaacaaacagcagaagaattggtccagttgaagtgcatgcaagaaagccacgaaatgaagggattctatccagcaagatccctgtccaagagtagcctgtggaatctgatcagttactttaaaagatgagtccttatttttaaatgtttccagattttggttgtggaaggactgtttgcatatgttatatcagataagatttaaatg

SEQ ID NO: 651517 - DNA, 1047 bp, Homo sapiens
gatcgttcggggacgggggctggtgaggctcacgttggagtggcttcgcgtactgcttacggagagctgtaaggatatctgatgaccagtgagatccctgctcagaacccccttcctgtgtggcctgctctgggccttatagtgccccacgcgccaggggcgtgaggagaccgtgcatgccatgcttctcccaagcaccggacagtcactgggcctgagataagaacacaggtgcagcgacacaatgagcgtatcactggaggcactcgtagaaggtgtcatcagtaaaaccagaggcggagatgtcgagccagaagaatttgctagctaccatgtacttcacaacactgcaatgaataaatgatggcaatacactttgccttgaatggcttgagaaactctccacgagaccaatcacgtcatgtccagttaactgacggacagcggctgtgacacaggcaggcagcttaatgagtgaatgagtgaacgtgacttaagcaataactaagactgggtgtgataaggagaaagagtgagtgaacacacgaagcgaatgaattggattacatttgtacatatgcttggaagattgtgaaaaaaatccagctgacaggatagaattggtatacgttagtgggagccagtctgcctgggatattctacaaaatgttgaacaccgtgtataatgttgaatatggaaacaagtgtgagataccttgacaaaaaagtagagctccaattttacccaaaagtcaactaggagttggacaacagcaatgtactgggacacaagaaaaggcagtggttaggcgaattgcgggttcacaagacgggggcttgcgcaaagacggctacggcacgaacagagggagggaagaaagaagcgaaatggggaagaagcgaaaaagcgaaccccagaacggcgtacccaacagcaccaggagcgtggggcaccagtggcagggacgaaagggaccggcagaagcctggggaacaggcaagagataaggcaagggaccgaaacacaagagaaagaaagcggagaaa

SEQ ID NO: 651518 - DNA, 990 bp, Homo sapiens
ggagtccgagtggagagagcgagctgcgtggtatgtgtggtcgcgtctcggaaatcggtagcgcttgcaagccatggctgaccaactgcactgcaagcagccagcattgccagaattcgaacagcaagctattgccactcatattgcaccaaagcatggtgcatggcaacttatttaccaaccaaaggcaatctgggcacactgtaatgcagcatcctccttgggggcacgaatcccaacagcaagcagcagttaacagggcacatgcattcacatgcaagtcagatgctagatgggtaatgggcgacaatttgactatccctgaaattttcttgacgaatgcatggcaaggaaaaatgaaagacacgagaacagtgaagaagaaattcagcagaagcattccgtgtgtttgatcaaggatggcaatggctcatattcagtgctagcagaaacttcgacatgtgatgacaagaccttggcagaggaagttaaccagatgaaagcaagtctgatgaacatgatcagggcaagcagcatcattgattgagtgcatggtcaaagtaaactcatgaagcagtctgtacaaatgcatgacagaaaagtgaaagaactgtggtccagcaatgtgttaaaatttctaggtaaaaaaaattgttgcactagatgcactatacactcttggcacgggcaacactacatcctgggtcaacaagggacgacatcccctacctggtcacaacaaccattactgcactgggtacttaaggacaaagtgacgggaacgttccaaagaacgcatgccccaagtggttagacttatcccccattgaaatctatgaacggggtaccattggtcgcctcacacaaaccattaaattagtaaggaccaaactgttgcatccccaggctacacctgtgtcggccattgtagggatttaagctgtcgggggaatctacattaaaagacccaaatattgggcagcatacaaa

SEQ ID NO: 651519 - DNA, 215 bp, Homo sapiens
tgcttatgcacgaatgtcgcgcaatacagtagttgacttggtgctctgcacgccaggggctcttgctagaaatctcggctgcaggctaaggcagcatcagcatgacctctttgtctgggaacaccgggtgagcagcccactgcccagtgcctcgtcagccaccatcttgcgggcggtgaaggccagctcgttgaccaggctctggttcccgatga

SEQ ID NO: 651520 - DNA, 415 bp, Homo sapiens
gcagcaaacaaagcagttcaccttttccaactgggaaaaatgaaggcaaggactctatttactgaaattattttcaacctttccccaaataacaatatttcagaggctttgaaaaaatttggtatttcagccaatgacccttccattttaattgttttcattgaagagggagaaaaaccaattaatccagaattcctaatatttcaagtagaaggtcatcaggtttctttgaaaaattttcctgaaataatgaatattacagaagtcaaaaagatatattaactcttttcccaagaagaaagtatcggggccttattggatgctatcctttgtagaatgtcaaccaaagatgttttatgaaatgtcagaaatattaaccaaaattttcagccttaaagaaaaccttgattttcaa

SEQ ID NO: 651521 - DNA, 224 bp, Homo sapiens
  misc_feature (1)..(1): n is a, c, g, or t
  misc_feature (28)..(28): n is a, c, g, or t
  misc_feature (39)..(40): n is a, c, g, or t
  misc_feature (68)..(68): n is a, c, g, or t
  misc_feature (75)..(75): n is a, c, g, or t
  misc_feature (109)..(109): n is a, c, g, or t
  misc_feature (118)..(118): n is a, c, g, or t
  misc_feature (123)..(123): n is a, c, g, or t
  misc_feature (135)..(135): n is a, c, g, or t
  misc_feature (137)..(137): n is a, c, g, or t
  misc_feature (163)..(163): n is a, c, g, or t
  misc_feature (178)..(178): n is a, c, g, or t
  misc_feature (191)..(191): n is a, c, g, or t
  misc_feature (207)..(207): n is a, c, g, or t
  misc_feature (215)..(215): n is a, c, g, or t
  misc_feature (218)..(218): n is a, c, g, or t
ntctgccgaatttcggcacgaggtttgntcatatttccnnctggcaaaacatctgtatctttctattnttaccgnagtatttaaccgtgaatgtgactagaaccgctcntctatatangcaanatcctttttttncncccttttttcttttcggcgttctaanattcattcttagctnttctttttcaaangtgtttgttcctttanttgtcatncangatagg

SEQ ID NO: 651522 - DNA, 154 bp, Homo sapiens
gacccatctgtgacattctttatcccttcttccccgggtatggtcggcatagagcgggtcttgtcttgctagtgattcgactactctgatagctgtgagcttgcttgctggccagaggaagcaccaggatgtgacgaggcagagggacggctcc

SEQ ID NO: 651523 - DNA, 234 bp, Homo sapiens
gaagcagaaactgtatcatagaatgtacgagataggattatatatgataagtcagttagagggaacatgaatccagccactatgagttccaacaacacaagttgccgaatttcttgaaggttgtgaaaattatttcctactactgactgagatcttgctatggaagtatagctttcatcagatttgtagtctgcataaatacaataatgtcttcactgtagtttttcttctgat

SEQ ID NO: 651524 - DNA, 240 bp, Homo sapiens
  misc_feature (137)..(137): n is a, c, g, or t
caaaagaatcttctagctctgattcatcctcatcttcatcttctgatagcgaaagcgaaaaggaagagtctaacgataagaaacgtaaatctgaggacgccgaagaagaagaagacgaagagtcttccaacaagaanccaaaaaatgaagaaaccgaagaaccagctactattttcgttggtagactatcgtggtctattgatgacgaatggttgaagaaggaattcctgcagcccgggg

SEQ ID NO: 651525 - DNA, 181 bp, Homo sapiens
  misc_feature (23)..(23): n is a, c, g, or t
  misc_feature (46)..(46): n is a, c, g, or t
  misc_feature (123)..(123): n is a, c, g, or t
  misc_feature (145)..(145): n is a, c, g, or t
  misc_feature (148)..(148): n is a, c, g, or t
aaaagatgataaatccaccctcntgctcttaaaatcccataaacgntaggctctggagaaacaagttgttctgtcgagcccttgccatcaacacactaagcaatcatagtcccccagagcacnagatactgctaatgaccattanatnttgtatcatcatgctgcctcctgcatttgaatt

SEQ ID NO: 651526 - DNA, 424 bp, Homo sapiens
gctgtaggaattctgcacgagctgtgctattatctcatgctctaatggggaaattatattttctcatattcttatatgaaccaaattaaagggtactcgtgtctattttttctcaaaaaggaaaaggtttttattataaaatacatgcgtctttgaaaaattcaacctgtgttggagtacattaaataccaaaatgaaagtcattttgacttccacttcccacagatatatcaccatgtgcacggtaattccttgtgttcgagagaaggcgacatttgatcacaactgtgtgtgcctcactctgtctggggaaggcccgtggtgaatcataggactcaaggtctctgttcacaatactcaaggtggtaagaattggcaagtagaagggggagtggtttgcattgtgctgttaccggatcatggg

SEQ ID NO: 651527 - DNA, 117 bp, Homo sapiens
ggcagcccccgcaagacggctaagggaactgagaagcctgactgtgatgggggctctgccataggcctcctcttcggcctcctcaccgaaatcctcctcctcgtcttgcgggggctg

SEQ ID NO: 651528 - DNA, 187 bp, Homo sapiens
  misc_feature (132)..(132): n is a, c, g, or t
ctagaggatctggtcttgaggcggagcaatgaggaagtcacaagcacggacttgactttggtctggcctgactttgaagtcatctccgcccacaaaaacccgggtgctgccacgcgaagctcaagagctccngggcacgcagggtgttctagcggagacccacttgcaggaaggcacacgccctcca

SEQ ID NO: 651529 - DNA, 248 bp, Homo sapiens
tactgctagtggccgggggtgtcggcgacgatgaacttgcgcttctcggtcgagaagaaacggtaggcgacgtcgatggtgatgcctagctcgcgctcggcggccaggccgtcgaccagcagggcgaagtcgatcgccccgccttgggtgccgaccttcttgctgtcggcttcgagcgccgccagcagatcctcgaagatcatcttgctgtcgtacagcaggcggccgatcagggtggacttgccgtc

SEQ ID NO: 651530 - DNA, 161 bp, Homo sapiens
tcgagctcggtacctaatatgagattaggcagaaacaagaaggttgaaactaatgcaaacaaacagataatgtaccagaatctctgggatgcagctaaagtggtggtaagagggatgtttatagcactaaatgcccacatcaaaaagctagaaagatctca

SEQ ID NO: 651531 - DNA, 200 bp, Homo sapiens
agtgatctagaggatcccggtgtcacgcggtgaaggcagtagtgggtcaggtacagctggatgcgcacgcggtcgttggtgggcgaggggatttccagtgcttcttcgtagttgtcctgctcgaagtactccttgaagcgcgggtggcgtaccaggttcgttaccggctggccgctgtcctgaggggtcttgaggcccag

SEQ ID NO: 651532 - DNA, 502 bp, Homo sapiens
tctctcttgcagataactatggccgtgtgcctgagatctggccaatggaatcgtggacagttctccatgctctttctccttctgtggcaactctgaatgtcgtgtgttcaagatgaagacagaagatagaatgaccttgggtctctgaatcattgcttggagaagagcaatttactgatcagtggtgtgaaaataagtaattcaaaatctaagctattgggccaggtgcagtggctcacgcctgtaaccccagcactttgggaaaccaaggcaggtggatcatttgaggtcaggagttcgagaccagcctggccaacagggtgaaaccccgtcgctactaaaaatacaaaaaattagccgggcatggtggcatacgcctgtggccccagctacttgggaggctagggcacgagaaacacttaagcccaggaggcggaagttgcagtgagccaagactgcaccactgcatgctagcctgggcaagagagcaagactctgcctc

SEQ ID NO: 651533 - DNA, 123 bp, Homo sapiens
aaccactagaaacgggtcggttcacatggctatacaaagcaaaatactatacttaaagaggactgtcacaacacggttccaacctgtgaaatgtacagtaaactcctgttccagtttcatggc

SEQ ID NO: 651534 - DNA, 131 bp, Homo sapiens
ggtcggaccccggacgaatcctgctgctgtaataggacggatagacgaagaggggcgtttggtattgggttatggcaggggtttccgggagcagcaggaattctcgcgggagcagcaggaattctcgcggg

SEQ ID NO: 651535 - DNA, 138 bp, Homo sapiens
cagacatctagaggatccctcgtctatcatcggcacctcgctatttatcggcacccgtattgaattcaagtataatattaagtatgcatggacctctagagctaatggatgccgattaatagcgaggtgccgatcaat

SEQ ID NO: 651536 - DNA, 122 bp, Homo sapiens
taagaaccagaacgggggcaaccctgctgtatactacgtagagagtacgctcaccgtggctgccctcggaacccaacatctacatccacaaggcacgacatcgcgcaaatgctccggctgaa

SEQ ID NO: 651537 - DNA, 443 bp, Homo sapiens
  misc_feature (81)..(81): n is a, c, g, or t
aaccatcactttaccgggtataagcacccagcagctgaaagcgtcctagaatgcgctgatggtctgactcgtcattggaantatcatccgctctcccctcccggcgctggagcggcgtgtcgcagcgccctctgcggacattcgcgaaccgtaactgcagcaaccccttggcggtgtgtagggcgtcaagccgcgctcatcagcccccttttgcaatacagctccctactgctaaggggaggtgagtagtaaataatactcgctgactgagaaagtgcaaggtcatccgattttattaataggccgggcgcggtcgcacgcccgtaatcccagcactttgggaagccgacgcgagaggatccctgtagcccaagagtttgaaaccaacaagatagtgagataccgtctcgatcttgcagataaacatttttaaaaaaagaaga

SEQ ID NO: 651538 - DNA, 450 bp, Homo sapiens
  misc_feature (8)..(8): n is a, c, g, or t
  misc_feature (15)..(16): n is a, c, g, or t
acatagtncctcacnngaaaaaattatcggtcttttagttcttcaatcatgaggatatgagtgagtaaagtattcaaaaaacattactttgtcatttttttctaaaaactctttaatttttatattagccgagctataaaaaagaccttgaaattcacctccttcagagttaatgcttccatcatcattgatgtgcataatttgatcaagctcattttcttgaccaatgataaagtcatcttcaccaaataaaggagccatatgaacaagtccagttcctgcatcaatagaaacatggtaaccagctacaacaataccaaacaaatcagtttttataggtctttgatattcaacaccaagcaagttttttcctttaaaagtatcaactactttgatttttgaacaccaaaaattccattctttttcaagcaaatcactagctcatggagt

SEQ ID NO: 651539 - DNA, 1137 bp, Homo sapiens
  misc_feature (374)..(374): n is a, c, g, or t
ttttttctagagaggaggacgcagaatgtagagaaacagtcacatagttgttaattcatctttctgttatattatttatctgtgtgtgttgaattcaccctccctgtgtggtttgtcctctccattgtgtcagtacccctgctccctcacgagttcaaccaggggtattgggtctttctcttggcccgagggaagggtgttataacgcccggaggggggcccgtggcccagcaacgtcccggagttaattcgtcgaaggcccccgaacttttgaggagccttttccgggaccattgggcttcaaagccatgaaaggtctgtacaagaagttcctcggggcaaccgtggctgggacacccacaatgccgcccccnactgggagcaactgggctttcacagctcaggtgattatcctgggaccactccaggccccaattagccccggcttatgcccccgtattggattgcccacacggctcacacttgcaagccagatttgctgagactgtaaggaaaagattgagtccccgtttctgggaaaaagctggaaagatggcccctcaaattcttgaaatcttggtgaatgctgcccattgttgaataatggttcctggcacagcccaatgtgtgttgagagcttttccagactaatccaccctttgggtcgcctttgctcgttcgtgaatattgagacccgacccgctttcgcgtgggtgtcaatccaaagcacgtggacccaagaaaggctgtctggaggctggccaaggtcaccccaagttctgcccacggaaggcttacgaaggctaaaatgaaatattattctcctaaatacctcgccacccccaccttcttaatccacctggtggaaagaaccggttctcacggactcgtttgtttccaattggccactttaagtttagtagtaaaagaactggttaatgagtaaccaatgcactcgttaaaccttcacgaaggaaaaggagaatgttttgtggagcccctcttggttttcttttttgcgtgtggcacgttttaagttatattagttttttaaatccagtactttttaatgggaaccacttgacccacaaatttgtcaccagaattttgagaccccctttaaaaagttaaatgaga

SEQ ID NO: 651540 - DNA, 925 bp, Homo sapiens
ttcttctttgcttttcccctttgtgaagtctcatcccaactgtcgtatatttctcggtgattcctatttgaaccaagtggtaacttgtcccttacgagtgtacgccctctcttggagtttcctcctcttgttacctaataaacacttttctctacgcggtaaacatccgtcacgcgctagttgtctacgtgcctttcttcgcctgggcttcctaatgcggattcgtgtcttttacagtcccaggctcttctcggatcttgtgctcttgtgccctacaccctggcattcctgccaagttgaaggcactatgattgttcttgtcttctcgtctcgtcgttggaaatattcttgcttttgcgtaatatcgcccctacccttataagtccttcccttctgttactttacggcaattcccctttccctgactatcgcgatgggtctaggagtctaggagcagaacctcgtggtaatgtatatggtgcagatcccaagggctgcctctagctctcaagtatccctgtgcctcttcagcatgatgtccgatggcccccggcacctcctgcctctgtgtctttcagacctgctacatgttctgcttgagatatttcgctcagcctgaaagtttccctcaatccatctgcacagagaactcttatggcactcccagttagaaggccctgctcagacaccattatcttttgtgaagcgcttctgccacattcttgtcttcacccaaaattgatcacgtccgccttctccactgggctcccgtagcacaactataacatctgcatggagtgtttgactgtttcgcacaatactttcttgtacatttgtgtcgtcccttcccctaactagactgtaagtgccttgcggtcagggactgaatctgcccggttataaatgcctcgatgtctagcccata

SEQ ID NO: 651541 - DNA, 232 bp, Homo sapiens
catgcacgctcgtatgttcggaacaggcgggtaagatatgcgagtcctttacttttttaactttccttatgagcatgctgtgttgggttgacagtgaaggtaataatgacttggtggtgattggagatattgggcttgtaattgtccagttccgtggtttaatcctgacgccagcttatgcggaggagaatggtttccatgttacttatactaacattagttcttctatagg

SEQ ID NO: 651542 - DNA, 429 bp, Homo sapiens
tcaccatgcttcttaccccagcagccagactttgggaggctacttttctctgagccaggtgccccgcccactccaggttctgtgtctcccctcttggaagggagatggccctcagtgacactgtaagaaagtttattgccttgagaattcgggagtatttgaggcttgagccctttgaaatctttggaaaaggacctttttggtggagtgctggacttgtggaaataatgccacacttaagacaacaaggagagtacaatgggaaagtcttctagagaaagcatgaagaagacctagtggtctttgccaatgtggatttctgggacagaccacttcttccaaatccttagtcagtttcctcctaaggccaactaaattctttttcctgttgttggtgaataacttcccccttcttttcccactcccagc

SEQ ID NO: 651543 - DNA, 1118 bp, Homo sapiens
aaggagaaatgtgaaacttgagtttagggttactgccgaaggaagaccaaattgaatgaaatctggccttggaattggctgtagattcttcctcctcgaattgttactgaaaaggagtcttaaaaattgaaaatgttagcagagcattttgtagtgttacaggctttgttaatttttcattgtagtacctgttgctggcagagtaacttttcagaattgtaagatttgatataaacctgaattcaaggtaaaatttagtcgttaaactgcacctgaggagattatgtccaaacagcctttatacgtattgcagtgtggaaacttgcaaatataactaggctaaatgtcaaatgccacacgttttaaacttggtaggatagcaaagagcccagttgtacaacaatagtagaaacaaaaaaataaaataaaaataaaaaaagagaatctgtcaaatttggaacaggcgaagttgccacactggtttaagaaatttgctattcttaaaattattcactctctcttgctaatgcaggtctcatcaggaaaaattcagtaaatgcatatggaattgaagaggtttttctacgtatctgtcttttcccctgaaaaataaatgtgtcatgctcatctgtctctctttaaacatttctttaggtgtttttcctttgaaaaatgaaagtgcaggttagataatactacatttgagccatctagtaactcaagcgacaataggaaacaggttccgataggatatttaaaaggtggatttgaatagacaactgctttctatttctggcacagattgtttgggtacgtacgtgttcccaagggcctcaagtctcctatgtaaaaaacatttccgtttggttctcccaaaggtaagtacaatagtgcgaaacatttccgggccagaacatcttctagcatcattgtggtgtccgctttccaaaaagagaggagaacaaaattgcgggggaagaatttggccaaacgagggatctcttcaaaagcggcgaggagaaacgatctcgaacaccgcagcgtcttacacacgacgtataaaaactatggctccccacaactacgcccccaggagactaccgtcatcactcatccca

SEQ ID NO: 651544 - DNA, 435 bp, Homo sapiens
cagtagcccgggtctagaactactcatttcctgtgtgccgtcgaggaatagcccagccaggacctggcaaaatgaggggtactaaacgtgcccatgagtcagatagactgaaatacctctgagtctaggtagatccttacactggataggtagaggcctcctctacagggtcggagaaggccacggcagacatatcttccatgctgtacagacataattcctcagtgtgagccgtgtcccacctcaatacagtctgagtaacagatgagcctttatgagtcagatcagccaagcagtttaacaggctctatagtattcagtgaaacctttatatcccttacggtcctccgatcttcaagaaaggtagaatggactacaggtctattacaaacacacctcaccaagttcaggcaccaaaaaggaccggacaatact

SEQ ID NO: 651545 - DNA, 410 bp, Homo sapiens
  misc_feature (42)..(42): n is a, c, g, or t
  misc_feature (402)..(402): n is a, c, g, or t
  misc_feature (407)..(407): n is a, c, g, or t
gcaggaggatcacttaaggccaagagttcaagaccagcctangcaacatagcgagaccctgtcttcaaaataaaaaataaaaataaaaaagaagaaattattttacaaactagcaccactagaaaatggagtttcatggatgttccagtgatggcagtttgggtataaggtgtttgaccaactgtcagccatatttattttcatgtttttatctgtgtagctattttagatcacttgacttagccacttttccatttaacataaccagccagggctttggacttcctgccaccctcccgcttcatccagagaagttccacttttatttgttttctacattaggcttcttctgaagcttacatttgaaggaaaggctctgctgctttaaaaattcctggccgncgttntct

SEQ ID NO: 651546 - DNA, 796 bp, Homo sapiens
gatcatgccactacactccagcctggcgacagagcgagacttggtttcaaaaaaaaaaaaaaaaaaacttcagtaagtacgtgttatttttttcaataaaattctattacagtttgtcatgttggctggtagtgctcatatttatggtggttttggttttagtactcactggttttcataattatcaatgattactaaacaattgggggaaagggacttctaatcttttttccataatatcttggacacattatttacagaagaaataaatttcttaccttttaattttaaaaaaaaaaaaaaaaaaaaaaaaaaaaaaaaaaaaaaaacaaaaaaaaaaaaaaaaaaaaaaaaaaaaaaaaaaaaaaaaaaaaaaaaaagaaggggcgggggcgcgaacaataatactacaccccgcagggggggaccaatacacagcgacacacccttttatgatataaaaagagagggggcccacaagaggagagggaataaatagatgcacgaagagcggtggagttattataacaaacacgatggtgataaagagaagaaaacacaaccagtaaaggtgagagaagatattaggagaagagaggacacaactaataatgggggtgaggagaaataaataagaggaagaacacacacacacataagaaataaaaaacaacaccgtgatgaataaaaaacactaaataatgagaaaaaaaggatgaaaaaacaagaaaaaataaatatgaaggagaaaacaaagttgaacgaaacaaatatattaggaaaaatatataacagg

SEQ ID NO: 651547 - DNA, 415 bp, Homo sapiens
  misc_feature (285)..(285): n is a, c, g, or t
  misc_feature (335)..(335): n is a, c, g, or t
  misc_feature (362)..(362): n is a, c, g, or t
  misc_feature (367)..(367): n is a, c, g, or t
  misc_feature (402)..(402): n is a, c, g, or t
catgggctcgaaacttgccctcccaagtccagtagtccccctggtctctcacctagaaggagtaaaatccgccttctctttcaagagccaactaggaagtgcagagataacttaaaaagcagttgagattttgccattggatcaaactgacaatgtgcattaagcctctgtttttcctgaaaaggatattgacaaatgaggcgggaagtagccttgactagtccagaggtcaatacagaaagagatgagaggagacatttagcttttactttcaagtggaaaaanacattgagtccccctctgcacccccactttatttgtccctcactttaggntctgaataaatagagagagctctattngtctngttttcttctctggagctagacttgagctgggggnatctaagatgtta

SEQ ID NO: 651548 - DNA, 759 bp, Homo sapiens
agcggaaaggcaatttccgcctgtctgcccgacttccaaaaactacctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaaaagacaaaaaaaaagggctggcgagagaaacgactttgggctatgcttaatgtgtgcactttcccccatgcccccgttcttaaactctttaagaatgccttggagtggctttccatgattcctttgagttacccgatatctggcttacaaaagctttagtctacgtactggtacattcctggtagggttaacgctttaatttctaccacaaaatatgctatatcgctatgtatcaagcttcctggtaatcacgaacgacagggtggccttatatcccaatgtcacggcatacattccctagtggacacttattcagaaagcacagtgtgtccggaaggcttgggacttctgcgggtgaaccaagagaccattcagcaagaacccttgaagtggcacggagcgtgcttaggttctataactctttttaccccccttttccttctcctttcaataatcactatcttgggaactctgcttaacacggaaagcccttaatcgcatgcctatgt

SEQ ID NO: 651549 - DNA, 149 bp, Homo sapiens
gtcatacctctgtttgccctgctagtatgagacccttccaatacgctgtatttccattcctgccctcccagccttagctgtccactctctgcaccagctggcctgggaacttccctccacagcacgtacccctgggcgccactcgctac

SEQ ID NO: 651550 - DNA, 440 bp, Homo sapiens
ggaactctggaagaggatatgaatttgatgtacagtatgtcctcacttaacatctttgaaagtctcttggaaacttcaacttgaagcaaaataatatatagtgaaaccgcttatttttcatcaacagtataactacacaactgtgaacaaccaatgctgttggaggacctcctgtacgttgtttccataaagtcagttttcagggaattccaaaacgaagtgacggacttcgtgtatataaaaagatggtagtgattccacctggatgacagggttattgctcaagaaactaaaagaggccgcctaggtagagaggattctgtcatgaggtttctgctaaacaaaggatcccagaatctcacccattccagttaaaggcataacgaagaaagcaatattcacaaaattagagatttccacattcttgatgatggtgaatt

SEQ ID NO: 651551 - DNA, 182 bp, Homo sapiens
ttgggggcccccccccccccccaacttcagttggaaatcaagggggggggtttccaagggggccatttttttttaaatagggaaacctttttgggggttccttcaagccccctcttttccccccatttttttttttttttaattgggggaaagggaattttttttattctttggccaaacca

SEQ ID NO: 651552 - DNA, 113 bp, Homo sapiens
taacgagcgcacttggtccagtcaggggctgttacggaggggctgtacggaggcgtcgtaggcagggtcgtaaggaggcgctgttacggacgtgtaagagagggtgttacgga

SEQ ID NO: 651553 - DNA, 125 bp, Homo sapiens
caaggaattttggaaaagcctttccaaaaattcgttcttgggaaggccttcggctgctgccccccaaattataaagtggctattaaagggtttaaataaagaggttttattttttaaaagggaaa

SEQ ID NO: 651554 - DNA, 542 bp, Homo sapiens
tctattaataaatataaataaataagccttccctgagtgaccaagagcatggaacaacaaagtatataaagccacaaggccaaaaggaggcagaatgtctttccaggaagtaaccccacaaacagaatcttctttacatatcactggacccctttcatttgaccccacctcttacctctctttgagcagtatagggatttcaactctgtgtgtgtgtgtgtgtgtgtgtgtgtgtgtgtgtgtgtgtggtgtgtgattctcccgtggtctatctgtgtgctgtgctctctcttccttcatgagttgtgttacttacatatcgtggcactcctccagcgttctctggggtgtgaagatatttaataaactaattgtgtttttgtggttcacactcttcgtgaggcccagctcccggtacgctctcttggtgtgtgtgtggctctgaaagggtctgctgcgcttcttagtggacatatttctgtcagggacagtctcatgcgcggcacaatctatgccctgcgccccagagcctataggcttaa

SEQ ID NO: 651555 - DNA, 272 bp, Homo sapiens
aggcacagcccttagagagaaacagatcagagaagggaattacggaggcaggcctcagggctgcatcctcgggcacaattatgttaacaaggtaaattagccccagataaaccggtacctaataaactggggcagctggtgcctggagccctcactaggaaggacttcaaagtccatagcccagtcttcagagttagtggtctcctgcggtggactccaggcctgtccatgggcggcaggccaaggaagggcctgaatatcgcctcccagga

SEQ ID NO: 651556 - DNA, 335 bp, Homo sapiens
  misc_feature (61)..(61): n is a, c, g, or t
  misc_feature (92)..(92): n is a, c, g, or t
  misc_feature (127)..(127): n is a, c, g, or t
  misc_feature (171)..(171): n is a, c, g, or t
  misc_feature (200)..(200): n is a, c, g, or t
  misc_feature (215)..(215): n is a, c, g, or t
  misc_feature (225)..(225): n is a, c, g, or t
  misc_feature (332)..(332): n is a, c, g, or t
caggaatcctcatcaggatttcagacagataagtctgataattcaagtagtagaactctanccacttggctaaagttcaaaggcattcccantcccagggaatggggaattgaaaggagcaggaaanacgttcatttggccgggcgcagttgctcatatctgtaatcctanctttttgggaggctgaggtgggcagatcnccagaggtcaggaantcgagaccancctggcccacatggcgaaaccttgtctctactaaaaatacacaaattagccgggtgtggtgcacacgcctgtaatatcagctactcgggaggctgaggcaggagaantcc

SEQ ID NO: 651557 - DNA, 911 bp, Homo sapiens
  misc_feature (365)..(365): n is a, c, g, or t
  misc_feature (385)..(385): n is a, c, g, or t
  misc_feature (387)..(391): n is a, c, g, or t
  misc_feature (403)..(403): n is a, c, g, or t
  misc_feature (411)..(416): n is a, c, g, or t
  misc_feature (420)..(423): n is a, c, g, or t
  misc_feature (425)..(427): n is a, c, g, or t
  misc_feature (505)..(505): n is a, c, g, or t
  misc_feature (760)..(760): n is a, c, g, or t
  misc_feature (778)..(778): n is a, c, g, or t
  misc_feature (787)..(787): n is a, c, g, or t
  misc_feature (902)..(902): n is a, c, g, or t
ccaccccagctgctgctgccacactcgcgggcgctgcccggtaatggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctcngcttccctcggctcccgctngnnnnncccgggacctcnccccctcnnnnnnaaannnnannncggaggccgggctggacgcgacccagagcctccgccacccgcttctgccactcaatggaggacggtctgctggagatnatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatnaccactgcgccccgccangcggccttnggcgtggtcggcggcaaggggagcttccagagcgacccccaagagccggagactccttcgcctgggatcggggacagcggcttgctgggtcgcgatcccgaggacgaggaggaanaggaaaaga

SEQ ID NO: 651558 - DNA, 213 bp, Homo sapiens
  misc_feature (20)..(20): n is a, c, g, or t
  misc_feature (22)..(22): n is a, c, g, or t
  misc_feature (148)..(148): n is a, c, g, or t
  misc_feature (168)..(168): n is a, c, g, or t
  misc_feature (197)..(197): n is a, c, g, or t
ctgggattccctcgccctcngnttccagaatccaatttcttggatttcagtgtttttaaggtgggaggtctcgctatgcttcccaggctggactcaaattcctgggctcaagtgattcccccgcctcagcctcctgagtagctgggangactacagatatggcaatgncagcctggggggtctaaccagaggaaganatcctggagctgggtg

SEQ ID NO: 651559 - DNA, 516 bp, Homo sapiens
gctcgaccacagggctagtgagaggcagggcttggctttgaacccagatatcctagacatgtcccccaactccttggtgctgctctctggctcattttgatctcccttgtctgtcatctggagagattcctccaagcctgccatccacactctcttctaaacatcatcccaccaactccttcccaggagcccggtgctatctgcacaaggaatgctcacaacaaagaaacctgcattggccgggcaggcgtgttggctcacgcctgtaatcccagcactttgggaggctgaggcgacagatcacctgaggtcaggagttcgagaccagcctgaccaacatggagaaaccccatctctactaaaaatacaaaattagccgtgcgggatggcccatgcctgtaatcccagctactcctacttgggaggctgaggcaggagaatcacttgaacctgggaggtggaggttgcagtgagccgagatcacatagcctgggccataagaggcaaactccatct

SEQ ID NO: 651560 - DNA, 427 bp, Homo sapiens
tactatcccttggcctaattctcttccttctctgaaatcaagccaaacaaacactctgcttgaccgtgcttatctgtgtggtctatttgtcatataaatatttgccaatgcaatatttctctcattgagacttctcaggcagactgtttagatggatgaattgagggctcatgttgtgtccattttcttgacatcttagccatttttattttgccttcagactttcaactgaaactgcactagcatcttaaatatctcttattttccctagctttttttttcactctcatccctctcctgctcaactctctgcccttctggtttctgttttcttggctgcctcctccatagtcccatcctctgatagggttattctccactctttctactttcctgcacattttccatttgaatattttatttattt

SEQ ID NO: 651561 - DNA, 1178 bp, Homo sapiens
gccggtgttttgcagtcctgggcaggctcggcagtccacgccctggccctgggtcatggtggtgggcctgagtggctgctctggcctgctgcagcctcgcctggagctgggagccgcctgctgccctgccgaggcctcgagtccagccctgctgggagttatctgccacacagatttgcggaagaacctgaccgtggacgagggcaccatgaaggtagaggtgctgctgccctgaccgacaactacatgtacctggtcattgatgatgagaccaaggaggctgcattgtggatccggtgcagcccagacggtcgtggacgcggcgagaaaagcactggggtgaaacctgaacacagtgcatcaccaccgacaacactgggaccatgctgcggcgacatgagaaacctggtcaagctggagtcgcgcactgaaggtgtaccgggcgtgacgacggtatcggggccctgacgtcagcaagatcacgtcagcttgttccacactggcaggtggcgtctcgtgaacggtcaagtgcatggagaacccgtgacaccaagttcaggacacacatatgtcactacgtggagcaagcccgggaggctcggaggacaccaataacgtagatcaacacggtgaacaaccttggtaggctggctggactcaggggaacggatatatgaaagggagcctgcggatgaagagtgtgtaaagcttcatgacgggagggtatatggggcggcatgccccgggagacgaagagtctactaggtggaccaagaagggatcgagcatccaacaaaccgatacagggtctaggaacggccaagagtggaagaccgggaaacaaggcaggacagcccggcgaagacaagccgagcagcggccgcaaaaggcagacagtaccagaatcgggccaagacccaaaagaggacaaagcaaacccgggaaagaagaaagacccgcgcacaaaaagcccaatacagtaagaagaagaaggacgaacaacacgaagaagcgaaaaaaagagacgacagacggagacaagaggaagcaaagaagcggagaggcggcgaaggaggaaaaggacaggagaaagacagccggagagaagaagcgcccaagacagaacaggaaacggcgacaagacacgcacagaacggaaagccggcagccagggaaca

SEQ ID NO: 651562 - DNA, 123 bp, Homo sapiens
ggctggtccgttttgggctgtcgtgctatgttgcccaggcggttcgaactcctggcctcatgggaacctctgtctcagcctcagcactggcaacacaggcctgcgttggcacgacagccaaaa

SEQ ID NO: 651563 - DNA, 674 bp, Homo sapiens
aataacctacgtaatgcctaatccaaggttcccaaatcagcccgcacaatccaaagggggaggggatatttacgggagttaggctaagtgtgggtgagactgccgggttatggggtgggtcggaggggttctatacctttggtcgacagtactattagaggtgtaagctccgctcttcgctgtgttcgcgacagttcgagcttagacggcggtgacgattttgaccctagtagaagggaagaggctgggatgcggagtattatgcctcgaacattattgagtcgatgtttgtctgtagctagcccttctcatacgcgagcaattagcgctagggttactggacgctatacgtgtgacctccctaatataaccttagcgctcaaggagcgaggttaacgctacctagagagagcatgtagagctctaacctcgagcgtacgataagggattcagcaggctctgacgttctccgtccgcagacttacgattgttcttaagagtcggttagcgactacgagtctaattccggtttttggtaagtttttggggagcctcagtaggatcgaagtgaatattcttgggcgcttacgtagtttttctaggacttcttcgtgttagcggggaggagaggtgtctttgtcggcttcgaagatttttaatagcgagtggtgatg

SEQ ID NO: 651564 - DNA, 134 bp, Homo sapiens
agcgagaatggcattaggactaggaagcggataggaaaatgattataaaggcgtgatcataaaggtgatagctcatctatataggggaagtagcgtcttgtagacctacttgcgctgatatgccattcttgctg

SEQ ID NO: 651565 - DNA, 630 bp, Homo sapiens
ttcgatattccgacatgactcaggatatgaaggttcatcagtcaaaaatcggtgttctatgcagaaggtgtgggttcaaacaaaggtgcaagtcatggactcatggtgggcggtgttgtcatagctatagtgagagtcatcaccttggtgacgctgaataagaaacagtacacatccattcatcatggtgtggtggaggtggacgccgctgtcaccgcagaggagcgccacctgtccaagatgcagcggaacggctacgaaaatccaacctacaagttctttgagcagatgcagaactagacccccgccacagcagcctctgaagttggacagcaaaacctttgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacataggcccttagccagttgtca

SEQ ID NO: 651566 - DNA, 445 bp, Homo sapiens
tatataactttaaaagaagtagaagatttttggagatttataattacattcaaagtatacttttttcttgaaaaaaattacagatttttcgaaaagcaattgatgtaatctaactctcaaattcatgttcttcttcattcctattatattcacatgtgaaagcaagtgatctgttgttgctgaatcagagatatgagagattctcttttctaggtgggcattacttctgcccctttctgtcgcgacgtcagaaacttaaaatacacgctgcatgaggaaaatgtacacatcctctttgcgattaactcacaacatcaagtcctacttgacgcacctgctcagctgaacattctctgccactatactgagaaaacaccatcttcaaaatctaattatcctcttcttcattgtgcttttatctcatcaaactgcactactttaacac

SEQ ID NO: 651567 - DNA, 1580 bp, Homo sapiens
gtccttggcgtctctcgtgctcttggttggtcccgctcctgtcgcgttgtgcgtatctcgctgctcgccttttcgtcgctgtggttgtcgtgtcggcgcttgctcactctggtctctttgagcgtgtgttcgtcgtcccgtgttgctcgcagttcggtggtagcctcttgctgtgtctcgtttggtggtgtggtcgactgtggtctccgtgctcctcttttgctcctcgcggtttgtttggtcgtgtttccctctttgtccgcagtgttgttgactgtatcggggcacgcccccgggactcctctatattgacttctctctgggttcctctgtttagcccctgtcttgggtctctcctcgtttgcgttggtagtcgtgtttcctctcgctggctcccgctccgtggtccactgttgcatgctttctcgtgtctttgtgtccccctgtgttctatcctttctgcgcccgtgcccttggccgcgtgccctggagagtctcttggggcgtggcttccggccgtctgcgtcttccgtcgcaaggggggttccccgtcttgttcgtggcctctccgctggtggcgtgtctaggcgcttttcctggttctctgcgtgtatgcgcttgttcgttcaccgctgtttgtcttgtggttcacggggtttccctcggcgctcatggctgtgaccccccccagggttccgagggtttgcgccttgcttggtcttgcggtgggctcctatcgtaggccctcgacgtgctcccatgcctagcttgttgtcctcgggttccgctcgtggcgggtccctgtgttttttttgccttcgtgtttttgtcgggttcggcttgcccgctttctgcggggaccgtttcctcccagttgcccagggcgctggggcgacgtgcctctgatgcgtaccgtccaccgtgactcgtcttgggcatcccgcgtgtgcgggtgtttgccatgtgggggtcgtccgcttgcccgtgggtcgtgccgcgggtctcgcaccagcgatcccttggtgtcgcgcctactaggtgcccttcctttgagattcccgcgtcaccccacgcagtcgtccaccgcgagtgaagttgctgaaatcccgagaaggcactgcagttttcgtggggggcgtgacaaccctgcgaagcagaaggcgactcattacgccccctccggccgagcggactatgagagattctgcgtgcgtggttccatataactcgtctcgtcccatgtgctgctgcggcagcgctggcgcattggtcactctataggccctctggaccatctctatagtcagcctagtcacaaggcagtagcctggcgcgcagcgcgcagggcctagcgcaatgctttggcggacaccgtagcgtagactgccgccccacccccaccatggtgctattcctggggctcggggtcagtcttttcctggcttgcctctgaccagctcctggcctctggtagagtgaaactttcagaccgttctgattgccttccgaatgtcatctctaccctgccgccaggaattggaagatgtcgagcacttctaagttaaactgctggagctcgg

SEQ ID NO: 651568 - DNA, 730 bp, Homo sapiens
ggaggagagagaactagtctcgacgttttttttattctttaggcttataaatctattaaattgctcaaactgtgctaaaaaatacttcccatgaaatacatatattacataaggtctcagttacaaaatggattgttctcaaatggcaatttcttacactaacctgattatgaaaaaaaaaagtctgtatcatctgcttccaaggtctgtttattgtccaaatattatttcaaattatgctattaatttggctaacttttataacttattagagatttcaccttaaattcatttttgtaaacctacgttcctaagaaccatttgtttcccgccatttacttactttctcctaatctaggacgacctctatctacatttagaccctagtgttatactgcactactaatcgtttcttctacaccagttagacaacctttttctataaaaacagacactacgtacaaccacaacattgcgagaacgctcgtaggtctcctcccaaaggactacaaggttacaaaacaatcaaaaaaaaaacaaaaaaggccggggggaggaaagtatgccgaagagacaaatctttttcttataagaccactctcctcgagatatataacaccactctcttggagaaagtatctctaaattcttctccccccccctttgtatcataacatgtggatccaccatggctcaaacaaacacgttgtgtttcccccaaaaggaagaa

SEQ ID NO: 651569 - DNA, 293 bp, Homo sapiens
  misc_feature (243)..(243): n is a, c, g, or t
ggagagtatatctctgaaccccaaaagtggatgaatacttttcagtccacaaatggaatcagtgaccccacgtaatacatcaaacaccttttacaaaaagaagaggcaggagaacaaaatgattttgttaacattggtgcaaagaatgatacttttcatggtgggaatactaggaatactctcttgcttcttggtctaacaaatctttaaaatgaggaacccctattagggggtggccattcnaattatttgagttaaatgaacttgagcagtttatctagagcagtgtttag

SEQ ID NO: 651570 - DNA, 236 bp, Homo sapiens
gggaggggggccccaaatttttttccccccacatttttggttttttgggtggggggggggcagggaaatttaagttgtggggtgaaaggggaggaaaaaagcggggggtgggggggttgggttttagcccccccaaattatcccagggtccccggccccccttttccccccccccatgcccccaattttgggggggatccagattgtgaaaatgtacaataaatgggtaatgggta

SEQ ID NO: 651571 - DNA, 621 bp, Homo sapiens
  misc_feature (165)..(165): n is a, c, g, or t
  misc_feature (489)..(489): n is a, c, g, or t
  misc_feature (567)..(567): n is a, c, g, or t
tgagttgagactctaatgggaatgaaagtagtagccatattccagctaaataagttaaatgcatttggggaataaagaaaaaagagtaagcaagcaataattgcttgaatatttttcaaattacaacaaaaaaaaatactttcttaggacattttgtattaaatngtgcaggataaaaaggtatccttacaatgtttccaggaggcaagaatattatcgtccctggcttgctagtcaggaattgaaacactgggaaagttaagtaactgaaaagtgactaaaattcagatatttgaattctcaaatgagtaccacattaaatagaatatattacctctttcaacaggcacattttcctttataggagagattgcaattacaagtgaaatttcagtatatttttcagtagattacacacacaaacgctaaccatatttaaatgcattctgcctttcaacttcacttcctttcagtatatattaccattangaaaaagacttttatatcctcactgttcttaatttaaagcaccagcagtaatatgggaagctatgctgaaaaccgctnttttgaataatgtgaaataaataaaatgcaatatttcattcaacacaaaaaaaa

SEQ ID NO: 651572 - DNA, 1024 bp, Homo sapiens
  misc_feature (457)..(457): n is a, c, g, or t
taacttcacagaaaacacttttttaatttaagggtagcattcacccaaaaggcaacgggggttggtaaatattcccgggtccatatatatatttgtggcacattttcctttagtgggctaagtttctctctcctcagtgggtcgtgggggaagtttctataaataatatgtgggggatattaactcttttccatctcgtgtgctcgtggtgtaccaaaataactctcgtgccatagtgggtgtgctctgtgccacacatttattgtggggtgcgtcttttatagtaaaacacaagaggtgtttatgtgtgtggtatgtgtggtagtgtggttgtgtggttaatagtgtgggtaacagacatattttatacacatcttttataaagtggagagagtgtgaatattctttctctctctcaatctcacacacgctttggtgagagaacaataacagctgngggagtgtgcgacacattcttataacaaaaaaaacacacaaagagagcgggggcgcgcgcgcgcctctagagagagaatactaccccgcgagaggggcgccccccaacgacgtcatttaccgcgcgcgctattcccgcgacgcgcaacttctcgctgtggtggtaccacagagagggtgggtctccccctaaaaaatgcagagagagcgacgctgcgcatcaaatcatataatacacgcgcgacatagaggccccaccgtggggcccccgcgcccgcgctataaatcaacccaaccgctctgcgcgaagacacgcgggcgggcaaaacaacctgcggtcgcacaagcccaggtggggggagaaaccccccttctgtgtgcgaacacaagaggcaacactcctcatcacactctcctcctggggaggtggggaggcggtgtcggcaacccactaataacctagtgggggggcgaccaccaccacacacaacccccgaccaccagaaggacaagacatactttcaacgacccggcctcctctatcgaaggaggcggacaaactcgatat

SEQ ID NO: 651573 - DNA, 427 bp, Homo sapiens
  misc_feature (60)..(60): n is a, c, g, or t
caatcccagcactttgggaggccacagcaggtggaccgcttgagcgccggagtttgaacnccgcctacacaaagtggtgaacctccatctctacaaaaaacacacacaaaaaaaattagctgggcatggtcgcatatgcctgtactcctagctactagggagcctgaggcagggtcaaagctgaagtgagccctcgactgcaccctgcagctactcgctggctgacagagcacgactccgccacaaaaggacaagacaaaaagaaacttccagcaccactcaatttgccaaataaatttgcctgactgccaaaactgaagctgccaacccaatcgacaatgttaagctcggccctaggacagcccttttaacaaaagcttccatgtacacaacccaactaaaggtcaccctagaacgtaaaaaaaaa

SEQ ID NO: 651574 - DNA, 1213 bp, Homo sapiens
gcgtgggctgagcgcgcggcgcgagcgtcacgccatgacagtggcccgctgcgccttctcctcgtgctgtcatgccgcctgtcgctgcctccacagaacctccgtcgtgcccatcggcgtgccagcgcccgtcggtcggacgaaaattccgcgtgttcacacgcattgtctcgcctcaggcccccgtggctgcgcgatgggggcagggaaccctccacccagtcccgctgtccgagacaagaacccgaaatgcccggtcccagagaggagagcgaggaggaagaggacgaggacgacgaggaggaggaggagcgaggacaaaagcaaaagagtctcaatccgtggcaaggcacagcagggcaacaaccaacacccagtcagagcacgcttcgcacaatagcaagtctcttccttacagagcagagccatttacaattgcacaaggaccggggcagaaactttgtgacaattgagcaggatacatttgttttctaagtaagacagaaaaccgatgcaactttagcaaatctacagcaaactgctttacaacaggccaggcactgtgtcctcattaacagacagactgtgggtcagttcagtggctttccatttgaaaccagggaagtgttccaatattcacaacagcacggacacgaccatgttcgcaccaactttagaaaatgccatgttcaaagagcctctggtgaaggttcttcgattcggccacatcacggtgtaaatagtgacctagtgcacgcagcaccttgaacttacataaactgggaatcccaaaagccattctttgcgcaaacaccattcgccgcaccatcttacacaagccttctttacgacacaacggcacggacaacacggacaacgtcaacacagcctctcgagcatggggcaacgaccaagagggctaaacagcaaaaccacgaagattgctctggacaaaacaccgccccgccatcaacactatgaccagtgagcagaaaccaagtacattcacaccaacccagggggacgaattccaccacaccaatgccaccataaacaacacagaaggggacccacccaacaaccagaaccgaccagcagagcacacaacaaaccacgagcaacacacgaacagcagagaagacagctcaaaaagacaacgcaccacccacacacacaagacacacacgaagatcagacgcaaatagaaaacatc

SEQ ID NO: 651575 - DNA, 310 bp, Homo sapiens
  misc_feature (291)..(291): n is a, c, g, or t
cacctaataattatgctgctgaatataatacttggaggagagagtgtgctcagaacttagacgggcattgggtaggccaagtatgctaagtgtacaatatattttttaatttttacacctgaaacaaagaaatgtgttcactaaaaataaaagtatatctttcggaattaatgtactcttgctttgtccaagctgtaggctatagtttccaaggtataatgttactctaatctctaaaaagtgcatgtatctggatagcaatgtagtatttcaaataaaggcatttacatnataaatttagggttagatg

SEQ ID NO: 651576 - DNA, 426 bp, Homo sapiens
tttgcagccagaatctagcaggatcccacatcgctatatcaaaagtgcgaggaatgaaggaaataagtctgactggctttctgtcctgtaccattgattcaatgacagactggcgggaggacaatggaagactagggttggagatcggatgggtggggcaagggatggaaaggaaaaggcagactactaatgcgttccatttataacaagtcatatatctcaaagacttaaaggagattaaagaccaatcagaataattaggcaactttaattcttaggaagatcaaagttccctccgaacctcctttgatgtctcattactaaaagcaaagaccagtatggtacagtattactccagagaaatttacggaacatccttcgggcggcttcacccacattcatttcatgcatggatacctcccctgt

SEQ ID NO: 651577 - DNA, 216 bp, Homo sapiens
ctgtgtagagcttgtgaggtgtttcattcctttctcatcttcatgagtttgtctcattttgatctttgaggctgctgacctttagatgaggttttcatggggactttggttgatgttgttgttgctttctgttttcctttgaacagtcaggcacctcttccgtagggctgctgcggtttgctggggattcacttcaagccctacttatctgggtcc

SEQ ID NO: 651578 - DNA, 1092 bp, Homo sapiens
gtatgatgtcataatttaatctgttcatatttaactttgtgtgtggtctgcaaaataaacagcaggacagaacatcgtgttgtatggttctttgaaatacaaccaaattctcttaaaatgattggtaggaaatgaggtaaagtacttcagttcctcaatgtgccatagaaagatggggtggtttcccaaagtttaacgttctagatcacaatatcttagcttttagcactatgggtaatttcagagtaggcccaaaggtgatatgactcccatggtccctttatttaggatatggaaagaacaaataaactttatgtattacgtgtcctttaaaaatagacttggctaacttactagtaccagagttatctcaacagaaaaacactagtgtccaactttcattccaaaacagatgtagaaacgacgaatcaggcatcaaattaacttcatacagcctaaagcaaagttacgatctgggggttattcagccaaacattaccgattaagaccagactgactagactacactgatacaacatgtactggataactgccacatcctatatgggtgtcatacgacaatagtgcaagggaacagtacatattgtatggctggtcttccacttcggtaccttcttcccattctggaatcctgtaccaacaagactctcctggaacattcaaaggctcactacattggtgccacgtaaactatggtcacgggcccagtccccaaaaaggggccggacgtgacgtccgtaaaataccgggtgtaaggcaagcgacactatgggggccacgggcgcaggggggacaacagctacaccgttcaagcttacgggtgaacctctataaagaaacccctgttgggtgaaagaagaaaccacacagcacgacaaacacggcgccgcgcgcccgccacccccagaaagtacatacaaaccaaacgggtcgcgcccaccagacagagcagatgagcatgcacaccaacaaaccgcctaacacacgagggggcacaccacaaaaacagggcgcgacggcataaaacaccaaccggcgtgttacatcacaccacacgacgtcacggcagag

SEQ ID NO: 651579 - DNA, 1078 bp, Homo sapiens
gtcgatggcgcgttcctacagcgagaagcacctgggtgtggcgccgcggggctgtgaacgacttctcctgcaaggtcaagcccggcgatcgaccgtgtcatccatgcattccctggtactgttcgggccaatgcgattcgccaacatggttccttcgtacgcgaccccgatctggtccctatgagcgggatacttgatgtctacacctttcacacactcaatggtctcccgatggtggtcatcctctgacgatggctgggggcgttcaaccaggctgacgcgctgccgtcgccttcctgctggcatgtgcgtcctgtgtgatgccctttgatggactcagggctcccggagaaccgcgaccgtggcgtcttgcacgacatgggtcgaccgttctgtcgtgagcatgttcgccaggggtggctgggcagtccctgcccggagacggtccttatcaattcaacgaatgtcattgtgcctgtgacgctgtttcgcaaaaggttccgatcaagatgctttgaattcggtggagctggagttgggtcccgctcatagccaacgggcaaccaacccgtcccggtcgcggctccgtcgtagcataagtcgttgggtcggaactgggcccttgtgccactgaaggggcttggttgcacaaggcggactttttcccctttaaggcagcggttgggacaggccttaccgaagcgcgatcaaaaccaattgtgtatggggccccatagcggagtcccaagtccaggtccttccacaagcgggggaacttccacaggcgcgttggcactggtcggaaaccgaggcgtgtttttaacccccgggtgggaccggcgagcgaaatcacagcccggttcctcccccgggcgctttacttccggcccccttaacaagcgccgggttccaaattcgttaccccaagccccgcggggaccttgccggaaccgaggccggaagccgaggcttccaacgggatacgcccgttaaacaatccggccaaaaggggcccctttttcctttcccaaaggcggggccgaccccaaaaggaaaatccaattgaacccggttgatc

SEQ ID NO: 651580 - DNA, 247 bp, Homo sapiens
gtctgtgattatcattctagcaaagcacaaatctcaaaatgatccgtactgacttctaccgtaatcttcatggcttcccagaaaagagtccaacagtactatgtaacaaagatctaatagctaacagctaacgaattgtacaactcttccctcttaactttttacttggaccgtaactccttccagttgaggtaaaaagtcttggacagactcagcagtgtggaggatagtgaccccaacttcacag

SEQ ID NO: 651581 - DNA, 150 bp, Homo sapiens
ctgatctagaggatcttttgcggctgctttcaaggcctgccgatgggtctgattctcaggtctggggtgggctcaaaagtatggagattttctcgtttgtttctgtttttttgagacagtttcactctgttgcccaggctacagtgcagt

SEQ ID NO: 651582 - DNA, 308 bp, Homo sapiens
actagatctattccgtctctgctggggcttgctctggagcaactccagctcgagggtggagtggaaagcttgccacaggcttgtatgtggaggcgctctgctgatagcacaagcgctctgtgtggccgaggtcattgtacccccggcttcctgctgggtggttctgtgatggggaaccagctggggccttatggcattagaatctggtggccatgagggacaatgtccaagaagatcaaattagacacaaactgtctgggaactaaactatcctacaaatagaccacaaacaggcagcaaaaggacca

SEQ ID NO: 651583 - DNA, 394 bp, Homo sapiens
  misc_feature (54)..(54): n is a, c, g, or t
  misc_feature (61)..(61): n is a, c, g, or t
  misc_feature (114)..(114): n is a, c, g, or t
  misc_feature (365)..(365): n is a, c, g, or t
  misc_feature (389)..(389): n is a, c, g, or t
gaaccctacgctgcggtaagatgtagcaggggttgctcccagcagcggccgccncaaggcntgcaactggcaataatcactattgatttaaagctttatttagtctcatctgtnccttcatagttaataaggtcttgccacattttattagtgagattgagagatgaattatttgtctgttgtcctccccgccttccctcccccaatattaaactgtgaagtttgtgattttgtttaaacgctgggtgaatcatagtgttagtttgcatgtccagctaatttgtttctatacattttgtttgattctctttctcctcagggcttttacaaatatatatatattatatatgtatatatatatggancttctgaaaaaaattgagggtgcnaattt

SEQ ID NO: 651584 - DNA, 101 bp, Homo sapiens
ggagtttgtgccgtcgaccacttaggtcaggcaatttgcgtcgaccatcaggtcaggagtttgcgtcgaccatcacgtcaggagtttgcgtcgaccaccag

SEQ ID NO: 651585 - DNA, 664 bp, Homo sapiens
  misc_feature (512)..(512): n is a, c, g, or t
taacccctctttagtttaatgcgctcaaaaaccaatttaaacccccccccccaggtaaagggggggcggggacaaaagcaaaaaggcaaaagccgcttgggaaaccaccaggttcggtgcccccggccatttaattcgccctgttagtgggatttggggttttcacattcgtgctccccgtgtggcttggggttggagttggaggggtttggacgcccctcctgtgggggcgcactgggccactgtgagcccccttgggaaaaagtctcagaggggagtgtggaagagaggccatgtgtccggccgtggatctcgcgtggaggaaccaggcggggtgtggtctcccccagagaaagattcccttgagagggcgcggaaagcgtggggcggagtttgcgagcaacgagaggactccctcacctacgaggtgtgtctacgagagagagggggtgttcctcgagaagagggcccaacgagggagaaggggcgagccctcccgtgagctgtggccntcagagagagtccgtggccgcggagaggggaaaagaggccggataaagacgcgctgtgcgtgttaacaaccggaagaggggttcccccacaaaaggatgtgggggacagggtgtgggcccgaccttctccgaaaacatgtggaagggaaacc

SEQ ID NO: 651586 - DNA, 377 bp, Homo sapiens
gcagaacagacatttctcagaagaatacgtacaactgccaacaggttcgtgagaaatactcagcgtcactaatcattagggaattgcaaattagaaggcgcaatgagatgccacccctcatctgttagaatggccattaacacgaatattaaagacaagcgttggcgaggatgtgcagaaaggggaagccttgtgcactgttgatgggaatgtaaattggcacagccatcatagaaaacagtatgggagtccctcgtaaaaactaaaacgagaactaccatatgatccaacaatctcgcttctccatatatacccagaggaactgaaataaaattgttaaagggatacctgcagtcctgtgttcggttgagcggaga

SEQ ID NO: 651587 - DNA, 330 bp, Homo sapiens
caagtatggaaaatcccggcaattctggacttgtgttaaactgatgtgatgaaattagacctaatcccagtggaagcttttaagcctatactttttaccaaaagctttaagggtttggttaaaaaatttccccaaagccctgagattctaaaaaaattgatgccccccaattggattcagaggaacctttaaacatggttttaacccttgttttggagggtatattacgtgcccattcctttaaggggagcagccggcacttttttgtaaattacttttgggggaaattttttgaaaatgattaaacggaataaaattgttaaaacctta

SEQ ID NO: 651588 - DNA, 923 bp, Homo sapiens
ggtcaggcgcatcttctttgcgtcgccggccgagccagatcgctcagacagcatggggaaggtgaaggtcggagtcaacggattatggtcgtatgggcgccgggtcacgcgagggctgcttttaacgtctggtaaagtggatatgttgccatcaatgaccccttcattgaactcaactacatggtttacatgttccaatatgattccatccatggcaaattccatgggcaccgtcaatggcttgaagaacgggaagcttgtacatcatagggaaatgcccatacaccatctatccaggagcgagatccctgccaagaatcaagtggggcgatgcatggcgctagagtacgtcgtggagtccagctgggcgtcttcaccaccatggcagaatggctggggctcatttgcaggggggagccaaaagggtcatcatctctgaccccctctgctgatgcccccatgttgccgtcatgggtgtgaagccatgagaagtatgacaacagactcgagatcatcagcaatgcctcctgcagcaccaactgcttagcgacccctggccaaggtcatccatgagcagctttggtatcgtggaaggactcatgatcacagtccagtgacatgacgtgcacccagaagactgtggatggccctcgggaaacgtgtggggtgatggacgaggggtctccagaacatcatgccgtgcttcgactgggactgcaaggccgtgggcgagtcatcctgagctgaagggaagctcaactggcatggccttccgtgaccagtggcaacgtgcagggggacctgtactggcgtagaaaactggcatatgtggctcagaagggggacacgcgtgaggcctcaggactgggtaagagaccgggtcttgacaaaggaccacccactgaaggggggtgccaaaacag

SEQ ID NO: 651589 - DNA, 141 bp, Homo sapiens
ctgtgagcgtgagactttccatctcggtggtatcaaagtccccagctacaaaaataatcaacacatagtaggtgctcattagatttcagttgacttgaacattcacttgctgtttctgaatgtcaagagaagagacgacag

SEQ ID NO: 651590 - DNA, 384 bp, Homo sapiens
gtcatagttgttgtggtcagttatatcttcaaataatcgtgtatcatgagcattcaaagctccatagtgacccatgctctcggtaggcatgtgattgtcttctgaaatgttcccttctctgatagcatcatctcatccttttagtgcctggtgaagactagtcttgccggaacaattcactgcagaagcctttacttaaaggacttgcaggctggacaactgccgtgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctca

SEQ ID NO: 651591 - DNA, 197 bp, Homo sapiens
attcgcggccgcgtcgaccactgggtggcaccggacgccaatgacacgtgccgtgggcagatgagggctggagggaagcctctgggctggatggggggttattgccatccccccactggcttggctggattgtaacctgcatcttacatttgccctgtgacgggttagcatcttagcactacaaagggggggaaagc

SEQ ID NO: 651592 - DNA, 384 bp, Homo sapiens
tctgcttctccccgcaaaccataacccaataccgtcccccaaaatataactattaacaacactactttaactaccggggattctatctcctctgtggacgatccacattcctcttctaccaatccagatgcctccgaggtcccaccctcatcaagggacgattccctcccatctgacaagttggacaaggacgaggccggaggtgatatcgtctacgctcgtcctcatcctctctccctccattctcagtcttcgaatacaacaaatacgcccctttgcggtatagcccccgtggctaataatccccttgatcagtcaacggtttcggaggctaatactacccataatgatacttcttctaataatgtttacgtacccgacact

SEQ ID NO: 651593 - DNA, 238 bp, Homo sapiens
gaaaggaggttcaggctttttggaggcggaggctttggtccagacgtagaagatgttgcagggggcggaggttgaagcagagacggaggcggaaaatcctcggaagatgtggcattaccaccgtgcccagttcatggagtggtgagagatgttaccctctcagggattgtcgggcggagatcccacccttcgccgtgtgaggtgctgccatgaggactagcagtggcgtctgcggccg

SEQ ID NO: 651594 - DNA, 101 bp, Homo sapiens
  misc_feature (10)..(10): n is a, c, g, or t
atgtctctcnctacctgtaattacatattctccttgtcccaaatgcaagggtttactctcaagagactctaggctcactgcccataaacctttgagttgga

SEQ ID NO: 651595 - DNA, 342 bp, Homo sapiens
  misc_feature (2)..(2): n is a, c, g, or t
  misc_feature (4)..(4): n is a, c, g, or t
  misc_feature (137)..(137): n is a, c, g, or t
  misc_feature (143)..(143): n is a, c, g, or t
  misc_feature (182)..(182): n is a, c, g, or t
  misc_feature (198)..(198): n is a, c, g, or t
  misc_feature (335)..(335): n is a, c, g, or t
  misc_feature (337)..(337): n is a, c, g, or t
gngnctgggaaggggcccacagaagatgggccacacccagcatcatctcctctctgtggtgcgccctcccatccccagacccctttcccattcaggggagaggccccccgccccttgattctgtcctgttacctccngagcgnggaaacccaggaggttagttgtgctctcctgcaggcctntcaacctgcaaagggnagagccacagcagaacgcgttggggccacagacactcgctcaggtgaagacactgagaagacactgccgcgctgacaggacccccgcggcggggggacggtggtggtaacaggactttttgcaggcccaggggaggntntggcc

SEQ ID NO: 651596 - DNA, 202 bp, Homo sapiens
agatcaaagcagtgccccgggttacaggagctgggccatggctgtgccgctctggtcaccaatggcaggtcgccctgtcagtgcagtccccaggtgattgcctacaccaatgaaggagctcatagaagtgtgcccggaagagtctctgagtaaggtctcccacgtcctggactgcgcttcctaggtctgggtacatcgtggt

SEQ ID NO: 651597 - DNA, 163 bp, Homo sapiens
taaatgtatggttataccttagtctaaaaaggcaccatgcaggcatttaagatctgaaccagtgaactctaagtatgtagtagtagaaaatatcactaatcaaaacttcagcatcagatggtacaaaaccccaagaggactggtgacatgggacggaagatca

SEQ ID NO: 651598 - DNA, 152 bp, Homo sapiens
taagaaatgtttcccttattcaagacagcgaaaagcgtacgcttcgatagacgatcaaataccgtcgtagttccgaccataaacgatgccaacttggagatccgtcagtgttattcccatgattccgccgggccagcttccggtgaaaccaa

SEQ ID NO: 651599 - DNA, 271 bp, Homo sapiens
tgctattcattggaaagatcgattatctgtagcgggaatagagacttctgctcctgtatctgatgtcgaggttaaagtgactcagaagtgctggaatcagagccccaaacacactgagtgtgaggcagagaacaaggcctgagaggaaaagtcacggttcccaaggctgctgcaggggtcaaaggggacccctgatcagtattctagggactgtcttcccctccatttcctcagagacgtcattccttaattgtctagagagaagaggggg

SEQ ID NO: 651600 - DNA, 145 bp, Homo sapiens
ccagtttgcagtgtggcaggtgtcaaccatgtccagtgctctcaagacatgttgatcccattggccacagtggaactctaatccacttttgttttaaaaataataatactaatactctgtggagtaaccttcagaattcaaaagg

SEQ ID NO: 651601 - DNA, 550 bp, Homo sapiens
caacgatggtccttcagcttctaggtgggtcatataaaaggttacacgttttttgttgttgttgttgagacagagtttcactcttgttgcccaagctggagtgcagtggcgcgatctcggctcactgcaacctccgcctccctggttcaagtgattccccgtgcctcagcctcccgagcagctaggattacaggtgcccaccagcacacccggctaattttttttgggtggtatctttgagtagagatggggtttaaccatgtgggccaggcgggtcttgaactcctgacttcaggtgatccagctgcctcagcctccaaaagtgcggggactacaggcgtgagccaccatgcccggccaaaggtaatggttcctacttggtgctctcagctcacgtggcaagatccaagtgagctgaggaccatcgttgagctgacggaccttcgttgagctgaggaccatcgttgagctgaggaccatcgttgagctgaggaccatcgttgagctgaggaccatcgttgagctgaggaccatcgttgagctgaggacc

SEQ ID NO: 651602 - DNA, 767 bp, Homo sapiens
gctctaccggcgggattctgagtggcgtgatgtctcacagaaagttctctcgactcccggacatgggtcccgtcggtttcctgtcctcggaagcgcagacgagctaggcgatcgtagggatacggtgaagagcttccctataggatgaatcgccgatctcggaagaccgtgatcacatcatcacagcttcgttcctggggagtacacaggactggcaatgacttcacatcgtgcgggtaaagtcgtaacaggtctcgggatccaaggtgatacaagtaaggaggtggtggtaggctgttgaccattgtatgatacacacacgcgcatggatggttgtgggcattggtgggctacggtggaaaccgccgtcgatgtccgtaccggaccattcaaagatcgggttcgttagtgcatggacgcacactcaatgtgcatgcaatgcaccgacggcgtttctatgttcgaatttgggctttaaatcttgacggagagtaaggtcctttttatgcaatagattatctgcccaagagaagataggactaggattggagagatggggaatgaaaaggctgactagggagaggggaactttccaagacttgctattgaacagaaaagtaactggcacaaatatgccaacacgatggtgcattgtgactcccagctactcacaggaattgcggccctggcgtatccttctgacgacccaggaacgaaagggcctcaacgctgaactggataatgccatggttgaggtgggatggacc

SEQ ID NO: 651603 - DNA, 393 bp, Homo sapiens
tcagaccttcatgagctgccatctcatccctggaatgttccagcggctggcccaacttaggaagaatgcctttgccagtgtcatcctttttggaacccacaatagcagctccctttttggagtttgggttttccgaggccaggagcttgcctttccccttagtcccgattggcaggtgggcttcgagtcatacccatggcggaaactggattctggcaacgaggagaccccgacgctggtttgagagtactttttctgggagggggccttccagcatgtgggcaaagccttccatcagggcaagattttcaagtgaaccttttttgccctcccctagctgcctgcccctgcccttcagggagatgggggtcctttaaggaaacttaaccttta

SEQ ID NO: 651604 - DNA, 132 bp, Homo sapiens
gtctgagaggcgagtacaggctgcaggtcgatcgacaccgaattcatggaacttgaaaaccttcccgggtccctggccgggatctgcgaaccaaagcgaccattgagctcaaggccctcaggctgctgaact

SEQ ID NO: 651605 - DNA, 158 bp, Homo sapiens
gcggggattatagtgtgagccatggtgcccagccgtatttttaatcttaatcccatttcccttacaccccctaaactatcaagggtaaggattatcaccagctggttagattctgctcttgagccacgtttagcgacaatggtattaggtctggttct

SEQ ID NO: 651606 - DNA, 392 bp, Homo sapiens
ttttcctagataaaccgtatttaatccgttcattctataaactcttgtcgtccttaccctactataaagcaacagggcttacgaagtcaaacacccatcagttaggccgagccccaagaaactagtcatccctactatctatctgtctggtcatactacctattctccatactcaactacttataaatgccctactcttgtatacacggccggataacactgtatcttcaagccatcacagctgatatctcttagtgctatccccaaactgccactcttaactccctcttacagtgcatagatgatctttgctggcaaggcaccctccaatatatccaccctgatgaagttctattctttacttttatactcactcttattctcattcccat

SEQ ID NO: 651607 - DNA, 1245 bp, Homo sapiens
gaggctcacccaaagagttaagggacatttatgtagccaaaaaacttatgaagaaaacctcatcagtggggcgcggtggctcacgccgtggtaatcccagcacttgggaaagctgaggcagatgggggtggtgggggcctgtaaatcccgagctacactccgggaaggctagcaggcaggaaaaatcggcttggaaccttgtaaaggcagacaggttgcgtagagctggagatattggtggcctattggcactcccaagccttaagcacaccaagaagccacaaaaccccgcgggtccacacagaacagaacaacacacaacacacaacacaacacgcggcacacaaccacgcgggacccacctgaacgaacgaacaagtgccaacactccacaacacccacacaaggtgaacgaaatacccacctccacacgtgcgcaaaagctctcagacacacatgtgcaccacatcttcatttcacacacacacgctcccaagacacacacaaaacatacaacacgcgtttgcgccaacaggcgcatgtgcgtgcgcaaacacacatatagagcacagtggcgtttttacacccacctgtgtgtgtgctggggggcgcaccactgtgtaacagagttcaaagtgtccacaaacccacagttgtgtgtggggccacaagaacacacagagagtgttgggcacaaaaactaccctctccacagggggagaactctgctgagagcacacccacagacacagatatctcctcgatatgtgtggcaaccccccagaacagaggtccctaatatataacaggcggaggggggtatatataatatacccccgcgaaaaaggggggcaaactctcattttcaagaactccaatgtctcgctctctaatttaagaaaagacagccattatatgttggcggtgaggggttgacatacactctattgtataataggtggcgaaaggaaataaccgctcagaaaataacgcgaaaaagccaccatgttgggacacaccccaaacgcccaagagaagagttgcgcctaatatacacagggggcacataacacatgatacgcatatataggggacgaacaattgtgttgtttacaataagcgggccgcccgagtggggacattatcactagtgcgcaggcgcatgtcgatcgaaaaggaacagtgggagccactccaaggtgagtccgttttgtggcaggggggaccaacgcggctattgaaacg

SEQ ID NO: 651608 - DNA, 320 bp, Homo sapiens
  misc_feature (221)..(221): n is a, c, g, or t
  misc_feature (275)..(275): n is a, c, g, or t
cccaacccaaggcggaaaagaaagggaataatgaagcattgttttccccattagaattaggcatcagatttcttggtgaaacacataattaagtagtataattaaaaaactgttcttcatacttagacttctaaatacatttctttaagactgtaaagtataattgtaaggcttgttaactgtttatatactaagaaaaagctttacaagataagactganattcagaataccacattaaagttttatctgtacagcgttgacaactctaactanaaggattacagcccttaaaattttagcttaaggacattttaaaat

SEQ ID NO: 651609 - DNA, 273 bp, Homo sapiens
ccagagaggcaagatgggctgagtagagagcaggactggagcttgctcaccagggatctgcctctggaccggatctgcgcatgcacacagcggagccaggacactgcaaaggacagccagtccagccccttcctggagggaggcccccagccagagcagatgtggcgactgcgtaactgttctgctccgttccctagttatcaaacggtgacctagatatggtgcgaaggggagggggcaaccacttaggaccaaaggaggccggtaagctcc

SEQ ID NO: 651610 - DNA, 1002 bp, Homo sapiens
gctgagtgccggccggaggcagcacgcggagtgagcgctggcctgccgcaaccccaagacggggttgaccctgtgagctgtgtggtgccctgaaagcagcccttacctctcgctggctgccacctgctggccagggccatggaggtgcgagcactaccacagctgcgtgcagctggcccctgacgctgaggcctggagtgagcttgtggccactgtgccccctgagcttgtgcctggtggccctcgtggtgtggctggggtggctggcctgctggccacttgaagcacctgtgcatggagtggaaatgtgacaggtgcgcagctgactggaaccccgctacgtggccaatgcggccccgtgcgaggatctggctgctgaaatgcccgtgccctgaagatccgggaggacgcgcagcggtatgactgacctgactgactgacgcggtgagcgagatgaagatgggccgctactggagcaaggcaggagcggaagcagcacctgatccgggcccgtgagcagcggaagcggcgcgagttcatgatgcagagccggctggagtgcctgcgggagcagcagaatggcgacagcaagcccgagctcaacatcatttgccctgagccaccgcaaaacatgaagaagcggaacaagaagatcctgtgacaacttggatcaccatacaggagatgctgtgcccaagggagcgcgctccgcgatgcgaagcgggtctcaacccttttctcagcacccaccgggtcagctgcctggcggtaccaggccagggccaggggaagcccccttgggggccccgggcgcctttaaatctccctatagacacatggctgcgatcgcggcagcggtagtcagacaggcacggctagcctgctcatctcgcactcagcacttctccctcgagtagagtggtgcacacgagtcacagtcatctcagaaaaagcaccaatgtagacatacagctagtacagccagcacgcgcccatgccacg

SEQ ID NO: 651611 - DNA, 590 bp, Homo sapiens
  misc_feature (59)..(59): n is a, c, g, or t
gccggtaggtcgccagctgaggcggtttgtaagtttgggtcgcagtatgctagaatttngaggctcccttctgatgaaaatagaggtgtgcatgcagccatggaacccgggttacagcagtgagggggccagggatcaagaaacttatacatgtccaaaaatgattgagatggagcaggcggaggccagtttgctgtagttaggactgctagacagtatgttccctggtgagattgagctgcataggtgaatgagcagctggcgttgtagcagaactgaagagatcgtagtgaaaatgaagacaagggaggggcgatcttcaataagtctactttactatcaatatgaacctggatgtatcgtgagcggaaatagaatggcgatgttatctctggcgtgtattgttccctggtaaatacccgggcagttctgtctggaattactgtcaggatcagtattattgagtagatccaagcaggatgtcagctgagaaggatctgactgattcctgtgaaaactatggtcatggagatgtggtatactgaatggcgaagaggggttagagagcagcctgtggtatgtcagcgagt

SEQ ID NO: 651612 - DNA, 120 bp, Homo sapiens
  misc_feature (58)..(58): n is a, c, g, or t
cacagatcccctcttcccttctcagtgaaggtgcttcaaagcatacacagtatcaggnatgtagataggcatctaggtgcagcagccatatacttgtgtgctaactactacctacacaac

SEQ ID NO: 651613 - DNA, 311 bp, Homo sapiens
ctagctgaatctaatccctctttgaagtggacggagaagaagccatcattttgtgcagctcattgataccttggtcacatcacaccagtggaacctctggacttgatttgtccagacttattggtcagcacagaaggagattatagtaagttaagcggaaaatccgagatgtactcttcccattagcacggttacttttgttcacgacttcagcaatgatgatctttacttcaatggcatctttgagtttcttatacttggggttcttgtaagatttccaggtaagccccttgaaaatggtcgccaatccg

SEQ ID NO: 651614 - DNA, 478 bp, Homo sapiens
ctgactcctgaggatccccttagggcactcagcctcagagctggcctggctgcctccttcccacccaccattcagtttctagctcagatatcacctcctgaaagaagccctctcctgactacttaattcaaggccctgtcctctctgtctagtttggcgaggcttttctgtttttcattttttagatggagtcttgctctgtcgcccaggctgaagtgcagtggcacgatttcagctcactgcaacctctgactccctggttcaagcagttcttctgcctcagcgtcccaagtagctgggattacaggcacgcaccacctcgcccagctaatttttgtatttttagtagagacagagtttcaccatgttggccaggatagtcttgatctcctgacctcatgatctgcccaccttggtctcccaaagtgctgggattacagtcatgagctattgcgcctggctgctgctgctgctgctg

SEQ ID NO: 651615 - DNA, 278 bp, Homo sapiens
ctcaacgacatgctccgttcctccgtaacaagacatttttcttcacataacggatttttttcctttctcctttacccctgatgcgaacagagaaaaagctgagatgtcaccactatcctcaagatacagaggctgctccgcgcatgcctttttatcacatttctcccggcacctgttggaaagcccggagacttttgctcgtctccattttatttccccctttctaaacgaaaaccttaattggaacttttcttacgctgtctccaccttgcgttgag

SEQ ID NO: 651616 - DNA, 248 bp, Homo sapiens
  misc_feature (40)..(40): n is a, c, g, or t
  misc_feature (70)..(70): n is a, c, g, or t
  misc_feature (182)..(182): n is a, c, g, or t
  misc_feature (204)..(204): n is a, c, g, or t
atgcctcagtcacccaagtaactgggactacagggatgtnccaccacacccggctagtttttgtattttnagtagagacaaagtttcaccatgttggccaggctggtcttgaacttctgtcctcaggcagtacgcccacctttgcctcccagcatgttggaattacaggcatgagccactgnacctggtcaagtgtccaaattnttactccaaaactgaactttgggctgggcgccatggctcacacc

SEQ ID NO: 651617 - DNA, 791 bp, Homo sapiens
cagggacagagctgcgggctgaggttcctccgttcggcgaagccccttctctctgcccccggcctgctctgggcttacttggctatgtctgctcctgacaggagggatgtgtgttgccagggtgggggcttggcgtgtgtgcgtgtgagaatatgtgtgtgtgtttaaaatacaaaaaaaaaaaaaaaaaaagcgtgcctatactcagccgcgaagacgcttggccagcctccatccgggtgccaagctccccttccgagcgggacactggggaccccggaggcacgggcgaggaggaaggtgcgggacagctgcgggtgaggattggccgcgttgccaccgacgttattgccagcggcttgcagggggccaaagcgccttatccacaaaacccaccggcaaatcgactggacaggccggtgggcggggaggcggtcagtcagtttggccagaagtgatgccagggaagggcccgtgcttgggggcaggtggaatccggggcagcacaagcaatgcgcaggggctcacggctccagggccattgtcgtccacaagagcccatcccacgggactgggacgggcatttttataacccgggccttggccttggtttgtggagcttttcgggtgtgtggcgaaccccaaacttcccctggggggccttgtgcctaccagaacgcttgggctgtgttccccctgggttggctgggacgccccttggtaaggtgtgggctctcaggaggatggccacgcccttcgggggacagattctggcctttccttccccccag

SEQ ID NO: 651618 - DNA, 965 bp, Homo sapiens
attgatacagatctacaagccaaggggaaagcaagatagtacatgggattggaagtagcacagtggctctcattagcagacttggttccagtaatactggagatttgctttggttctaaagataaaaatttccaatgggcaaatactggagcagctgtgtcggaacacagtcagtcggaacccagtcagccggtaaagtggtgaagatgaagatggtagtgatgaagaagtagtacataatgaagatatccattttgaaccaatagtgtcataccagaggtagaagtaaaatctggagaagaagatgaagaaatatgttaaagagagagccaaacttatatagatgggatcgggatgtcagacagtggacaggagcgcggagttggagaatataaagatactttggatcaaatgaagaatcagttacccggaattcctaaatgagaagagaccagagataatacagtgtgtgacaacccacgttattcactacaaaacaatggaataaacgccgtttcaaatgtttcaaataaatggaatagaatggacgtgccttcagcattactggtgatggagcaagaaagagtagaacacgtagcgaggcagatttcaaacactacagaaagtagctgagggttcacgacacacttgacgaatggcagaagaagtaactgaagacccgacaacggcccgtgtatcaaggcgaaggagagcattgaaacggacaccaatccggagagaacaaaaagagggagaggacacggacaacacacaaggagcaacaaagagaaaacatgaaaaaagccaagaaaggagagaacgaccaacacagcagcacacaacggaagacaaaacaagaaaaaaacagcacacgagacggcaagacaacgaagaaagaaaaggaacagacagacagagagaaaagaagagagacgacgagaaggaacccgcaagaaagccagtca

SEQ ID NO: 651619 - DNA, 330 bp, Homo sapiens
aggtcagctttttgggaacatatccacttatttaaaacattctccccagcacttagggaagccgaggcagacagatcacttgaggccagggattcgagaccagcctggcccacatggtgaaatcccatctctactaaaatacaaaaattagccaggcatgcttgttatcccagctactcaggaggctgagacaggataatcgcttgaacccaggtggaagaggttgctttgagccaagatagcgccactgcactccagcctgggtaaaagagcaaaactccatctcaaaaaaaaaaaatctatagaaaagaaatcaaacaaatttattag

SEQ ID NO: 651620 - DNA, 100 bp, Homo sapiens
tccaaccctctgatgcatttctattagtttgtcccagagcttcctgaaaccttaagcctccaaatccaggctcacttctcctagcccaagtagggcacgg

SEQ ID NO: 651621 - DNA, 1327 bp, Homo sapiens
gtggcggctgggaccctggtacacgtatcctgaaaactggagggccttcaaggctctcatcggctgctcagtacagcggggctcgaggtccgtcgtggctctccggaccaccccacttgccatttaggaccaagaccgaaccgacacccctgaatttctccgcaaatttcctgccggcaaggtcccagctatttgcgggtgatgatggattcatgtgtgttctagcaggagcaacgccattgccatactactgtgcagcaatgacggcagctgcggggaagatacgtcccagcaggcagccaagcgccaggtggagcgcaagaaggagtagagcactccgcgtgaaatccggatacatcacgaagccaccacagaccgagtaccgaggagtgtagccaccacgcatacgggccatccatgacagcaacgacacaaacacggccgacctgaacgcaactgccaaagagcacggacagatggagcgccgacacttctgaggcgccttgccctgtgcactgaccaccacctcgctacccaccccagcgcacctcattctaggccgggccaccacacccacacctgacacctctgggcttgacaattccacaaccgcaggtccccaggacgccccacagcgcccggccgagccctcatactacacacaagggacacgcaagacggcaccatacatgaacaccggccacaacgaacaaacccccaaaaatcacccaaacccgacaagaggtatcgcgtcccacccgtgacaactaaaacccagaacacccaaggcactaccggagggcacgggacacaaagcgggaggcaacgattgcaaacccatggagctacagaacagcacacggcacccacaacataggacatgcagctacaaccaacccttaccacgacagacgaccgacaccgctaaaacagaggcacacaccgagcaaagaggacaagaaagaaaacggaacacaagccgacaaaccccacggcacgacacaaccaacgaacaccaccgaacaaacggacaggacacacaacggccgaagccgacagccgccaaagagacaagaacgcggaaaacaagaaagaccgcaacaagcacgagggagagcccagtgcacggcaccacccacagaccacacgcaccaccacaacaacaaagcgaagaaacaaagaacgaaacacccaaggaacaccccgagcaacaggcacaccccacgacaaaagcaaacgacaccaaaggacgcaaaaacagaacacagacaccagacacgaacgcgcacacgaagaaaagagcacaacgacaaaacaaagcaaccaa

SEQ ID NO: 651622 - DNA, 579 bp, Homo sapiens
ccactttctgtgactcctgcccctgcctccatacccactcttgttttaattacaactaaaatggactttaccatgccgtgcggactggtctaaactcctgcctactgtgaccacctgcctcccctgccaaagtgctccatgcaggcctgagtattggtcccagccattagaaagattgtaatcctatgaactcccttttgaggagagaaaggccaatctgtggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttccaacagactgtttgttttctgttgagaataaggaattccttcactcttgccagagtattgacttttttacaaattttttaaaataaaggctggcctttgggcccaaattggtaaaagtgtaaataaaagtcgttacctctcctagggggggggcccccg

SEQ ID NO: 651623 - DNA, 101 bp, Homo sapiens
tgtggggagtggtctcccagctgcactcaatggtgttcgtgctgctgcggcagtctggcggcacctgtgcactctgccgtcgatacactggtcgattggga

SEQ ID NO: 651624 - DNA, 1023 bp, Homo sapiens
ggcggcgtgcagggctgagccagctgactgccctccattcactctccgctgccctgttctccgtgctgtcctccctgttcctgctgccctgccctgccaccatgactggaacagtgccatctccttcgccaaagacttcttgtgcctggaggcatcgcacgccgccatctccaagactggcctgtggctccgatctgagcgggtcaagctgctgctgcagtgtccagcacgccatccaatgcagatcagactgaaccgacaagcagtaccaaagggcatcgtggactgcatatgtccagcatccccaaggcagccagggcagtgactgtaccttcatggagggtgcaaacatatgccaacgctacattcgctagtatacacccaatcaaagccctcacacttcgcctacaacggataagtagcaaagacagaactctacacatggaaggggacgatggaacacaaggacacacgagacaaagaaacatgagacggtcactataggcaaggagacaacaccatgagcacatcgcgagccggatgcagagcccggcggcagaccacaacacacatacatagcaataccgaggtacaccacagagatgaggaaataaacaaccccaaggaaacccagggcctgggccaacgcaggcacagggatggacaagaggtcaagggcaacaagagaacgcgcgagatacccgaagaggcactggggagcacaggccataggaggcaggagtcaacagagagtacccgaaccagagaaatccgggagaggaccaatcgaaaaccaaaggcaaattacacagagagggcagataccggcaagacaaggagacaaatcaaaccgaaagtaacaccggggcagaggaaccaacacaaaagcagcagggatggtgacagaacaacccgggaacacaagtggagaacagcacatcagacgagaaaacacaaagagaccgccaggacgaacaattcggagaatgaaggctgggatagacatgacgaccgaacacacgg

SEQ ID NO: 651625 - DNA, 110 bp, Homo sapiens
ctagaggatcccacggttcagactcagagttcgactctgagtgtgcatccacgtctttcagtcctgggaagggagaccctgttccagcttgatctcacctctactgaggc

SEQ ID NO: 651626 - DNA, 110 bp, Homo sapiens
tagagccttgttgctctgcaccctgtcgtccaccacgttgctcttggacacctccattagagcggaaccgcaatggcgccgataggttctccccatgcgtggattgccag

SEQ ID NO: 651627 - DNA, 632 bp, Homo sapiens
agcgggttgctgcgccgccagcagccgagtcatgttaccgccgatcttctcaggctactcctagcagcatccatcgcacgcaccctatcttcacatggcattcaccattctccattcatctctacgatagcatgagacagaccaagcctatcctagcagctactgacctgatcagtcatccgatcactcgcagcagaggacgccgcatcgatcccatgaggatggaccagcacattgacgacacgacatatggacatatacaagaacaatcacacaaggaagaagatatacagcaattaatagagagggacacccatccacacaggacatctgcgttccacacccaacccggagacacacatcaccgggaaccccaatcccacaatactgataaaccacccccgggagaagatcaccacgagggaaaagcgaccgccgcacacggcggagaaccaaaccagatggacccaccaccacagagaacccaaccacgagacgagtatacgacaagtccaccaaacgtctcacaagtacaaacacaaatacaagaggaggcgacagaaacagaaaaaaggcgagcacaacaggagaagggcacatacggacaggcacacacccacgcccacgaacac

SEQ ID NO: 651628 - DNA, 796 bp, Homo sapiens
ccctgtgtacctatggtctcctggccgtcttctgcgggccccccctgtagacatcggtcgtcccggcggattcccgacttgccttccgcgggctcccctggcgttcccccccgaactcgaagccggcttgtgtgcaaccccttctagacatattgggggcccgcacccctgatgctagcagcccacccgggtggtgtacgaaaacacactggctcgccaccactaaactggggatgctcctcgcctcttaggccccagcgtcttcttgagggaagtaaagcaggggtcccatccaggggaggtcccccacccggggtcaaaagccgccccgtgaacccgtggggaacccgcaatatcttcccagcccgggtgtacccctcgagatgttttacccgccttttcctccattgcccgcttcttcaacagagaggtgtttgcacggcgggtctaaaccaagagattcctgttcttagccccctgtccctttgacagcccccgcggcacaggctgttaagctttctacacacacaacgagagtcccttcccctctctctcagtctagaagcccgtgttaacacccctgtttcccccctttaacgccttaacaaggaccttttccccccggagatatcccccttcacctccacctaggccaccaggcgcttgttccttcccccgagaattttttgacaccacccttgtctctgttaggaaaccaccagcacttttccaaacacccaccccactctcgactgtcttacaccccataacactccccagcccctcacccaaaaca

SEQ ID NO: 651629 - DNA, 718 bp, Homo sapiens
  misc_feature (195)..(196): n is a, c, g, or t
cccgttgtttttttttatccaaaagaaggatcccaagaggtggttaactgttgggcgctgcccattttaccttaaccgtccaaatcttttacgcccttgtgaaagggagttaggtttcaccgtcccccctctaaattgtaccatcacccctttggtttgaacaaaaaggtttttaactccccctccccctttggnntctccctggtgtggaaatatagtattgcaccattctgtttaaaaaaaagatgtggcttccttttttagttttgttttaggctgagcccctttccatggggtttacagggaaaaagttttccattaatggagtcagcccctttttttgcccccagggggggtgggtttttccccttaaaggaatcaaaaaaacccctgtccttttccctgggttttttagggaaaagcccctccgtttttgggggcctggccaaaattaaaaaaaaaaaaagttggttttccaaaggtccggggggggttattcccaatgggaagggtttggcccttattttaaccgaaaaaaaaatttccaattggggccggtttttttctttttttaaaacccgggcccaatttttcccgtaaaaactgttgggtccggccattttttctttttaagggccaaatggcctttttttttggccaaaaccccccatttgccaacctgttaatttttttttttataaaccagctgttcccctga

SEQ ID NO: 651630 - DNA, 209 bp, Homo sapiens
agtatgctcatcatttccccctctattgacccccacctccaaatatctcatcaacaaccgacataagtcaccacccaagcaatgactaatcaaactaacctcaaaacaaataataaccactacacaaacactaaatggacgtacctagatctctatatactcagtatcctctcatcatttactattgccacacactaactctcctcggt

SEQ ID NO: 651631 - DNA, 297 bp, Homo sapiens
gttgtgctcttggattgagcgttctcaggctccctcggatgacctatcccgtaccgtgtcacatgtaggacggactacatcgaagtgataggcagacgtcgatggtcgtcgcgcacgggggcgtgcgatcggccgaggtattaagtcacaagctgcgggccgcccccggcgtggccgagagggctgccggtttggtttgatcctgataatgcacgcatccccccgcgaagggggtcagcgcccgtcggcatgtattagctctagaattaccacaggtatccaagtaggagaggagcg

SEQ ID NO: 651632 - DNA, 205 bp, Homo sapiens
  misc_feature (84)..(84): n is a, c, g, or t
acgaggagtagtgtggatctcacgtggtccgattagctttctctgccttgcttgcttgagcttcagcggaattcgaaatagctngaaataaggctggaaagggactcccggaaaggccaagacaaaggcggtttcccgctcgcagagagccgatctttcagttcccacgtggggccgctatttcatcgacacctaaaatctaggg

SEQ ID NO: 651633 - DNA, 948 bp, Homo sapiens
  misc_feature (948)..(948): n is a, c, g, or t
ggcgcctgcgccataaaggccgccggcgcccacgcgcctcgcttgctgcgcgctgccggggcctcgttcctcctcggctcggtctcactcggtgtaccttcttagtcccggctagtggccggttctcacccggggaccgccccgaggttccgaggaagcgtgcagcgaagtgggtacacgggagcacccggtctgggatggatgaacccgtgcagcacgggcgttctaccgatgggcctaccagagggacccgtttacccaaaccaactttcaaaggcttttgacgcctcaaaaatagcacaaaccgagtggggcaatagtcgcttggggggggtcatttaacctcccagaggacaaccctggggggacggcgagggaaccggtggatagacggtaaatgcccgggcgaggggaccttgggccgaaacgtccaaagggggcgcgaggaagggggcccgggccccgggcataggacggaacttgcttccaaagggggtggacgcaaggaagtcaaatttaccacgccgaagagggttcgaaacgcccgggcggcgtggaccacgcgagtgggcacctgctcggaacgagagaaaccccggggcagaaaaaaaagtgaaccccaatgtcccgtgtgggaaaaacggcgccacagcggaggtggtgaacttgggccagcggatgggctccacagacaaagagcgttcggccggggacccaagcgatggaagaggtccggtccgggcacgaagccgggggcaccggacaagccgggcggaacattgggaaacgggggtaaccacatgggccagagatcggaatcgcaagggcaggcacaattcggaaccattgggggcttcggggggatcgccgaccctgggggagccccgatcagtgggtggacctgaagccccttaaaggccaagaaccgcttgccagggaggaaccccn

SEQ ID NO: 651634 - DNA, 248 bp, Homo sapiens
  misc_feature (196)..(196): n is a, c, g, or t
  misc_feature (221)..(221): n is a, c, g, or t
aaccgcactgaccaacttcgtgcagatgctggcgatcttcttgatcccaacggcgctgtgctttgcctttggtgaagtgatgggcgatcgccgccaggggcgcatgttgctgtgggcgatgtcagtaatttttgtcatctgcgtaggcgtggtgatgtgggcagaagttcagggtaatcctcatctgctggcactnggcacggacagcagcatcaatatgnaaggtaaagagagccgtttcggcgtgc

SEQ ID NO: 651635 - DNA, 626 bp, Homo sapiens
  misc_feature (626)..(626): n is a, c, g, or t
ctaaccttgaagtgcaggcaatcaattatactaattatcgtactaaattttactgaatccagaacactgcattgaactgggtatggaataccttccatattggatgcttaccaatgtactgcagagataagtttaactgacctgagtaccatattgagtgcccagttagatcaagacgcgcacttacaaggaagtacgcaaaatggtagaaagatgcattgactgctattgtgaaacccactggacatgaacagtctttaggctgtttagataaccagctagctgccttgccggacgaactttgccatgagaaagaaactttggagaagcacggacattcagactgctgcagccatagcgaagaggcatgacataactgttctcttgcacacagaatgtctagtccagcatcgatcccagtttgccaagtcccagaacctgtcacaagctgcgaagcatatgaagaatactgggagacattcatgaacaaatgcagttatgagatagcaagatggcatgcattcctgcatgcacctgcaatacttctttggcctgctcgctatgacctattcaattttgctgacagctgaggcagtttggttaatccacatgcatgttgccactgn

SEQ ID NO: 651636 - DNA, 587 bp, Homo sapiens
tatctataaggctaagcaccagtgaaatctataaaattagttagcaatattctaggcatgcattcatgtaccacatgatggtgtggggttaaggaatgtattcgctgttgtcaggaacgcacagagctcgccagattgaattgcgtgtggaattctaatagacctttgcttgtcgcatcctatggtgatttggactgtaattttaatacagtatggcaatcattatggtctattttctcagaattctggttaagtagcataagcgagtgtggaagcatcatgaattcatgctgtcaaatcttgtaggtgcgacaggtaaagaatttgtcctcatctttgcacttatgcttactaggcccatctctcttggagctgtagtgtggaactggggactcaggtagaggtaaatggccgagtgccctgtaattgcaccctttatggtgataaaaacctgcctgagaacagattgctgtaggctctgttgtgcctaatgaggaaatggataggttggtcagcacagaccctggtgccagattccatgcagtattctgcatctacaatgcagttcgacgctgccgatgcctcta

SEQ ID NO: 651637 - DNA, 352 bp, Homo sapiens
ggtcactaagctgtgcatcaccgtaggtatggaggccaacttctaatgactttccgtaatattatacttagcgtcggagtcaccccaagaggtagctatgattagccttgtttatagacagagaaacggaggcacagagaagttgacgtgacttgcccaaagggcacacgtagaatacgtgtcgcagccagggtggccgcccagggcctcctctgcatttgacagtgacccactcaaggctacacatataggaaggcaggacttgaactctggggttctgatgtaagaaccactctgcattcagcatccctactttggctttagaatcttgggatgtttttacagtgtggag

SEQ ID NO: 651638 - DNA, 537 bp, Homo sapiens
  misc_feature (56)..(56): n is a, c, g, or t
aaaaaagtaaaaccgggggcggaatctgggtaatggaattccttaaggatttaaantttttggaaaaaaaaagggaacctttaaaaaaatgaatcccaaccttgggggtaaaacccccccccccccaaaccccccttttgtttttttgttttttttggaaatggcaaaaccttgtaaaaaaaaacaaagccttctattaaaataacttttagcaattttccccgataacccataaaccaatttttcccccacccccaatatgcgggaaccgcccgtaaataccttgtgaaaacccatgggggggatccccgcttaaatctaagtttaaaacccccccgttagtagccttaaaaaggcccgggggggaatttttccccccccgaaaccccccaatccccccaatttgggctcctccttgggcagttagcagttcaccattttccggcccccccctggtacaaaatgtgaaacaggttttgttaccaaaaaagcccccccttggaaaaaagtttcaaccaaaatcccttttttttattt

SEQ ID NO: 651639 - DNA, 101 bp, Homo sapiens
gctcgcgcgcctggagggaggccctcacttcatcctggcggactaggacccgcggtcccgcaggcgcagcccttacactttgcccggcgccatgggccttt

SEQ ID NO: 651640 - DNA, 215 bp, Homo sapiens
ggggggggggggggggtttttttctcccccccccagggacccctggggggccccccctctcccccgggggccggggggcccctcccccccttcccggttttggggccggggggtgggggggggcccccccccgcttcctttttcccctccgttccctttgtggcccctggggggaggggttttttttttttttaaaaaacccccaaggtttttta

SEQ ID NO: 651641 - DNA, 207 bp, Homo sapiens
  misc_feature (11)..(11): n is a, c, g, or t
aggtaggatgnggtgctggcgggtaaaagagtatgagggggtggtggtggtggtaaacttaatagtgtaggaagctgattaattaaggaaggagaggggtcaggatggatccggaaggatccaatgggggcgggggcttggtatagataatggggcgtggataagaagtagtaactgggttgaccatggttggtgggacaaaatggt

SEQ ID NO: 651642 - DNA, 348 bp, Homo sapiens
gtctgaaatacagtagaaaagtcaatcttaaggctccactatgatctcctgtgagtccaaacctcagatccaagtcacactgatgcagaggtgggttcccatggtcttgggcagctctgcccctatggcttttcagggtacagcctccttgctgggtgctttcatgggctggcattgagtgtctgcagcttttccaggtgcatggtgcaagctttcagtggatccaccattctgggtctggaggacagtggccctcttctcacagctccactaagtggtgcccctgtagggactctgtgtgggggcttgtaccccacatttcccttccttcctgccacagtccttggg

SEQ ID NO: 651643 - DNA, 514 bp, Homo sapiens
  misc_feature (103)..(103): n is a, c, g, or t
  misc_feature (221)..(221): n is a, c, g, or t
  misc_feature (319)..(319): n is a, c, g, or t
  misc_feature (343)..(343): n is a, c, g, or t
  misc_feature (394)..(394): n is a, c, g, or t
  misc_feature (413)..(413): n is a, c, g, or t
  misc_feature (422)..(422): n is a, c, g, or t
  misc_feature (428)..(428): n is a, c, g, or t
  misc_feature (445)..(445): n is a, c, g, or t
  misc_feature (496)..(496): n is a, c, g, or t
gaattcggcacgaggtttacagaagcaacttagtgccttgtaatctaactttgtcactgtgactacattacctcttcagcgccagagggcacccgtgggcctnccggagcctctgcccatggcggggtggagaccggaccagcagcccctccactggcgcacactgcactttcctcattcagtctcccgcacactattctctccctcttccggtggcactnttcacctgtaccgccccgcccaccacccggcccttggaagagttgttgcagaccagggtttgggggaaactgtgttgacattcaaaactttttcttcngatctgaacccctgttgactaatnttgcctgggtttgtgtaggtctgcaggaaggaaggctgaaaaagcggacgnggttttgacttaagtgggntttgtgatntaattntttcttttttttaagtngggagggaggggaagtagatggataggagagacttgatttggtgtaaagtncccagttcaatgtgacac

SEQ ID NO: 651644 - DNA, 895 bp, Homo sapiens
tgacactttgaatcgtgttgcgacgaatgagtatgtggtgcgatctcaccgtggttccgattagccttttctctgccttgtcattgatttgagcctttcgcggaaagttcgaagaatgcgcatggcggttaacggcatggaatagggacctccggcatagaggccaagtaccaccgaggcggtattcctcgctccgctagagagagccgtgtcttgcatggctccctagtctgggtcctggtattgatcgacaccttaatgatcatatggtacggaccaggttaatgtgacgtttgcgagcgcgaatggctcggttgtttgtgacaggctgccagacacacttccattggaaattaccatcaccggataaaagtacattaatatctggggcagtgcaatatgtgctactccaagacacgtagctatatgagtggtacttgcgatattaaccaacccgtgcagttccactttgacaaagtttgccttatttcccgtggagtactactgacctgatattgggaggtgtcttcttcatttcacaggtgcctaccaaattttgcctatgcgtggggttgtgctgatcaattacccagtataatacccaccaaaagtgcgtctggaatttggggaaccacaatgtggacaaacacgacaagaacttgtctataagtgattgctctgggatttacctctgttgatctccaggattctcttaaatttacttctaatcgagcctgtcccaggtgttctggtgaagttccatgctggtagcttgtatctctggtgtaacaagacataaattttggcctttgtgtaacttcctatttgagcaaagtttggaagttcatttcatttttccaacctaacaaaatttcctgcttcgagttttaacctt

SEQ ID NO: 651645 - DNA, 106 bp, Homo sapiens
attgttgcttctaatctgctggaggctgagagattagaaataaatttgtcagactggatatgtaaattggatcacatctctgattgaggccgggtctctttctctg

SEQ ID NO: 651646 - DNA, 440 bp, Homo sapiens
  misc_feature (116)..(117): n is a, c, g, or t
  misc_feature (122)..(122): n is a, c, g, or t
  misc_feature (375)..(375): n is a, c, g, or t
aagtgctcagcactccccttattttttaagaaaaacaggtggcccgccctgcttgaggccggcttccggaaggagaacaccgtttcggagggtatggcgctggttcccccgggcgnnttcgngtaataccctttccccagatgattcgccccttgtggcccaagggttagccccccccccgggccggccccacccattccctcctccgtgcctttctgggcgggagttcagggggttgccccaacccttgggtgattccaactgtgtgtccccaaaaacttttccgggttttttttgaggggttcccccaacccaggggtgattccaactgtgtgttccccacaacttttcccggttttttgtgaggggcccttntgccccccgcaggggtccttaggttaaataaacccccgccctggggttggcccgtcggccgttga

SEQ ID NO: 651647 - DNA, 280 bp, Homo sapiens
  misc_feature (9)..(9): n is a, c, g, or t
caaaagaanttagttcctgtgtaagaacctaattaaaatagatagatgagtcatgcttagtctcatgtacgaggggttgatattttcatgcagttattccttaacagattgtaccagctttgcgtgcatagaataagaaaccaatgtatgaataatttatatttctggcaagtttccctataaatatacagcttggaagacctagaaatccagagtagcagtggatacagcgtatgtcattcataatatctctctttaaaacagtctataattcctgatc

SEQ ID NO: 651648 - DNA, 900 bp, Homo sapiens
cgcccccgtgtagcgctgtgtcttgtgtccgtcgagcatgtgccttgtcgtctcttgggggcgccccccctggtgtgggggaccacttgttccgcgcgggttttttccccgccgtgtgttggtccgcccccccgtgtgcgccacgatgtatgcgttgagcctctttggtgtgttctgttttggtgtgagaactcccgttggacacccgttgcgccggccaccaagatggtcgtgtccgcggaggatcgcggcgtcccgcgaggttagcattaacagcgccccgcgggtgcatccctcggcggacgacttttctttaagggcgctcacccgactactgtccgcggcctgtttcaaaaggtcctctcatttatcaatttctcaaacaacccccgtttttttgttacaaacatactctctcttaaatattagcccctctcccttgttttattatagatattaattcttctcaagacaccttgggtgttgtattactaatagttatcctatttaatacctcgctgagctgttataccgctccctcccagagtttttctaaaagcaccccccccgctctcttgatcacactccctatggcttactagaccaagaatagcgacaaaattatctctgcgcacataattctccccccttaagagagcgcacatccacccacttttgtatagtactccacacaaagagtcttttgtcaccacactatatcgtggtgcgccatatattgtaatctctttttcataaacattgtgggacttcctctcctcgagaccccaccacgacaatatgtgggtctctcactgtgcccccaacatcatcattatcctaaatatttccccgttttctcagtattccagggcctaaaaaaccccttaaccccacataaca

SEQ ID NO: 651649 - DNA, 268 bp, Homo sapiens
  misc_feature (83)..(83): n is a, c, g, or t
  misc_feature (86)..(86): n is a, c, g, or t
  misc_feature (209)..(209): n is a, c, g, or t
  misc_feature (214)..(214): n is a, c, g, or t
  misc_feature (249)..(249): n is a, c, g, or t
cataataattaaaagacgctctgaacatcgtcatcagttcttcatccgacatatttttgggttcagttgaagcgatttctganaantttgattcatgaaaagcttgtcggaggaaactaaatttatagggaaatatttcctttccgggtttcattaaggtgaaatccaggccaaattctatccaaattatggaggcaatccctggaaantccgnaccgggttttgaatccttttcccattggtcgggancgggcaccatcccgttggg

SEQ ID NO: 651650 - DNA, 701 bp, Homo sapiens
cggctgcaggaattcggcacgaggcagatagtatatcatatgctaggggtcgctgggaggaataagggacttaattgtggtggaacacccgcacttgcagtgcgggaggctagggggccacagatgctgcttcattaacatagaggttttggatttttttctcttgcggctagttattaaagtggggaagaagaataggtgcgctcagagaggcctatctaaggatgggccagcagtgtggatccatcgttgacactaattgaaggcttttggattaaaaagcgaggcaccgggtgtaaaaagttttgggtctccggtggccgggtaacctaaagggcaggcccaacatatagagagggtacccgctgtggggcaacaatctcacttcccccagagggtcgtttgcccgcctccgacttttggtcatgtaaaacacggggcctttgcaaaaaagggcctccaatatgttcgcaaacaaactcccgggcctgtgttgcgcgccattccccaacaaaccgcgggggccgccccatttccacttatctttttttcggaggggggctttaatatccccgctacgtcaacccctctttttagttgacatctcgcatccgtactccctgcccaaagagtgtctcctcataaacctagcggcttcttctcccgtcctcactatactcctaccgcccctctctcacccc

SEQ ID NO: 651651 - DNA, 337 bp, Homo sapiens
gggctctgtgacacaggtatggaataggaattgtaatgctgagatggggttagaaagcttggccaaaaggtcccaatctaagggaagtaagtgacttcagtacgaaaagttgtaaaacatcttaaataaggagaagtaggaccatactgagtacaagcatccctaaattcttttaaaaaaggtaagattgaacagcgcatatcgatgcagaccggtttaggacccgaaacgacaggagggtgaggggctgtagtggatgggggatggcctggagaatgataggtaaagtgtagttgggtcctggagccatcagcttctgctctgtgttggtggtgtg

SEQ ID NO: 651652 - DNA, 266 bp, Homo sapiens
aaactcaaacccttccccctcgagtgatcttcctgccctgcctttccaaagctttgggattacaggcatgagccaccacccctggcctctctcttctttaacaaatactaaattaatttatttggcttagagatgggccttactgtttcccgggctggtatggaacattataaagactcctgttggccatcttatttgactgttggttttcacccttttccccattcattagctcttaattgttggtcttccctggaaccttccac

SEQ ID NO: 651653 - DNA, 965 bp, Homo sapiens
aatccttagagattagttacataatgacatatcactttgaacttccatgaaacctgtcttccatcacaacaaccctgggactacaataacatgctaaacggatgtatctaggcttaataatttccttataggccaatactcagaacacatgtgctgactcagcgacacagatggaaaggacccgaacacctcacctatgtaaccatttcagatctcgtgtcaatttgaatgtaacaataacaagacagaacttctggtactctacaatcagggatgatgtcctatacgaaggtcagtcactttgtgaacttatctggacttctcgggttactttagagtctctgcgatatattctccagtttacatctggacgtcatatcttgtggacttgtgcttcatttcagtgttaatcagttaaacagaagttagttggcgttatgatgtgtgagtgaacttatgccactggctggcctatgtttctcttaccagtagcttgttgtcattgaatcggctatatctatgacttggcaagtatgcccagtaagctttccttctactatagaatagaccagataataacgagtgtggtcttatttatcgactgtaggctagtctattatacaataatcttgtgaagaagaatgtcttgacattctactactatactcttgtctagaattttggatgtcgaaaagtttgcagtacaaacagttgacttactcttagttccatgatatttaggtacgtacacaactgtctgggatatattaccaatcaactggtcctacagtatcgagaattttacactggcattttaagaccttagtaggattctcaacatacgtgtagtaccatggagtcacggacacactttggggagggaaaggccccacctggacccggctcctgttgctcttcgcatgggttcgcgtcctccgcgttcggcaccctccaccgcaaacact

SEQ ID NO: 651654 - DNA, 164 bp, Homo sapiens
tacaccacctgagtctcctttctgaaagaagacccagtgcagagcggcctttactttcaatttctactgctaaatatagattccaggcacagctgctttaaaagaaaaaagaatatagaaagatttttcttgccctttgtatacctgcacatgtcttctgcaag

SEQ ID NO: 651655 - DNA, 690 bp, Homo sapiens
tgccgtggttggcttcgtcatgcagaatgtttaaaaggccttaggtatatggagcgagctgctgaaaagctatggcaaggtggttgatctggcccactccaattttggatgcaggatttcacctttctaacccttcaggcagcagctgggccagctgagaaagctctggaagctctggaaccaaatgtatgatccagatactttagcacaggatgccaatggtgcacacgcaggaactgacgttatgcttcatcgtgctactctgtggttttcacaaggcaaacgtgtatggtatgtggataccttaccttactatgtaaggcatgctttcaaggtagcaatgaatcgagccaagtggttgatatccagttccaagtctggagagaggcatctttatcttataaggtatggagagacaaaatttagacaagaatgaccaagaagtacgaaatggtgatggcagaagaatattgagtgatacaggtctgacaaggatgatgggggaatctgtgagcacagtatcttatggactaaccgattacgaggtggagtgaagtagacaggaatacaattataagagaaagagcaaaaaattcgaattggcgactaacaatcagaaaacaaaagaagaagacaaacatgaagcacaaacgaaaaaagaagaaagtaagaggagaaaaaacaaaaaag

SEQ ID NO: 651656 - DNA, 663 bp, Homo sapiens
ggagacacagaacgtgctggagattgccctgagactcgagatgtgggctgaactctgcccctcggccaaatggcgccatcatcctctacaaccgggttcagtggaatgtcccactggagcggccctagtggtccccagccctactcccgcctgctctgaaaataataaacgactttattcttgtgattccgttggcatctgctatttcttgtaacagagaggagcaactgtggccctgcagtgtagatggctcctgtgggctggaatgcagctccgtaagatatacctcgctgcagcagtgggagcaacatgcgtgaactggagacactggtggcctgtgtgccgaaaaacgtcacaaagcctgcagagatgctgggcatctgtaccctgacctgcatccccaaggtggaccgttggtcctttggcatccactgccaattgagaacaatgtagaggtgcagggttgccttgaacttacgaacagcaagttgaaaactagagctgaacttggaactgcaagagtcaatgtagaagcaagcagtcggtgtcgacatggaggacctaggatatagtagagccccacatccgttcataccactgatccccacaacagttccaacttggacggtggtgcaaaccgtggctccttaggcagtacccctg

SEQ ID NO: 651657 - DNA, 134 bp, Homo sapiens
ctacggtctactgttttcagtgcaggtgtggtggtcatgcttataatccagcatttgggaggcaaagcaggaggatcgcctgagaccaggagttcaagagcagcctgggtaacatggtgagaccgcatctcttc

SEQ ID NO: 651658 - DNA, 371 bp, Homo sapiens
  misc_feature (10)..(10): n is a, c, g, or t
tcttcagctncaagtctggcctctccctcccagcaagcagccattacagaaactgaggctggccaggcgtggtggctcacaccctgcaatctcagcactgggaggccaaggtgggcagatcgcttgagcccaggagtttgagaccagcccgaggaacatggcgaaaccccattctctacaaaaaatacagaaattagccaagtgtggtggcacgtgtctgtagtttcagctactcaggaggcttaggtgggaggatcacctgagcctgggaggtagaggttgcaatgagcagagattgctctccagccagggagacagagtgagaccctgtcccaaaataaataaataaataagaataaaatttaaaaaag

SEQ ID NO: 651659 - DNA, 369 bp, Homo sapiens
ataccggccaatattaggaatggatgaggtcctgggcacctgagcagtccagcgaggacttggtcttagttggaggcattatggctaggaggatagtatgcggcacggttctgagtctgtgggatagctgccatgaagttacctgaaggaggtgctgactggtaggggttgatcacagggttgaaaccagctcgtacacttgccattctctgcatatactggttagtgaagtgagcctggcgctcatctttgcgctgagctaaagctacatacaatggctttttggccacaattctaccgttcatatctgtaactgctttagtggcttcttctggccaggagaaacatacaaaaccaaaccctttgctg

SEQ ID NO: 651660 - DNA, 157 bp, Homo sapiens
cggagcaggagtggtatgtgggggcgccacaacctgtcccccgatgtccaccgtgatccacatccgagcgagacctcgtgcctgacatgtggtctggtccctgtcaacaccctcttcatgaacacctgctgcctgggcttcatagcattctgtgtac

SEQ ID NO: 651661 - DNA, 512 bp, Homo sapiens
  misc_feature (1)..(1): n is a, c, g, or t
ngatctagaggatctcctccataatggtgccaacctcccatcccatcatggccgggaactcagtttttaaggtttccctgaagtcctcttggccaggagagggtctatttagtcaaatggggggggggggtgcttaggattttatttttatttccaagttataaggtgggaccatcagagcatgaatacgggtggagtctttaatcggtaaatacttagcaatcaccttcttctcagtaactttctctggaaggtggctgataagccagggttctggatgttggcccacttacccctcaagatgaggagtgaagaaattagatggcttggccaggaatttcctaaaaagaaaaggttcggaggatgcatgacctatgagggtgctgaggacccctttccaccaaacagggactaacttcggggtggctctttcacatctatggtctggtacgacgtacacagaagtgcagagcacagccgcagccctcacagcatcatctatctaggttctg

SEQ ID NO: 651662 - DNA, 381 bp, Homo sapiens
  misc_feature (53)..(53): n is a, c, g, or t
tatcatctactggggaaattttggcagttgatgtctaatgttgattttttttnctgatcgattttaattgttcactgggcactttggggtagaattgttttaaaaatttggttactgggaaagctagacaagcctttgctatggtgaaagagacagaaggaatatagatataatttgtaagtggttatgccattgggcttaatgctttgcatacattatctagtttgcatctcctgatcgccctttaagtttgcttacggtaaagcattattccttgcttggcaatgcacagagaaaaattatttgctgaaggaccctgcaaatgagggacaggatcagagttggaactgtaaaccctgccactccatttcatgtgatctt

SEQ ID NO: 651663 - DNA, 285 bp, Homo sapiens
tctggtcgtattgatacaaaatagatgtacatatcttgcacataagtatattatgctgtaggcacaggagaaacagcagtgaacaaaatagaagaggaaagcagtccctagttacaatatcggggggtggtagggagccctcatcattctcattcttggtcagcaggaaaaccagcatgcatcacactcattcaatccatcaatcatgatacatgatcagtcacggtcagcagcacagtgcctcttgcacagcacacaatcaaagccactagtcaaggaaggcat

SEQ ID NO: 651664 - DNA, 439 bp, Homo sapiens
ctgctttcctttctgtgtgttcaattgacaaaatctaaaaatgcgctagcttggcaaagagaaatgtttatagggtctagctctagtatcaaaaaggaaagcagaggaagggtggatccgtaactgatggacatttaatcgattattggcccttaaagagtattgtaggccgggtgcggtggctcacgcctgtaatcccaacactttggaaggctgaggcgggtggatcacctgaggtctggagttcgagaccagcctggccaacatggtgaaagcccgtctctactaaaaatacaaaatttagctgggtgtggtggcgggaacctgtaatcccagctgaggcaggagaatcacttgaacccggggagtggaggttgcattgagctgggattgcaccattgcactccaacctgggctacaagagcaaaactccgtctcc

SEQ ID NO: 651665 - DNA, 261 bp, Homo sapiens
ccccccccctttgggggggcccctttttttttttccccaaccctttttgggggccccccctttgccccgggggggcccccccttttcccttcccctggccttttgggccgcccgggtggtttttttaaaaactggggtgggggcccgggatttttttttttttttttttaccgggcccccccttctgggttttttttatgggccttagattattttttggggttttaagtgtttttacgggccggcttttccaacccggga

SEQ ID NO: 651666 - DNA, 214 bp, Homo sapiens
tcccttgacgccgctggcgatagcgatgattatggtagcggaggtgaaatatgcttgtgtgtctacgtctattcctactgtaaatatatgatctgctgcagcgctctgagccctaggactcatctttcttttaccgtaggcgccctgactggcattgtattagcacactcatcactagacatcgtactacacgacacgctctacgttagcgctc

SEQ ID NO: 651667 - DNA, 413 bp, Homo sapiens
gggtatggagtctcgctctgtcgcccaggctggagtgcaatggcatgatcttggctcactgcaacctccacctcccgggttcaagcgactctccagcctcagcctcctgggcagctgcaatcacaggcatgtaccaccatgcccagccaacttccgcatttttagcagagactggaggaacggagaatcggctgtgaacccggggaggcagaggtcggcagtgagccggagatcacgccactacactccagccgtgggagactccatttcaaaaaaaaaaaaaaaagaaaacataaatagagaaagctttgtgggggccgcgtttgggcgcttctaagaagaggcgttttgttaaaaccatattcgcggattgggggagcgcgcggggggccccaaagtgttggtttcacggg

SEQ ID NO: 651668 - DNA, 684 bp, Homo sapiens
tcggatgttggtctgtggggagccggacgacgctggaagctggtgtcggatggatgtagtagtgctggaggtgtcctgcctctgattcccttggcggtgatgcctcgggctgtccgtcccctgcagtgtcttagctccgagaggggaccctcttttccacagcagtcttctccagcctctggataatggtaacgtgcatccctcctcatcccttcaggatcagtggccttcagtgggattctgggttttactagtcctggcggacttgtggtttctacataatgtgctcgcacttgtgcaaaaaatcgttctcatagaaccctcctcagataattctgagtgtcatctatttcccatgactggttacagtatctcttcgtgaaaaagcagagtgcacttcaagtctgtaggaaaacccttttcttagggaggctgattatctgcgtctctctgctgcttatttggcctactttacaactttctaacgtaactagcttattggcatttactgaccgtcaattattgcagtcaccaataaagtgagtagtacatggtgagaccagaaatattggcgtcatattagcacgataggacattctttggctctgaagtctcccttcgtgaagacttcacacacggttgcttcagccacacagttgctgctcaggttttatgtatagatga

SEQ ID NO: 651669 - DNA, 687 bp, Homo sapiens
  misc_feature (559)..(559): n is a, c, g, or t
acgataccaagctaagcgggtgtttctactggctactgcgcctgaaagaggctctataagttcattcacacagcatggcttatctggttttaacattatggacaggatgagtacctagtaacaccgcattgcttacgatagatagactgcattgccctgatattgacacaggagtgctgtccttttctcaacgtgtagatgtgatgtccttcacaacggagtaatatgagaactgagccttcaatagatgaacatttctgcacagcaagaacctaatcttaacatccaagaagagttactctgtaatgtagataacagactttcctagtttgcgattagtctaatcggaaactacggcattgttgcaatgatcttcctatacagaatctgacagttccctaacatattgatgagcctatggatcatacactgtatacgatgtgaaatggcagcaatggaatcttgagatagttctttccaatggggcaagtaccgatataaataccactgatcatgaggatacttaccacgatgcatattgtctcagtcgtgtatctancataatactctctgatagacggcgcctggagataatttctaaatctcagagttagctcatattgtccttgtggaatgtattcatattgataatttgatatcttacttgagaccacatagataggtgtc

SEQ ID NO: 651670 - DNA, 95 bp, Homo sapiens
  misc_feature (16)..(16): n is a, c, g, or t
  misc_feature (60)..(60): n is a, c, g, or t
gtgctacctccacaanctttcttcttcttcatagtgaccaaaccccatttctctataganatcctgattagtatttttgattggcatgtagcctc

SEQ ID NO: 651671 - DNA, 396 bp, Homo sapiens
tacaatcagatatatgcccgggacacaacgagatctagcccgaggactactggagtgtgccggaggatgaccacaacctactgacagaacttgacatctctgtgtgccttccgtgtcatcctagatcatccacacaaatgatgcctcctcacccatgatattctgcagtcattctatataacaaataatgggcttctccccccaaaaccttcgcatggggccatatttattttgtggcttacctttccctcccagctcatggccatgtatcctcatgtataatggggggcactgagattggctcacaacacgggcagcctctggatctgggagaagtgcaatgtcagccatggaggaagagcagcaccgagtctaatctgagggaaggaacaggac

SEQ ID NO: 651672 - DNA, 174 bp, Homo sapiens
ttggggccccattcagggtagaaactttaggattccagtctaaatcgtgatgaatatcagggacagaaatatcgacagggaaatggtcctctacccttagcaaattcaatatcatcgaaaggaatcccattgatttcactaggcttctctcgcaaaagtagggtaccgagctcg

SEQ ID NO: 651673 - DNA, 1285 bp, Homo sapiens
gaaggaagtcatccgcccgtccctcatctgcgtccggaaggaagtcatcacgcaccgtccctcatctgcgtcctgaaggaatgtcattccgcccgtcccatcattcggcgtctggaaggaagatcatccagcgcggtgccacatcaggcggtcactgacaggaaatgagtacacagccgtgacgtacatactgggctgtgataacggaagaaacacatgcaggcacgataccaatagcatgcgccacgacacggagagacacacacagcgcggagccgacaaaacgagcaaggcacgagacagggaaaaaaacagcagcgcgcgacataaccagagaagagcacaacaaagaaaagagaaacagagaaaaccgggaacccaaagacagagcaaacacagaacgggacgaagacagaagaaagaacaggaaaaacacagagactggcgcgaacagaaagaggaaagaaaaaaaagcacaagggcaacacgagaaaggccagaagaaaagggaaaaaaaaaggaaagaggaagaggcaaagacgccagagcaacagcacggagcccaccacgaagaaacggagaaacaaggaagccgggcgccggaccaagagaaacagcagccgacagaacgagcaaagaaggagaacaggtggacaaaaaaagaggaaggagcacaagagcgccaggaacacgaaaaaacagagcggaggaaaaatcagaagggagggacgggcacgaggagcgagaaaggagaagaaagaacagacacgaaggagagccgaggcggaagagaggcgcagagcggggagacaggaaaaaaggagagccggagaggagacgaacgaaggaaggaacgcgacgaaagaggacggggggagaaagaacaaagagaggcgaggaacagaagcgggagcaggggaaggcgaagcgcgacaggagaagaagaaagacgagcgcagaaggaagcggagcgagacggaaccagacgcggagaacacgggaagacgcacccgggacaggcggcccccacagagagagagcagacacggacaagggcgacgcgacgaagcgaggacacgacgagacacgaagtggaagaggagaaagaaggagagagaggggggaatagaaagagagaagggaaggagaaaaagggagatgagaggaagagagagaagaggggagagaaagagatggagagaaagaagagactgagaaaagaaggggaggaagaagggagaagataaagaagaagacgaaaggtctgatgttcgtttgaggatgg

SEQ ID NO: 651674 - DNA, 894 bp, Homo sapiens
  misc_feature (663)..(663): n is a, c, g, or t
taaacctaatagggttaagtattattatgatttccatgtttacactgaaaggaaactgagctgcgaggtcagatagttagataagggattgttctgggctgaagaacaaggatcgcaatgtggggggagaagatagtctttgcccctaaaggtactaccgattcatctagtgaagtcttagtcggtacgtcaatgaattgctcaaatgccatgagtttccattcctaatctatgcatgcggtacttgacgcctgctagaatacacgatcgatgttgacgctgggaacctctcccctcgtggtaggtatgggattttcagttttggcattggtggccatggcgaatttttaaagaattcgcgcacaggggctgcattcttttgtatcgcacaaggtcagagctgatgatagccagcgttgttttctagccacatgttacggaagtagagaactgaattcatccctcctttaggagaagtctggtcgactcatatgtagggcaatgtccctcttagtcttcccttggccccttcgctctcactacgaaaagcaccatgcatttcccataaatgccatggctcaagtcatagaatttttttcaatggagtcttcttgtattgcgtttgcacaaaagtcttagtcttccccgggggacagctctctntgggttgcaaaatcgataattgctctgagaggggcttataaaacaaggaagcctacatatatagccaaatagccacccccgaatcaagggggggttaatgccattgtacggcattggtgatttgggctgggcacgctatccttttccttattccaccgaatacgttcgcaatttaatatttccatggtagggcgggggattaacccggtttttgttccggtcattgaagtc

SEQ ID NO: 651675 - DNA, 260 bp, Homo sapiens
gggttttttccccccccccctttttttccccgggggggccccccccccccccaggggggaaaattttggccccctgggaattttttcaacccccaccgggggggggaatttttgggcccccccggttttttttttcccccaaaaaagagggatttggttttttttccaacccgggggggcccttttttccccccagggggggggggcgggggtttttttttcccccggggggggccccccccctttttttttttttttta

SEQ ID NO: 651676 - DNA, 1559 bp, Homo sapiens
cttcttatgtggttgcttctcatctagtatggggtggcatctttttttggtcttcgttgtgcgcacgaacactccttggtgttcttgttgttctatcacaaacagggagggttggccctctcctcttctccgactgtataggctcgtctgttgtgtgttgctgttgcgcctctacctcctcctctctctctcctggtttggtgtatatcactctacttgtgtccttcgctccgtcctactccgtcatgttgatcatgtacgcttccccacatttgtttggttttgtctgcgccagccgtggtgtatgttgtcgcgatcccgtctttttttttttgtagcatcgaaggacgggatggttctgtgtggtgtattgtatcccgcgctgtgcgtgcatccgttatgttttgggtgtgggtcgcctctctcgctccccgtgtactcttctactgtggtttttgtttttcccggcacagtgtattatctctctttaggtagattgcttcgggggttgagcgtttcctctttgcttccgtttgtgttgccgttgttctgctccccgcacgattgacgacttctgttctcctccctcgctttcgttgtgtgagtaagtaattagctccatatttgttgtcttcgctctcgattatgtagagggtgctctcacagctatatataatctgatttgctagtatagtattttatttagtagtatatttgtgtgtcgcgactagcgctcgcgtcttgtaagagtgaacaaagacaacactattgtgttgatatactacaagagaggatcgatataggtagagtagtagaagataagataaggttgttgtgctcttcagcgactacgatagatattttattttggctcttcctttctagttctgggttgcgcgtcgcacatcattgttgtttggcggagaatatatgagtgtgctgcgcgggtctgtgatctattattgtctatctactacaaaacaatatttatttcatatatatatagtatgcttacgctcctcgacgtctgtggtttagaagatatctcttgtgtgtagtcttagactactccacccatcgtcttcgtgtggtggtgtagcacgcatcacaatgtattctcgcgcccgcgcacccacccttcgtggtgtgtatatataaccagtaatgatagtttctatctctctctcgctccgcgcgcgtctatctctgtcgccctatctgtattgatattccttgcgcgtggatgtttgtttatatataagggtgggtattcttgttttctctggtctggcgtggtgtgtgtgcgtacacacaaacattttgtgtgtccaccgcgctgtttcctctcgtcttgtgctcctcggtgtgggtgtttctaatttctctcttggtttctctcctccttcctcctcccctctcgcggctctcctccctgttgtgtggtggggtgcgtcaccacgggggggcgccccccccgcggctcttgttcggataatgtttttttttttttttttggggaaagggaaaagaagaaaaaaaaataccaacacacccccaca

SEQ ID NO: 651677 - DNA, 102 bp, Homo sapiens
  misc_feature (2)..(2): n is a, c, g, or t
antgttcgtccccgctaccgcagccatctcatcgtgtggtgctgcagttgtcccagaggtgtctgcatcaacgctgtcttctatactcctctcgcagtctct

SEQ ID NO: 651678 - DNA, 254 bp, Homo sapiens
  misc_feature (33)..(33): n is a, c, g, or t
agtcgacacagcaactggctgagtctgtggaanaggccattgaagagaaaaaataccttgctggggcagaccttctactgtgtgaattgtgttaccctcctatcattcagagtggtggcactataatctccagttcagtgtggtgagtgacagaatcatatgcactttggtgctatcacttgtagccatgagtattcgcttccagtcttaactggtccaaccttgttcggccttttgatggttgatccttctca

SEQ ID NO: 651679 - DNA, 400 bp, Homo sapiens
  misc_feature (400)..(400): n is a, c, g, or t
aaaacatgaatctaaaatattcagcttgatgagttttttcaattgcttatactcaggtaatcaccaacccaaacaacacataagcatttcttctgccaagaaagtttctcccgccaagtaactttctccctacctctctacaatgttccataatccaaagcataaactttctaatttccagcactaggttagtttgcctatcattgggcttcatataaatataacatacaatacgcactcttttttgaagttttttatgttggtataatatgtataacatgaaacttgccattttaaccattatttatacaatttggtgtcatttattacattcacaatgttgtgcccatcaccaccgtctacctctttgtagctcatttcattttaccagcctactgcn

SEQ ID NO: 651680 - DNA, 282 bp, Homo sapiens
  misc_feature (244)..(244): n is a, c, g, or t
acgtacccaacagagtctgaatgtcgcaattctgagtgatagagcatctttgttctaactaggacatcttaatgggcttctgggtagcttcaaggtggggactattcacccaaaagacacgagctaaattgaaaaatgtggaactttcagtcccaccctttgacctctggagattggaaaggggctgaagattgagtttaatcagcaatcagtcatggcctcataatggaatctctatacaaancctaactgatggctggagtatggggagagttcagagag

SEQ ID NO: 651681 - DNA, 339 bp, Homo sapiens
gcgtacgagacgattgacgctagaggagcgccggcaagagcgccccaagagcagtaccttctaacgtagagctgcatgctggactaccagcaggcacacacgtgtaaaggggcccggagccaccatagggcttctgaacagtcagcacattcggagaatcgacctcgctggagctcaggaaccttgatttgtgaggcagcgcctgcgacggacacacacagtcctgcggtaacagtgacgtgatgcctctgaccatatgagacttgtgaaggtcatagcctcttctgtaattggccccggactgtacacgtcaagggcaaccacgctggacttcagact

SEQ ID NO: 651682 - DNA, 449 bp, Homo sapiens
  misc_feature (426)..(426): n is a, c, g, or t
  misc_feature (449)..(449): n is a, c, g, or t
tgtaatgctggaggcctggacccatggggaagtcctcgacccttgcccagttcaggagaggcagggcctcaacccttccccagtttatggggcctgcagctttgccagtgaaagaggaaagctggaaagagacccagggctgtgggtcccgcaggaggtggggagcggcccctccgttgtgggaaagcaactgccgcaggccgggctgacctcatgggttatgcaacccaggccggcccgggggctgcagggagcagctcccattgtgtaggcctgcctggggatcagcagctcaggctcctaaaccacaacccacgtggctcccgatgcctcctgacccgtttagcagaaggtggacagctttcccgctcaccctcctcctgccctgggcgtggcagggaaatggagtaattaaagccttttggngattatcaagaaactgctagatn

SEQ ID NO: 651683 - DNA, 235 bp, Homo sapiens
  misc_feature (14)..(14): n is a, c, g, or t
  misc_feature (28)..(28): n is a, c, g, or t
  misc_feature (37)..(37): n is a, c, g, or t
  misc_feature (105)..(105): n is a, c, g, or t
  misc_feature (147)..(147): n is a, c, g, or t
  misc_feature (187)..(187): n is a, c, g, or t
aagttgttcatggnaggcatttatcctntcaataatncaaacgaggcttctggaataaccagtgccccattccatcagagtctttgcgcgactaaagcctccatntttgccaatttcaattgtttgggattctagcactccttaccngcagtaatgcccttgctgcagacaacaacacctggactgngagatggaccaattctcaatggcaatccagggaaagagtgatccttct

SEQ ID NO: 651684 - DNA, 92 bp, Homo sapiens
gttttaagggggttttttggggggccccccccccccctttggggttaaaaagggccccccttttttgggggttttttggggggggttgggga

SEQ ID NO: 651685 - DNA, 285 bp, Homo sapiens
taggttctacgaagacaaaggactcggactttaagaggcattacgtgcaacatgaaagagctaggacaccaaattgggaaaattcagcataatctacagggtgaccatctcactaggctggctttataaccgtggtgtggccatctttaaagggcctaaatgcagcacagtcacacgtgtctacgactggcgaaaaacagtgagtgcacaggagaactgagtacaaataacccaattctcccagcctccaaggtgaaacctcatcttagttacaatacaacggca

SEQ ID NO: 651686 - DNA, 83 bp, Homo sapiens
atcagaagcaaatatggcaaaatagtatgtaaagggcacaagggcatttataatattatttttcagcatatctgaaatatttt

SEQ ID NO: 651687 - DNA, 875 bp, Homo sapiens
caagatccacagtgtatgctggcatcgatggctattccacgtacagcagcccattccactttagagtgttagatgatatgcacctgggacacaaggactagtgtatgacatgcccgtagggggtagcacgctgcttcgacccggatctcggaacgatcgctctgccgaccataacagaacctgaggtgccggctcgaaaaggagccgtcaccaccgactggcacacccatggtgatcaaagttagctacacacctgacactttgagctatcgttgcctaatatgtcgtagttatgagaatggatctgagactcacaggagagaacggaatgcccaacagactgctcctatagtggtaccacatacagcttatactagaccttgctgatcagacacaagttgcgtgcatgagatcaactgcacgatacctgcctccctaattctgacagggtattcgccgtggaatggtattaagctagggactacgaatatgagccgttccaggcttaaggcttgatacatcgggaacctggttttagcatccgtgctgaagatacactcctttgattggaaaggcaagcctcccagggtacatgctccagaggacctttggtcaaaaaatgtaagtgttggagaaattacccgctggatccggacttcatcgccttggcccaattgtgttgtttcacattaggcgggtccgaaactaccctgaactgtaacactgaaagtggggcatacgcgggcccttctctgtccgccccgcaacttagggcgacgcccagtgggggggaaaacgcagtgttataactacgtggaaagatgtatggacggaaaggaggccctatggctttgcaacaactgatatagaccggg

SEQ ID NO: 651688 - DNA, 503 bp, Homo sapiens
  misc_feature (103)..(103): n is a, c, g, or t
  misc_feature (115)..(115): n is a, c, g, or t
  misc_feature (138)..(139): n is a, c, g, or t
  misc_feature (266)..(267): n is a, c, g, or t
  misc_feature (269)..(269): n is a, c, g, or t
  misc_feature (287)..(287): n is a, c, g, or t
  misc_feature (396)..(396): n is a, c, g, or t
tgggactatcgcccgtgataccttctgcgtaatgaattgacctagaaataactttgtcaaggtagagcctacagcataagtatccccgaaaccagacgagctncttatgaacagntataatagcacacccgtctattnngcataatattgggaagatctataggctgaggcgagcaaacctaccgagcctggcttatacctggttgttctctatagtaatcttagttcaactttaaatttgcccacagaaccctctaaatcccctnntnaatttaactgttagtccnaagaggaacagctctttggacactaggaaaaaaccttgtagagagagtaaaaaatttaacacccatagtaggcctaaaagcagccaccaattaagaaagcgttcaagcncaacacccactacctaaaaaatcccaaacatataactgaactcctcacacccaattggaccaatctatcaccctatagaagaactaatgttagtataagtaacatga

SEQ ID NO: 651689 - DNA, 473 bp, Homo sapiens
  misc_feature (1)..(1): n is a, c, g, or t
  misc_feature (68)..(68): n is a, c, g, or t
  misc_feature (140)..(140): n is a, c, g, or t
  misc_feature (145)..(145): n is a, c, g, or t
  misc_feature (162)..(162): n is a, c, g, or t
  misc_feature (204)..(204): n is a, c, g, or t
ntctacctctgtgtggggcccacaggcccagttgagtcataaatccataggtcctgggtggggtttgncagttgaccggaatgtaaaaagtcctgaaaaaccattctccaaaaggcccaaatctccaagttcctaccaanttagnggatgttaatcctaccnggaaccaattgggggaaagtcacaaaatcttggggacctctngcccacaagaccctggagcagtaaggggttatagaaaccacatctttatttgagtagaattcaaacgcaattttcctcccataatcttaatcttgtggcttttcattagttttatatacaggttttggtccctgaacagtgttgggggatagttttagggagggattgttttcattcttgcttcaagtttaaagtgtaaactaattttctcccatggttagcttggcctatgcccaggaatgaatgaggacagccagcctgtgaggcca

SEQ ID NO: 651690 - DNA, 536 bp, Homo sapiens
  misc_feature (205)..(205): n is a, c, g, or t
  misc_feature (221)..(221): n is a, c, g, or t
  misc_feature (274)..(274): n is a, c, g, or t
  misc_feature (301)..(301): n is a, c, g, or t
  misc_feature (376)..(376): n is a, c, g, or t
  misc_feature (418)..(418): n is a, c, g, or t
  misc_feature (435)..(435): n is a, c, g, or t
ccttctgcaaatttattttccagctcagtgtttccaatggcttttgctgcttgacacatttgtcgaaacaatttttccaggcgcctcatacaacgaattatgctgccttcaaagacatctgtcattttgcagaaatgggcaaatgtagctccagttgcccaggtatatactacatccattaagtgagggttaaaggagctgcggnaggtttccgtaggggncgggggttggcttctggtgaaacttttgcaattcttttagacaattcgtgganttgccaaaaggtcctgctattgttctnttaaattgggcattttaactaaaattgttctggaaaacaaatctctctggagaaggtttttgcccgattttgcanaaaagttagtgggtaaggggcatttaaaccttgtggtggagnagacggggcttgctcancagtgtgaatgctacgggcctcttcgctcctagcaggtgtgttttacctccgaaaaaatggtcataaccccacccttcttaagacaaccgtatgtgtcaca

SEQ ID NO: 651691 - DNA, 829 bp, Homo sapiens
  misc_feature (188)..(188): n is a, c, g, or t
catggcggcttcagtgagcagagctgggcactatccatgccggcggatgtgcagctagcgcaggaagccatttcatgaccgttctcacaagtgtagtgtgcataaccaacatcagaagacagtagtagcactcgtgtatctaaacattgcagcacaccaatccatgaattgcagaaagtacatgtacncgctggatccatgtagtttcccatcatatcacgtatccaagtatttgacacacaccaagttcgcagaggtatcgtgtccagacactacgcactcacaatgcagagtcttcactcaggagtagcaccgtcacacgtcgatctagagagccagaagattttcagtggcgagttttcattcactaatacatgctgagaatggctattccacgttggaaccacacagtccaacgaaattgcatagcattggacgaaggacgccgcggtacaaacaaggcggttctttggcacatgctttggttggcaccacacatacgtttcacaaatgattcatgcgtaacgtcggcactactagtgcaaggccaatacatgcaatggcagggggcgccctgagacttgtctgaattcgagcggccacgggagttatagcaatctagctggtgtgcagctgcacacacgttggtggacgacgaacggcggcactacctagggccggatcttacaaccgacaagaggaaaggggcacagaacccctcacacatctagggtattacagcgaaaggaatgtaatccccttgacgaccctgtgttcccacgaaccgcgttgggtgttaattttacaggaccgtcattgtcacctctcg

SEQ ID NO: 651692 - DNA, 152 bp, Homo sapiens
agttcacagaacatctaacagtgcccctcaagaatagtttactcagattgtagatacattacatctccatgccagtctacagtcattaaatacctctaacttagagaaggcaaaaagaaataaaatttgcatattaaaaaaattgtgcattc

SEQ ID NO: 651693 - DNA, 1030 bp, Homo sapiens
cgggaacggggagcgcggctgcagcacccctgagccgcgcggacctccgtcgccccgggcgcacccgcccctgggtcccaggtgtgtccgtctcgggacggtcgataccctcgcagagccggggaagaggacggaggggggcccagaggaaggagggactcagggcgcgcgcgccatgagccctgcgagcacacacgacgcgcggtgcggcgaatgcgctccgtggccgtgagcgcccagctgtggggcgggggccggggtccatgcgcggatgtccccactccggaccggagcactgccggtgacaggagagcggtggagtaggagagggacagcagcagccataggatctccattagactcaggccacattggggcagggtcagacaaacccagaaggggaacaggaacaagaggaagcattagaagaccctcagagggacctggggcacctacacaccacgagacaccaagtgcttcatgaaagggaccaccaagagacgcatgcccggcgacagggcaccgtcagagaccaaactgggcacccggagaaggggataattgagtgaggcactggccatagagcttcgaccccaaggggccaatccgcagggacttgggccacccagaaaagcaaccatgggagtaaggcgttgcgcacaagaaagacgcagcgtagccacccagctaagataaccaagaggggcccgtaagtgggggcccccaataatcgagccactctaccccgaagaccaccatcgaacaacagagccctatgggacaaacgggacaacggaggcgccgtgacaggaagcggaggacggcatcgaagcttcgagggaacccatagggagaacacagcacgacaacaattcacgcgaagctacctggcgaccgccgggcggcgctggcggaagaaacagcaggcgaaacatggcgtaacgattgccacgaagcccgagttaccgctcgagccagggagaccggactgaatcgccgtacgcactcacacataccggaactgatcacg

SEQ ID NO: 651694 - DNA, 614 bp, Homo sapiens
gggcccttgcggagactcacccccttcagaggtcgctgcccccaggtcagctcttattgcgggccgctccgacggcggtccatcctgtcagggactatgcggcgcaaacatctccttcgccaaaaacaggggccgcccccgggcgcatcgtggcggtcattggcgcagtggtggacgtccagttttatgaggggctaccccccattttaaatgccctggaagtgcaaggcagggagaccagactggttttggaggtggcccagcatttgggtgaaagcccagtaaggactattgctatggatggtacaaaaggcttggttaaaggccaaaaagtactggattttggtgcccccatccaaattcctgttggtccttaaaccttgggccaaaatcatgaatgtccttggagaacccctttaaaaaactgtggcaaaaactgataagctggctgaaaagcattcatcgtgaggggtctttgtcctctggactgtctctctccctgcccctaacccaaaaagcttcatttttttgggtagggtgcccaaaagccttgattgaaaaaatattctttttgaacagtatttaaggtttccaataaaatggaccccccccca

SEQ ID NO: 651695 - DNA, 267 bp, Homo sapiens
ctttttggccccccccccaaagaacgtgggggtccggttttttttgccccttccccgcccctgccgaatggcccccgtgggtcccttgtccccccctgccctgggggcccgcttgcctttttcagctgcccccccccccctggggtggccccctccccccccgtggaaggggccggggtttgcccttccccccccttcccccccccgggcccctaacctggcccttggtttggcttttttttaaaataaaattgtggggggggtcca

SEQ ID NO: 651696 - DNA, 225 bp, Homo sapiens
ggtgctctagaggatcctctcctaccccacgtacagtaaggagcagacaacgtggcacaggccaaatagaaaacctatttgcataataataagattagggtggggtggccagcttcttccagtgctatgtaaacgtctcaccccggtcaaacaatcttcgggccctatgtaaatcagacaccgcctcctcaagccagtctataaaacccccgtggggtaggaggt

SEQ ID NO: 651697 - DNA, 1610 bp, Homo sapiens
  misc_feature (5)..(5): n is a, c, g, or t
  misc_feature (9)..(9): n is a, c, g, or t
  misc_feature (101)..(101): n is a, c, g, or t
  misc_feature (109)..(109): n is a, c, g, or t
  misc_feature (113)..(114): n is a, c, g, or t
  misc_feature (275)..(275): n is a, c, g, or t
  misc_feature (279)..(280): n is a, c, g, or t
  misc_feature (291)..(291): n is a, c, g, or t
  misc_feature (562)..(562): n is a, c, g, or t
  misc_feature (693)..(693): n is a, c, g, or t
  misc_feature (776)..(776): n is a, c, g, or t
tcatngctnagggtttaatttcctcaaaggagccacgccatgggccttcccaaatacctccgggtatccttccaatttccaccattcccaacgggtcaganttccattncagnnttcctccaacctcagaccaaccacttttcttttcaaaagctcagaccttccaaattattttaaaaatgtgaattaaatgtgttaaattaccaactttctcacttatttcacgagaaagaggggcgagcttagaaaagagtttacacctcgtggtgccacanaganncgtggggaacnaccccgcggcttcgttagacaagccgtggcgaaggaactcctctccttgtgtggtacccaatttctcgaagagtctcccacgggtgaaaagaatggaggctcgtgcaagcgggtgtgaaagtttcgaggtgtagaacgaggtttcagaggggttcaccccaccagcgtggcgcctttcttctcgctgcgagaggagtgtgtgctccgtgcttgtggcaccccgagtgccgcaaagcctgtgggcgtctccgagggggcgcacaagggggcngagtttgtgcaaacagtgggcccattggggggcacacagcgtgacacccgaggctgtgagctttgtgagtgtgcttgtgcccactggtgtggccctccctgtgtgacagagtctttcaaaaaaacccgcgnggtgacaatcttccggaaaaagtctctgaggcaccgccgcgtgtcccacacagggtgttggcggcggcgctcttcttgctttnagcaacgcggtgtgtgtgtaggacctgttctgaagcaccttctacaccaaggggacaaagaaggtcttcctcttccaccagagcgggagacccaatcgtttggtgtgtgtgggcgcctcttgggggcggcccacacaatattacatctttggcgcccttggggttggggcgcaaatggtgttgatttctgtctaacacgcggccccctcaggagtggggcctaacgcagacaattcacgaggggtcccacccccacgaggagggcacacccacgcggtcggcgtcatcatgtttcccctttttaacagcttccctcttgtggggcgcgccccaacacaagcattagccaacgttttgcccccaacgctttgaccaacaacttgctcttctgtgagcaagacgatgggttataggacatacccctccatcgctctgacaacatcgtctcccgggacaaccccccccagttggggatatcagaccgcggacctatacggcccgagccagggacccctcgttgttctagggcggagcccacgcttctcccgagggggaaaacgatcccctcttttcaccttaagctctcgctgtgtgaccaccaggtggtgggcacaaaagaaagttggagcgtacagaggatttctctcatctacgtgcgcaccccgtggtagtacacatcctcggacgagcgttcccggccaaactgtctctcgacatagacttttcggcggccccctattgcttctgtcctccagaaaacccatcatcaaacggggcttcgtgataccacaacgggtagtcggatagtctagcacatctagtgctgcgcaaagc

SEQ ID NO: 651698 - DNA, 121 bp, Homo sapiens
  misc_feature (55)..(55): n is a, c, g, or t
  misc_feature (71)..(71): n is a, c, g, or t
aatggcagttctatttctatttatttttgagacagggtctcactgtgtaatccanggctgagtgcagtggncagtcttgggcactgcaaccaccgcttgtcaggctcaagcaattctccca

SEQ ID NO: 651699 - DNA, 635 bp, Homo sapiens
  misc_feature (365)..(365): n is a, c, g, or t
  misc_feature (381)..(381): n is a, c, g, or t
  misc_feature (389)..(389): n is a, c, g, or t
  misc_feature (603)..(603): n is a, c, g, or t
aacgagtcaaccggatcggtgactgtggagggcgagctgagccctggccgccgcacaatgggccgcgagtttgggaatctgacgcggatgcgcatgtgatcagctacagcttgtcaccgttcgagcagcgcgcctatccgcacgtcttcactaaaggaatccccaatgttctgcgccgcattcgggagtctttctttcgcgtggtggccgcagtttgtagtgttttatcttatctacacatggggggactgaagagttcgagagatccaagaggaagaatccagctgcctatgaaaatgacaaatgagcaacgcacttcgggatgacggttccctggtcttctgaaagacctttctctggaaganggagtctgcattgtangtgtctcnaaagacacaataaacttcctattggcctgcatagtaaaaaaaaacaaaaaagcaaataatgtacgactcccactcataaaacaagggcgggcccaccccccaagacataacagcccaacgcccctctcataacccggtccgttctcaatgaaccgctgcgcattttttgatctccggcacacctttttaaaccgcccccaaagcggggctatcnttttaaattctcggagactgtggaaccctctc

SEQ ID NO: 651700 - DNA, 256 bp, Homo sapiens
gttcttgaaaacggccttcgaaggtaggcaacgaagtagaacggaagctgattatctgagagatgataactgtccaccaagatcgagcagagtagagtaacttgatatcatgggactaaatgaactaatgaggataatattttcataattttttatttgaaattatgctgattctttaaatgtcttgtttcccagatttcaggaaactttttttcttttaagctatccacagcttacagcaatttgataaaatata

SEQ ID NO: 651701 - DNA, 741 bp, Homo sapiens
gggcctccgtgctgcgaagtatctcgctagccctgcgcccgactagcgggcttctggcaacttggcagacgcagcttacagagactcaccagccgagcgtcattgtcgtctttctggtaactcattcccatgcagatcagaacctcttcgaagaacagaagaaggtagatcctaccagaacagaccactgaagcatcggagcgcttgaaaaggaagatccgaaaactggaaaaggctactcaaggagctaattcctactcgaacgattcttattacccctcctatagagttgcttggcatgaagagcaagagagctgggctctcaggtggagcctcaccttgtgaggagactgagaggagagctctgctgtctgaaagcaggtggtcctgtgtagcaagcgagtcaccgagctgtaaagatggagagggacaccatcagtggctatgctagatagcccagcttatggaatgcctctgggaggaactgccaacttggtatagtccccgcatagctcctatcgctgaggccatcaggtcgggatcctataccttgtttcccctttgagaaggagaggttggcacactgacagcaccaccgatccctaaactaccaagccccggtgcaagggcaggtgcaaatgactttcaccaagtggtgtacacacaagtggtagcttgtaaagaagataagacttgtcaggctgctatacttaacttgctggccctgagagtatgaatgac

SEQ ID NO: 651702 - DNA, 329 bp, Homo sapiens
atggaaagttcatacttagctgttctagccccacccaagaattttcgccatctgctgttgttacaccacaagattctggtagttgatttcgacggcggttccacacgacaactagtgctatgtcgctacaaacagtagggggtttgcatcaggtatgacgcctgttcttaaacgaactttctgtggtgaaatttataagtggcgagagccacgagaaggatagataagagaccacaaaccacctatgcggcgttgggtcacacaagcacacaactatccccaccctcttgggggaaaattccattaaaggtaattcccccaaaaaaaca

SEQ ID NO: 651703 - DNA, 625 bp, Homo sapiens
gctgatcatccagtcctggtcctgatcactgggccctgattctaatcactcagacctccttttgatcactgaaccctagtatttatcactgagccctgatcctgatcgttgggccctatttctggtaactgagctctgatcctgaccactgacctctgttcctaatcactgagccctggaccagatcactggcccctggtcctgatcactggcccctggacctgatcactgacccttgttcccgattgctgagccctggacctgatcactgagccctgttcctgatcactaacccctattcctgaccactgagccctggtcctgattactgagccctggacccagtcaatgacccctgttcctgatcactgagccctggaccaaatcactgagccctggaccagatcactgggccctggtcttgatcactgggccctggtcctgattactgagccctgatcctgatcactgggccctgttcctgaccactgagccctggaccagaccacggatccctgttcctgatcactgatctctggttcttttattatgcatattcattttgaaatctgattccttttctgagcatgtatcagtctgactagacactgagtcctgtctgaaa

SEQ ID NO: 651704 - DNA, 454 bp, Homo sapiens
  misc_feature (132)..(132): n is a, c, g, or t
  misc_feature (153)..(153): n is a, c, g, or t
ggattcacgggcgacgtgaagaggagggaatggagtgatgcgtttgaatcaggcatagtctcgtacgtgtcatccaaggagcccggcacagaacccgtgtcacccccatgtcacccgcagaccccgcgtcanccatagatacgcacaccccgngtcacccccatgtcacccgcgtgtcacccacagatacacggcccccgtgtcagccacagatacacggcccccgtgtcagccacagatacacggccccccgtgtcacccgcgtgtcacccacagatacacggcccccgtgtcacccgcgtgtcacccacagatacatggcccccgtgtcagccacagatacatcggccccgcgtgtcagccacagatacacggacccccgagtaaaccgcgtgtcacccacagataaacggcccccgtgttacccgcgtgtcacccccaatacagcgacaca

SEQ ID NO: 651705 - DNA, 659 bp, Homo sapiens
gctgatcatccagtcctggtcctgatcactgggccctgattctaatcactcagacctccttttgatcactgaaccctagtatttatcactgagccctgatcctgatcgttgggccctatttctggtaactgagctctgatcctgaccactgacctctgttcctaatcactgagccctggaccagatcactggcccctggtcctgatcactggcccctggacctgatcactgacccttgttcccgattgctgagccctggacctgatcactgagccctgttcctgatcactaacccctattcctgaccactgagccctggtcctgattactgagccctggacccagtcaatgacccctgttcctgatcactgagccctggaccaaatcactgagccctggaccagatcactgggccctggtcttgatcactgggccctggtcctgattactgagccctgatcctgatcactgggccctgttcctgaccactgagccctggaccagaccacggatccctgttcctgatcactgatctctggtcctgattattagatcctgatgctagtcactgggcactgggcactgggccctgatcctaatcactgaaccctgctcctgatcaatgaaccccggccctgatcaaagggctttgctcctga

SEQ ID NO: 651706 - DNA, 160 bp, Homo sapiens
tacaatactcacttgctagttgaaatatgatatgattcttgatacagcttctctttaagctcttgttggtataaacatagtaactgtccctcttaagcaaatgaggcacacagggcttgtatgaccactgaaaaggacgaaaagcgacacacggttaata

SEQ ID NO: 651707 - DNA, 227 bp, Homo sapiens
tacacctagctaagtttgggctttctaaatatcatttcctaacgaagaggaaccagggctcctggacaaaggggcggattacagttccctggcagagaacatacaacgtaaggcttagaatatcttgtgtaccagaaagtagactatgggagatacactatgatataggagttggtcccacaggtcaaatttaggacaatctgaacatgaagaagaataatcgtagt

SEQ ID NO: 651708 - DNA, 117 bp, Homo sapiens
cacaagaggtagaatggggaggcaagatctcaggcaccaggcaggaggtgccttgtaagctaactgggcgtcggttacatgcagttgtcaactgtggctctgtaactcttcaatagg

SEQ ID NO: 651709 - DNA, 786 bp, Homo sapiens
tggatgggcccagttgtttatttaaaaccctgatggtccaaaaacatggggggtgcttcacacctttttcactggggatggtggcgggaggtgtgaatagggcaagcatttcttaccatttctcctcatgcaacaagatggtagaagggcctccctcaacctcaaaaagcaacaaattggtaggtgggacaggggaggggcatgggaaaggtggaagaagggaaaactccctaagggcaaattctcaatataagaaagagggcgataaaaagagatctctccaaaatatctcctctataagtggagcagggtgtggtggcgcacgtgcgagtgtgccctcaaggtgccctgtgcgataaagagtgatccggtgccctctcctgtgtgctctctctctatctataacacgccacctctcacaactatctaaaagaagatctctctataagtggagagatctctctccccaggtgataagtgagacagagacatagtggagatatattatctctctaataatcttcatatatagcgcgtgaggacacaaaatattataaacgaggagtagaaaaataggcggcccacacaatgaagtagagagaagaaaagaaggaaacaggagatggagatattcgagaaggaggatgatgacgaagaagttgttctccaagtgtagaagacgtagcgcctacaagtttattcttccacactagatgcgggccccccgtgtggagatagtagagggggcatcccctcacaaaaagtggtgcgaggggtcgcagatgg

SEQ ID NO: 651710 - DNA, 374 bp, Homo sapiens
  misc_feature (19)..(19): n is a, c, g, or t
  misc_feature (32)..(32): n is a, c, g, or t
  misc_feature (36)..(36): n is a, c, g, or t
  misc_feature (95)..(95): n is a, c, g, or t
  misc_feature (97)..(97): n is a, c, g, or t
  misc_feature (126)..(126): n is a, c, g, or t
  misc_feature (148)..(148): n is a, c, g, or t
  misc_feature (166)..(166): n is a, c, g, or t
  misc_feature (176)..(176): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (215)..(215): n is a, c, g, or t
  misc_feature (218)..(218): n is a, c, g, or t
  misc_feature (231)..(231): n is a, c, g, or t
  misc_feature (241)..(241): n is a, c, g, or t
  misc_feature (265)..(265): n is a, c, g, or t
  misc_feature (282)..(282): n is a, c, g, or t
  misc_feature (295)..(295): n is a, c, g, or t
  misc_feature (302)..(302): n is a, c, g, or t
  misc_feature (325)..(325): n is a, c, g, or t
  misc_feature (337)..(337): n is a, c, g, or t
cagttaggggttttggggngtttggggtcaanaganaataggtaggttccagttactcttcccacaagttcccttaagtcttgccctagctgtgntntgccaccttccagactgactcccctctgnaaatacctgcatttcttacccnggtgagaaaaggacaagnggtgtaggcnccaatgctgctttcccaggagggtgaanatggtnctntnctnaggaaaggggatncagagccctncccagcacctccacctcctatgcncctggatccctaggctntgttccatgagcntgttgcnggttttggtactttagaaatgtnactttttgctcntataattttattttattaaattaaattactgcagtgg

SEQ ID NO: 651711 - DNA, 1538 bp, Homo sapiens
tgtgccattactgtgcctggtggtgtgcctgagcatgtggcatgcagagagtggcctcggagggaatgccactgccacctgatgacatgcccaatgcatgcaatgataaaccctgcttccagccctgaaccctgcctgaacctttcatgcatatagtgattggagaacctacttcatgtgaacaaaagagcagaaaaccacacataaccaaaagagttgttacgacacaacagtggcaacaaagtgccatctatatttcccttgggtcacattgggtcaagtggtgtcctttctacttgggttcactttcccgtctatactttgtgcgatccattttgtgttccatttgatgtgcatagcctattcgggcgtatactactggtccgcagcgtgttctgcttgttcgaatttcaccggggttcccctggcattcggatctctttccaaatttatttccccttgtgacatgggtggacaaccaattaccaaaggcggcccatcactaaataagcacatggccaccaaatcacaagacagcggagggttccagtttggaacatggcctctggtggcctacctccaatggaggtagcttcccctattaggaccacataggtatgggacccctctttagggaaaaggctgccacccaaacggtttaccaattaccagccatggaggaaaaactatgttactcgacactattttgagctgcgattaggagaaacacacaacggccacgtgttgactcatttagtgacaccccattgttggcaaacaaccagcccaaaacttttatccgctttggagtacttatggctttaactcagccacctttaagagtaggacatattgggagctaggggatggacatgcaaaagcaacgcgtttttcccccaatattcagtgatgcgagcgcagcaggtgtccgcccaacactcatttcctcggagaccggtaacacgtgactcggacgagcacacccggcatcagcgacggacgggccaggacctctatactacccagcacaaccattccctacctaacacctactccctcgtcgacgacgccgacaaaaacaactattcgcgcagcaaacaccccattacactccccgacgagcgaccaccttttcgtgtacaacacatcacaatggaaacacattactcgtagcgctctccacctctattcatgcggcgcctcccaaagcaaacactatttattgactcccacaactgcggcccgagcgaagcatttcttccccccattgcggccccaatcgggacagacgccccaacgcccccaacaacaggtcagtgagacaacaaaccaccacggacaccccaaacaccccgccttgggggcacgtaccccacccccacaaacaaaacagcacaaactcccctcaggcacgccatagcaacaccccagcactgcgtgcccctacactcacccataacacacccgcgctctctaacatcacacaacacaccacgaccgaggccgccaagtgccacccacacaacaagcacggcgcg

SEQ ID NO: 651712 - DNA, 394 bp, Homo sapiens
  misc_feature (78)..(78): n is a, c, g, or t
  misc_feature (97)..(97): n is a, c, g, or t
  misc_feature (117)..(117): n is a, c, g, or t
  misc_feature (155)..(155): n is a, c, g, or t
  misc_feature (363)..(363): n is a, c, g, or t
  misc_feature (376)..(376): n is a, c, g, or t
ccaatgctgttgtgaacatccgtggacaaggaactgaacctccctgcttttcattctccttggcataaacctacaacnaggaattgctgggtcttanccggtaattctgtgtttaanttttggacgaactgccagactgtttccacagcagttgnactattttacatccccaccagcgttacacaaggattccaatttctctacatccttgccaacatttgctattttctatttttttttaataatatccatcctaatgggtgtctttttttttttttaaaggaatggtttaaacaggttaccttcttactcctcattgcatggctttagttggactacataaggacccctctccctattggncaccattgaaatngttcagggcaaaaataat

SEQ ID NO: 651713 - DNA, 884 bp, Homo sapiens
ataaagcataaagaaaagcaccgcggtgtttactacggacgaggggaagctctgaggtccggggcttccggaggtcgcggagataggaattggagcagagagaagggaccatggcagccgtgggctttgaggagttcttcagcgccgccaggctcagagttggcgttgccttcccctatttggtggccacatcctggcagagctgagctaggagacggaagtggcagtatagtgtcaggtggtctagggcaggcttcaagggctccgggaggcagaagatgaagaggaaagaggcagcccgggggtcggccggcaggcggcccaggcgggggaattaaatcgccagcacaagtcaccaggcacatagggatcgcgcgactgaccgaggacgatcgacgccagggtgaaacgaaagcggagtccatgaacgcagggcatccattcagggtgacagaagcgcataccctcgagaagggccatgcaggcagggacccgtgaggtgattccttcatgagaaggtgctgggacatcctacgggagaacatgaattaacaccggggtgaccacagacacaatgttttcaacccaataatgttgccaggagacggattagcaggcgcaagacccaaggggccacggggaagttgacacaccaaaacccaccaaagggcaaaacacggcgggcggcggactattaggcggacacatcacaacacaggcaacaaggaagaaaacagttggtcacaagcggccccaaggaagcagcgaacttccattggacaccccccgcgaggaacacccagggccaagcaccaagaacccccccggctgcaagggaggccaacaagatgcgggcgcgcaacaaggcggagagacgatgacaa

SEQ ID NO: 651714 - DNA, 366 bp, Homo sapiens
tacccgtgataacataacttggttccctgaagtgagctgtgcatggaggcttgtccatccctcacaggaccaaacgaatccgtggttatgattatgaaagcaaggaatttaatgcggacgcacatcgtatgcacatcatgagccagaatgctgcagagcacatgcactacttaatgttagaagacgcagatgcttacaagaaacagtgtctctcagatacataaagaacagcgcaactccagacatgacgtagctgatagatacaaaagctcatgctgctatacgagagaatccagtctatgaaacgaagcccaacaaagaagttaaaaagaagaggtgatgccaagctatgttataccgagaacc

SEQ ID NO: 651715 - DNA, 401 bp, Homo sapiens
  misc_feature (53)..(53): n is a, c, g, or t
  misc_feature (66)..(66): n is a, c, g, or t
  misc_feature (320)..(320): n is a, c, g, or t
ccatggtgcacctgactcctgagaagaagtctgccgtactgcccctgtggggnaaggtgaacgtgnataagttggtggtgaggccctgggcaggctgctggtggtctacccttggacccagaggttctttaagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcntgggcaacgtgctgtctgtgtgctgccccatcacttggccaaagaattcaccccatcagagagagctgtaaaggatctctg

SEQ ID NO: 651716 - DNA, 837 bp, Homo sapiens
  misc_feature (104)..(104): n is a, c, g, or t
  misc_feature (147)..(147): n is a, c, g, or t
  misc_feature (321)..(321): n is a, c, g, or t
  misc_feature (541)..(541): n is a, c, g, or t
  misc_feature (644)..(644): n is a, c, g, or t
  misc_feature (661)..(661): n is a, c, g, or t
  misc_feature (737)..(737): n is a, c, g, or t
  misc_feature (797)..(797): n is a, c, g, or t
taaggtttaatgaattttattgttgatatctccctaaccctagacattgtacaggatctgtctcaactgatccccatatgagtctcgtaaacatgatccgtctnccttccgtcacaatttaaaatcgaacaaaaatgacaacgacgngatgattcgttgttattgtaccagatagacacactttgttgactaacttggagtggacttctgttgagaatttaatcgtagacaaaggtaaatctttgtagttgacgtagcaaatgattgaattccgaccgaaaagattttttattaggtatttataaaaagatcacaaacccnccaaaaataatacaatctataaagtgatcgtatgataattgtaatctgtacgtataaaccgatatccttctaagaattcgtatgtaaaattttttattacgtcgactccgtcgattggattttgattaggattttttaaactgtttttcgttcctgatgtaaacagctttttgaaatttgaaaacatgacgtattattctggtggttctcggggtaaccnattaataaaatcgagattgatttggttgtttgtaaatcttggacttaaaaagcaaagaatcgaaaaatccgaaagattttgttccaggatttttttgagtctnagaagaaaaaatctcgnacctaaatacaagtgaacttttcttttattttttctgtctttctattttaataactggctggacaataatagaccntagatacgtcttaggatgttaacccaaatcagattaactttcgaagaaatagttcgtccncaaaagagattagtacgatttgaaaaatttagaaaaatct

SEQ ID NO: 651717 - DNA, 464 bp, Homo sapiens
  misc_feature (72)..(72): n is a, c, g, or t
  misc_feature (401)..(401): n is a, c, g, or t
ttactgtgtgtttctctacctacctctcattctcaccttcttttcctaagctttttttttctctttaatttntccccctaggaatcctccctcaatttcaaagccctccttcccttctcctggctcttcccctctaattcccttctccttccaactttggtttctggctccttttcctcaactttcctttcacctccttaattccttctttctggcccaatatttggtctccaaattttcatatagttctgcctctttcttccccccgtctctgctggccccctaagcttcccctgttaaatcccctcttccctgctatatccacctgtcccctctctggcatccccagatcccagttctccccaagctgtggttctccctgtgctctccttgtcactggntgcccctcttgctctcccagcaaccatgctgctctgtctgccctggctccaaatccctccttc

SEQ ID NO: 651718 - DNA, 155 bp, Homo sapiens
gactcttacatcaggtgattggctcttttgtactctgtcccttatttctcaaaccggccaatgcttagggaaaatagaaaagaacctacgtgattatcgggggcaggttccccgataattagttttagaaattttaatttgcctgtctagaatgc

SEQ ID NO: 651719 - DNA, 1552 bp, Homo sapiens
actgatctaggattgcccaggaactgttgtcaactcacagagtaaaagtctccgctcagcctggagggcgccctcctggtcccctcctgtctgacatcccctcagcctagagggtgccctcctgatcccctcatgtctgacatcccctcagcctggagggcgccctcctgatcccctcctgtctgacatcccctcagcctggagggcgccctcctggtccccgtcctgtctgacatcccctcagcctggagggcgccctcctggtcccctcctgtctgacatcaccctcagactggagggcgccactccctgatcccctcatgtctgacatacccctcagactagagggttgcctcctgatcccctcatgtctgacatccacctcagcctggagggcgcctacttggagccccatacaagatcatgacaagtcacacatacagacaaagcagaggacgccacatcaaggagatccaaatacacagacaaagacaatacccacatcagcaactgaagggcgccacaacatgaaaacacaacctgaatgacaaaccacacagaagtaaccacaagacgcacccaaagagcagaagccaccacagaccgcgccaccagacaaaagccacagtccgcacaacgacgagacacgcaccagcactaaccccagacggccaggagccacaggcaacagccaggaagacaaacaacacgcgaggcaacaggcacaaagctccacacgcacaaccacaagagacacaaggaaagcacagacgacactgcacacgaagacaagagaagcagcacaccgggaaccgcgacgcaagcacgcaccagacgaagacaacaccagcacacagagccacgaaaaaaaggagcgaaccaacgcacaaccagaacacacactctgggaccctcagacacagaccacacacaacagacaaacacaccaacaaagccgcgcaaaaaccacaacaaaacacgacaacacagcacaaacaacagaacaaagcacccagaagggggccaggaaggaagcgcaaaaggaggaagggaacaaaagagagagaaaagagccagagcagcgacaaagcggagggcgcgggccgcgggggagaacaacaagaaggacggaggggacggagggcacgaagaggaggagacggagaagaggaaggcagcagaggcgggcaccaacggagacgaacgggggagggagaggcaggaaggaacaggagacaggggaaaggaagaggagggagagaaaggcagaagaagacacgaaaagacgcaggaaacagaaggaacagacgatgcaagaaacaggacagggcgaaaagagaaaggaaggcggcaggcaagccagacagaagaagaagcgagagcgcagacagaacgaaagagagagaggacgcgcgaaagaacaacagaaggcggacgacgagaagaaagaagacaggacacgcagaagcgaaagaaaggagaacgcggcaaaggacagagaccaagaagaaaagacagcaaacccgagacgacgaggagacgcagaagaaca

SEQ ID NO: 651720 - DNA, 473 bp, Homo sapiens
gggtgcctttcccttgcttgcatcgatattcagtgtttggtgacttcttggcaggcagacatctaccaagagatttgtattctttttatacctcctattcaccaagagaaaagggccattcaaaagtgagtttttcttttttttttttaaagtttaaaaagctatgatgtggccacccatggtggctcatgcctataatcctagcactttgggaggccagggcaggcagatcacttcaggccaggagttcaagaccagcctgaccaacatggcaaaacctttttactactaaaaatacaaaaattagctggccgtcgtgatgtgcccctgtaatcccagctacttgagaggctgaagcaggagaatcgcttgaaacctgggagatgcaggttgtggtgagctgagattgcaactctgcactccacccgggctgacagagcgagacttggtctcaaaaaaaagctgtgatgtga

SEQ ID NO: 651721 - DNA, 122 bp, Homo sapiens
  misc_feature (7)..(7): n is a, c, g, or t
  misc_feature (9)..(9): n is a, c, g, or t
  misc_feature (12)..(12): n is a, c, g, or t
  misc_feature (35)..(35): n is a, c, g, or t
  misc_feature (43)..(43): n is a, c, g, or t
  misc_feature (54)..(54): n is a, c, g, or t
  misc_feature (64)..(64): n is a, c, g, or t
  misc_feature (86)..(86): n is a, c, g, or t
  misc_feature (93)..(93): n is a, c, g, or t
  misc_feature (96)..(96): n is a, c, g, or t
  misc_feature (111)..(111): n is a, c, g, or t
ctttgtnancanaagtcctccaataaaaggaacgngaaacagntcctaggaatnggctaagganaggctaagcgaaccaaatgtcnctgaaantcngtcagatgaatctantagtgatgaag

SEQ ID NO: 651722 - DNA, 556 bp, Homo sapiens
aacgagaaaggaggagggcgctccaggcgactagctattgcagactgccattatcctctgttgctctgtctgcagccgacctcggacgtcttgcctgtgatcccacttggttcgcggcactataggcgtactgtctagcactggggctgtcatgttgttggttccgagccagaacgcttcagtactgctctgcaaggatatataataactgacttggtgtgcccgttataactaacacagaatatggtacaactgaacagtccagaagaaaccttccctaatcactggaagaccaattggtgaatttggtaaactcgccctgcagaagatatggaagaggaacaacgcatttgagaagatctaggaaaccactgatgagatgggtcgacattagcggcattgctgcttcatgacgcactgaatgctggggcagtgattggaaaaggaggcaagaatattgaaggctctccgtacgagacgtacgaatgccagtgtttcagtcccgagacatgcagtggccccgagcggcctattgagtatcagtgctgatattgaa

SEQ ID NO: 651723 - DNA, 1234 bp, Homo sapiens
  misc_feature (373)..(373): n is a, c, g, or t
  misc_feature (531)..(531): n is a, c, g, or t
  misc_feature (549)..(550): n is a, c, g, or t
  misc_feature (552)..(554): n is a, c, g, or t
  misc_feature (557)..(557): n is a, c, g, or t
  misc_feature (559)..(559): n is a, c, g, or t
  misc_feature (581)..(581): n is a, c, g, or t
  misc_feature (590)..(590): n is a, c, g, or t
  misc_feature (1099)..(1099): n is a, c, g, or t
  misc_feature (1115)..(1115): n is a, c, g, or t
  misc_feature (1131)..(1131): n is a, c, g, or t
  misc_feature (1206)..(1206): n is a, c, g, or t
tgaggtcaggagttcaagaccagcctgtgcaacatagtgaaatcccgtttctactaaaaaatagaagaactggctgggtatggtggtgcacgccggtagtcccagctacttgggaggctgaggcaggagaatcacttggacccgggaggcggagtttgcagtgagccgagattgagccactacactccagcgtggcgacagagcgagactccgtctcaaaaaagaaaaaaataaaagccatgtgttgtggcatgcagctgtagtctcagttcctagggtggctgaggcgggaggattgtttaagcctgggaggttgaagttgctgtgagctgtgattgcaccagtgtactccagcctgggcaataaagcagancttgtttcaaaaagaaagaaagaaatgagcatggtgggaatggggacagatggcagtgttaagtagagtggtcagggttggcctcataagtgaatattgagcaaaagtttgaagcaggtgatggagctggccaaggtgctgagggaagagcattgtangctgagtcaacaggatanngnnnatnanggaggaaactctctggtgtctnaggctctgnaaggaggccagtggagcaaagagatagagggagcaaagtcaatgaggaggccagggagttgctgggctgggatcggtacagattgtgtaagccctgggacgctattgctggggctttggcttttactctgactaaaatgggaaccaccgagggcttctgagcagagaggtgacatgatctgtctcctgatttaaaagcacgacctggctgccaagttgagaaagactatgggaagatttgggtagaagcatgggggccaagctgtggcaatatcctggtgggagatgatagtgatcctgaccggattcatggtggtggtgagagatggttagagcctggatacatgttgaagtcagtcagtaggatttcctgacagactggatgtgagctgtgagagaaggcagtggtcaaggttgagtttgattctgattgaattattaagtaattttaaaaaacactactgcctttcccaatcctaccaagtaaaggatgctagataaaagaaatcncaagtcaggccaggtncagtggctcacacctntggttccaacagtttgagaggcagagatgggagtatgttttaaggccatgagtttgagagcagcctgggcaacanagcaagacctcctctctacaaaaaaaaa

SEQ ID NO: 651724 - DNA, 806 bp, Homo sapiens
atcactcccttaaagttctaggtaaagagggcctgtgtgactgttcatgtagcctagtaagggatgtaggcacctccattctgcaaatctctaacccatcataattgtatgggatcggtcatggattgtacatgtgatcacataggcatcatatatgtccttggctagatgatagtagtgcgcatttttgtactgtgagagtttgcaatctacacacaatgataaatacaacagattgattacccgattcaagttataagctttatgataagcgactcccaggctcgcgttgcgccaccattcgtgctacccgtagtgtgcaatgcatccatcgtggtcactacaatatagctatcaacatccccttgtcctatgatataacaacaatttatactatagctccgcgagtcgatgaagtgtggaacattagcatgggtactacccagtctatcttcatgtccggcatcgtaggttgagccaacgtataaaggtaagggctatccatccattttgctgcaaatgacatgatttcattttgttttaatggctgagtaatcattcgttgtatatataccacattttctttattcagtcatctgctgatggacacttaggttgattccatatctttactattgtgaatagtgctgtaataaacacatagtgcaaagatttcggaaattttaacaaagaaacccaaaacaacaaacacaacaacaacgagcggcagacggcaaacaccaacagccaccataacgccaccgaaaaacaacgaacaaaaacacgcacgacaccaacacccaccc

SEQ ID NO: 651725 - DNA, 1147 bp, Homo sapiens
  misc_feature (373)..(373): n is a, c, g, or t
  misc_feature (531)..(531): n is a, c, g, or t
  misc_feature (549)..(550): n is a, c, g, or t
  misc_feature (552)..(554): n is a, c, g, or t
  misc_feature (557)..(557): n is a, c, g, or t
  misc_feature (559)..(559): n is a, c, g, or t
  misc_feature (581)..(581): n is a, c, g, or t
  misc_feature (590)..(590): n is a, c, g, or t
  misc_feature (1100)..(1102): n is a, c, g, or t
  misc_feature (1141)..(1141): n is a, c, g, or t
tgaggtcaggagttcaagaccagcctgtgcaacatagtgaaatcccgtttctactaaaaaatagaagaactggctgggtatggtggtgcacgccggtagtcccagctacttgggaggctgaggcaggagaatcacttggacccgggaggcggagtttgcagtgagccgagattgagccactacactccagcgtggcgacagagcgagactccgtctcaaaaaagaaaaaaataaaagccatgtgttgtggcatgcagctgtagtctcagttcctagggtggctgaggcgggaggattgtttaagcctgggaggttgaagttgctgtgagctgtgattgcaccagtgtactccagcctgggcaataaagcagancttgtttcaaaaagaaagaaagaaatgagcatggtgggaatggggacagatggcagtgttaagtagagtggtcagggttggcctcataagtgaatattgagcaaaagtttgaagcaggtgatggagctggccaaggtgctgagggaagagcattgtangctgagtcaacaggatanngnnnatnanggaggaaactctctggtgtctnaggctctgnaaggaggccagtggagcaaagagatagagggagcaaagtcaatgaggaggccagggagttgctgggctgggatcggtacagattgtgtaagccctgggacgctattgctggggctttggcttttactctgactaaaatgggaaccaccgagggcttctgagcagagaggtgacatgatctgtctcctgatttaaaagcacgacctggctgccaagttgagaaagactatgggaagatttgggtagaagcatgggggccaagctgtggcaatatcctggtgggagatgatagtgatcctgaccggattcatggtggtggtgagagatggttagagcctggatacatgttgaagtcagtcagtaggatttcctgacagactggatgtgagctgtgagagaaggcagtggtcaaggttgagtttgattctgattgaattattaagtaattttaaaaaacactactgcctttcccaatcctaccaagtaaaggatgctagggaagaaaccacannnaacctaatgggcaaaataaccacctaatatcataatgancgggaa

SEQ ID NO: 651726 - DNA, 106 bp, Homo sapiens
agcgaaccatttgccaaagagtgtgttccacctctgcccctgggagacagagggccaagcctggattatcatgaacagggcaatgccccatgacaccgaggaagcc

SEQ ID NO: 651727 - DNA, 425 bp, Homo sapiens
aaggggtggggtcagtgtgctgggactctgcttcaggctcccggacagtgactggcagtgtctgcagcgctccgtgcaatggagaacgtggcggtgagacaccgagactgtgtacgcccatgcggacaattgaacaacacctgcggaatggggttcctgcggctgtgagctcctgtggtatcagctccctgagtgtggggtcttgcggcagcagctgcacggaaatgttatgcaccccaaatcaagtcccaggaccccagggcatctttccagtgctctgacttcatgggcccatccagttccaggtcgcctgcagctagtgctcagctacttctcctggactttgaaagaaccctcacagtcctggcctcatatttctctgtgtgatcccccacatctgggctctatcaccccgtccagtgtag

SEQ ID NO: 651728 - DNA, 119 bp, Homo sapiens
gtaaaattgcatcagaccacatccatcagcttctggatcttctgtgctattacatggattctttaagctgttcgcttgagtgcctgggcggtccttcctgcatcttgttccatggataa

SEQ ID NO: 651729 - DNA, 229 bp, Homo sapiens
catctacgacggctcttcttgtgctgctgttggtcacctcatcgtggtcactgccagctaccgagtgggtgtcttcggcttcctgaattctgcgtccggagaggtgagtggctaacgtcggcgggctgctggaccagtgtggcggctctcgacctagggtgctcacccacgatccgaggtatttgcgcggggacccttcgtgcgctgtgtcctctggccagtcagcacc

SEQ ID NO: 651730 - DNA, 109 bp, Homo sapiens
cgatgggtcagatggaccgctgaaacaggtgtagctccaccaacaggctaactttgggagacatggatctgactgcccggacaagtataagcttataccagtctagaaa

SEQ ID NO: 651731 - DNA, 129 bp, Homo sapiens
gattaaatcaggcctgtgtggtgatggtgagaaggcaggttgtgcggcgtttgaccgatgtatcttttccttaaagttattataatacatgggtactttgtcaatacaagcattcctgttggcgggtcc

SEQ ID NO: 651732 - DNA, 111 bp, Homo sapiens
gacacgacgccagggggtttgggtgctggagaatctggtacaagcaccattgtgaagcatatgaggatcctgcgtgtcactgggtttaatggagagggcggtgaagaggag

SEQ ID NO: 651733 - DNA, 531 bp, Homo sapiens
cccatctggcgaggcagtctcagctgagcctagcccagcaagccagattttcctgaataaacaactgtggggagagaaggaaaaagtcaggattgtggtaccggaacccaacaaaggtgtgaagatgtatatggcatggcatgtttctgggaacccactgaagtggccagtgtgtaagtgacttgactttgaagctgggagggcatgctggcaccacataaaactaatgctaaagagtttggactttatgtcataaccagtagagaatcaccaaaggtttctgaaccagactaggacataattaagtaaatggtttagaaatataagtatggcagcaatatggcaaaaggactgggaaatgaggaagcctgaaggcaaggtgagcagttaagaagctcttttgttatactggggttaacaatatcctcggcacactgatttccttatcatctatgacaagatgatagcatctattaacaaatcaccccaatatggaatactcccattgggacagaatcccactgtaaaaat

SEQ ID NO: 651734 - DNA, 353 bp, Homo sapiens
acagtttgatgttgctgtgtagagagtgagtgacttgacagtgtggctgagtgggtttgtggctttattcttgccttgtgctgtggtgccttctgatggggctgaaatagtagaggtggatggttctaccctattcaggcttctgtatagggacccaggtggtgtgctatggttagcttacttcaggctctagggctgtgctatccaatacagtacgcagatgcggcggtttaacgttaagccaattcaaatcacataagattaatagatctttcctcagttgcactcaacacgttgctagaggcgtcatggtgtgtggttcctggctactgtactaaggatcgagaacatag

SEQ ID NO: 651735 - DNA, 81 bp, Homo sapiens
tgatgaaatatataaaactatagcttatagaaagcttaaaatcgtcctctgacatccatttcgaacgactctcgcctcatc

SEQ ID NO: 651736 - DNA, 133 bp, Homo sapiens
gtgcggctggtcttgaggatccgaaacctaataacgcaactcagctctgttcagccacaacttcagctccagttctagcctcagccccagccccagttctagcatcatcctcggctccagtttcagccccagc

SEQ ID NO: 651737 - DNA, 370 bp, Homo sapiens
  misc_feature (268)..(268): n is a, c, g, or t
  misc_feature (283)..(283): n is a, c, g, or t
  misc_feature (349)..(349): n is a, c, g, or t
agaaggacataacgcaggacaattctgaattaaaacacagatcctcaaagaaagatttgttagagatagacaggttcacaatttgtggaaaccgaattgactgaatctgtggcttcatgcgctgaagaagctgggtcctgggggcaacaagtgctgtgttgccagggacaaataggatgctaaacatgggcactttaaatatttattttaaaaactttaaattatttattgggcaagcaaatctttagttattctttcttcccagtanatgggcctgggcttnaggggtcagacccacagggacagggagcgaccttccggcctttgactgtcttggggggagctttgntggggttatttaaactttccc

SEQ ID NO: 651738 - DNA, 296 bp, Homo sapiens
tcgctattcattcggcacctcgctattcatcggcaccgtcgctattcatcggcacctcgcctattcatcgtgcacctcgcctattcttcgaaacctcgcctattcatcgacaccttgctattcatcggcacctcgctattcatcggcacctcgctattcatcggcacctcgctattcatcgacacctcgctattcatcggcacctcgctattcatcgacacctcgctattcatcgacaccttgctattcatcggcacctcgctattcatcggcacctacgctatacatcggaaagt

SEQ ID NO: 651739 - DNA, 337 bp, Homo sapiens
  misc_feature (297)..(298): n is a, c, g, or t
ctaggggcgtgcccccccaaggccaaccgagaggcccctcagccacttcgtgcctccagcaagcacgacgaatctccggtctatcttccgtcatgatgcgcagttctgggtctgacctgccacgcgcctcgcgcgtgcacgtcgggcgcccatggggcgtaccccgtgtggattgtcggagtcattcttctaggaggcggtgctcccctggcggcacgccactgctccccgagtaccctcgcgcgcgtcgcgcgctctccacgcctactcctactgccactgctgatggagtccganngggccatgagatggataggcctggacgacccctgggaca

SEQ ID NO: 651740 - DNA, 170 bp, Homo sapiens
cccactcatcctttccccagccctttttagccctccccagtcctccccagcctttttcagcctttttcaggtcagcccttttttattttttatggggccattttggcctccccatccccccacgtgccgatgtcaggttcatttaaatacctcaaatttgtaattgttta

SEQ ID NO: 651741 - DNA, 380 bp, Homo sapiens
gaacaccgagtcacggagatgcaggtacagacaggatctgtcctccacacagatgtgacgttgactggtgccccagctggcaagtgcaaagtggaggagaaagagaaaaaagagaagtcagcccttacactgagccttgaggtggagtggttacacatgggcactggccggtcagattgacactaaccataagaaccaggctgtccgtgcgggcacataccagcccgtgcccggagcagggagccttggcagtcacatcatttccagttttcttttctgattgctctgtgcatgcgtgttatcttcccctaccacccccaacacatccttgagcttttagagaaccttgtcataggagatgatattttaaacatttatct

SEQ ID NO: 651742 - DNA, 364 bp, Homo sapiens
tgggggccccaattatatgcacaatatatgttgtccaaagtagcccctgcaatcactagaatctttaatgtattataacatatgatgattagcagtaacactttattatggttctggttagcaagagctataacaccgaaaaaaggtaagtttacagtgatcacataatatcagagggtaaggagaggttaaaagagacgtcaaggacgtgagtgtctgtgattcagcgtggaggtgcaccataaacggccgaaaaatcggtggttcctccatcaatagtccagtcatgtctgtggcagcattagaagtcaggataaaaacccctgtatctccagaaatgcatttcttccacgacaaacttgtc

SEQ ID NO: 651743 - DNA, 220 bp, Homo sapiens
agataaaactttaaaaggtgtcaaggcacacatgactagatgcccagtcaagttgccttctatttcccaactggaagccaatgttaaacataatacaagtgccggctaagcagttgctggatcaattagagaatatcccatttaattctcacatacttggctcataaagtcaagaaaatttggtcagcattcagtgaacatgtacagatgcaggacactg

SEQ ID NO: 651744 - DNA, 299 bp, Homo sapiens
  misc_feature (251)..(252): n is a, c, g, or t
  misc_feature (299)..(299): n is a, c, g, or t
ttgcttgtgggggatttcacagtaaggataaaatacagggcgtggcacgcctgtaatcctagcactttgggaagccaaggtgggaggatcacttgagcccaggattttgagaccagtctgagcaacgtaacaagaccctgcctctactaaaaataaaaaaaaattagctgggcatggtggttcacggccgtagtcccagctattcaggaggctaaggtgggaggactgcttgagcgtgggtggtggatggnngtgattcatcactgcactccagcctggacaacagagcaagatcctan

SEQ ID NO: 651745 - DNA, 496 bp, Homo sapiens
  misc_feature (13)..(13): n is a, c, g, or t
acagaagaaaagnagttacaggaccacttgacccactgcttgagaagatggagagcgacagggtccagttgctggaagagcaagagaggaccctggctcttaaacttcaggtgtctaattgcatcaccttgaggtttctgtttttctgttttctctccattctccccgatcacaggcttactgtggcagagagaacatgaagcccaggggaagaaccctgcttgcttacttgtacttttcaattcctgtctgtccagcctgaactggctactgccaagtctggtcactaaactgcaaatattgcagttgtgtcacattcagtgctttatctatatatccttcatttcaaggcaggtattatctgctagccatcattaaagtatctgtatctcttgcttaataccatgtgaagcaagaactatattcttattacttaggagaagaaacaaagtttccaaaaataataaataaatagagtcacccagctaaaaaaaaa

SEQ ID NO: 651746 - DNA, 299 bp, Homo sapiens
ctagcaggatcccctggcagcagacacagcactattggatatttggaactgtgtgcattcttttcattgtggatacattcagtatcatccgtggcttgcattctgttatgtaccattatgcatcactcccagactgtcctctcagttgtgagagtcataaatgtttccggatcggttcacatgttctctatgatactcttgtactccacactttgattaactctgcttttaacgatactcgtcgtgcaatgacgatgtcatatactggttcttgagcttgcagctctcttttgctccaa

SEQ ID NO: 651747 - DNA, 226 bp, Homo sapiens
aatcatgaatggctggatacacagacgtggcacctacatccgcggacggatggataaacagacgtggcagctacatccacgaacggatgaataaacagacgtgggcactacatccacgaacggatggctcaaccgacgtggaacctacatccacggacggcatggataacatcgacatggcagctacatccacagatgtgacaggcggataaccagaacgtggcca

SEQ ID NO: 651748 - DNA, 417 bp, Homo sapiens
  misc_feature (37)..(37): n is a, c, g, or t
  misc_feature (96)..(96): n is a, c, g, or t
  misc_feature (106)..(106): n is a, c, g, or t
  misc_feature (118)..(118): n is a, c, g, or t
  misc_feature (176)..(176): n is a, c, g, or t
  misc_feature (198)..(198): n is a, c, g, or t
  misc_feature (205)..(205): n is a, c, g, or t
  misc_feature (208)..(210): n is a, c, g, or t
  misc_feature (216)..(216): n is a, c, g, or t
  misc_feature (417)..(417): n is a, c, g, or t
gtagaaaaaaaaaatcctggattttacgtgtcattcngttttcatctgacagcagggctgtcccgacatcaggcacagcagcggcacttctctgangcccctttgnagaggcagcccngggcacacttggcacagcccagggggcaacaggagcagcagctcttcttgcaggaggngcatttgcactttttgcacttncaggagncgnnncaggcncaggatgttaccagcctcgcaggagcagttggggtccattgcaagccgaggtgagattggagttcccaagcgagagcagcaagcagcgccagctggcaacacgtgatcccgcgcgcaattccgcgcaccgcgctaccagccctgccttttttgctacaaacttgcttctatagctgctcacctaaatagcgccctaaatgn

SEQ ID NO: 651749 - DNA, 593 bp, Homo sapiens
  misc_feature (133)..(133): n is a, c, g, or t
tcggggaataccaaggccacagtccggtctgggttttaaatgctcccaggaggtgccccccccataccctggggcccatcatcctggcccagctcttcccatctgtccccccgtgccgccagaggcgtacatngggggagcaccaagattctggccagaccccccaccactgtccccttgccacaggtgaccaggccccttcggctcctggtgctggttaccgccctcaatccctgcacccccaggggcccctggcacatctgtcttctctcgcacccctgtgcccttatgaaagctgctcactgatggctggtatcgatgactgctacaccctcacgcccgcgggctgcacctgcccaccctcgggcacaacttcgcccaggccccctcttgatgcccttttctaagacctatcacgctacctgacccccgaccttctggaaggagactgtattcccccagtctccctatcaggagttcactgaccccctcgtccagacccccccccgagtctccgtgcaacggactcaggctcccgctgtggctaccacatagggtttttataccagaaaaataaagtgaattaagcgtga

SEQ ID NO: 651750 - DNA, 267 bp, Homo sapiens
  misc_feature (41)..(41): n is a, c, g, or t
  misc_feature (48)..(48): n is a, c, g, or t
  misc_feature (117)..(117): n is a, c, g, or t
  misc_feature (261)..(261): n is a, c, g, or t
aaatattatttgtagaaaatgttaaaatgcctaatgagagntgaaatnagaccccaaacaaatgggaagatacacccacgttctttcatagaaatacgcagcatcataaagatatcncttctctcattaatgggtgcagcacaccaacatggcacacgtatacatatgtaacaaacccctgtcgttgtgcacatgtaccctaaaacttaaagtataataataataaaattaaaaaaaaaagaagtagaattactggataanttggta

SEQ ID NO: 651751 - DNA, 1716 bp, Homo sapiens
ttgtgcatgctgctgtgtgcctggtgcctggtgactgtgggacttgtctgtgctgcagtgctgtgccatgcccaccaacttcacctgtgtgtgccctgtgtgatgtgctcactgcctgactgtgtgtgctgtgttgactgatgacttgcctgatgctgtgactgtgattgtgctcctgtgtgcaccccctgtatgtgtgcccctgatgccctgatgctgccccatgccctggtgagattggaaatctcaatgatgacaagacagcccaattctctctaacgaattgtctgaagtgttgtgagacaatgaggatgcttcattttgacaggtggaacgacacattgtgccagcttttctgagggcagtgagattgtgaccatgtagacccacaagttgcgttgatccatctggctttgaatcagaccaatgcttgggccagagataagcagacacagacctttgtattgcacatgtgggctagttgtgttggatggcacatgatgaggatgcgaactgacgtgagtgatgcccagggtctgtgctcgtgggaatggtggccctaaaagaggggtacacgtgtgagagccaatatgtgggtcaagacagtatcaagtaccagaggaaggatctttatcacttttgcacaggtgtggaggcattagcaatgaagatataatttcacatttggttgactggattagaataacaaattcattatacccattagacagagcgacagtttgtaaacagtttagtgagaagttccatgggattgtgatgatagatgattaagaagacgatatagggaagattaggtaagcattggggaaaagaataagaagatatcacgatatacaaattcaaagaataaggagcaaccgagtatgggatgtgaacatatggaaaagaaaagatatggtaagacaataagataagaggatagaaaagagagagacagaaatgatattaccacctaagatagaagtagattatggcaatgacattcactcgaaaaataaaaaacataacgaatagataggaaatggattagggagatcaaccacaaaatagagagatagagggagagtagaagattcagaagttagaaggtatcagaaaaagattaggacattatatttagagtaatcgacgataacaagacaaatagtagagggaaagacaaccagagaaagtagataaataggaagaagagggaaacagcataggaaaaagggaagaaaaaagatagaaaagtttagagtagacaattaggtgtgagacacatagaaaatgagtataatagataagtaagatataaagcaaaattaaaaggctaaaatactctatatggaggagtagagacaatacagatctagagaagtaagttagtaaatgagattaagaagaaaagagaagaataagaaagaaatgaaagagggaaggatatgtggcgagatgaagaaccaattcgagtgagaacgattggagatatgtttgagagaatgaaaagaggatagaagagagatgagagagagagatataagaatgatgagattatttatagaaatgagaagaatgatgagacaaacaaatgaaatgatgacagaagatgcgcgagatatagaaagaagatgaagagaagaatgaaagagagaaaggaagaagaattatagagagaatgcggattgagcagaagaatcagataggagataggaa

SEQ ID NO: 651752 - DNA, 174 bp, Homo sapiens
taggggagtatgacggggaaaagctccccccagatatgtcacacgctcccgaggcgtctcagaccatctcatctgcgactcgcgcataccccggctctaggccttcgctcccaccagggatcgggcggcgcatccccccccattctcatccattgagtgtgctgcgcttctacg

SEQ ID NO: 651753 - DNA, 967 bp, Homo sapiens
  misc_feature (509)..(509): n is a, c, g, or t
  misc_feature (625)..(625): n is a, c, g, or t
atctgtaattaaatagtgcttgtccccggagcgtcttccctgaaacgtgttgagatacctgaaatcttgtagcccctaggacgcacatcttgcacagatccaggaggtccatgacagtcgatgtagtaggtgacgtggaatcgtggcaaaggaattcctacgactacggttcgtctcgtacctcaatacgttgtgcgtggacatttcgatcgttactcatctattgaagtcggacgttgatatcgttttcattgtacctaggtgtgactggacttctatagtcttcatcgtagttgccaatgtgccatcctggaacttagcttcatgatgtcgttgcttctctcgaagtgcgtgctttcttgacacgtcacccgggtttttgccgtacatcacgcgagttggttccgagtaccttcggaggtttcgtcttttcattgcccagttcatctttcgtacttctggtacgtggctcgaggcggtagcatcggtctggttcgctagtcgtaagngaagtccagtgatgtagttcgcgagaagtacaacaatctacgaatacgtcaacgtcgatagggttgcctctccttcttctgctaaattctaacttatgtacaatactcttgtgggngtgtctaagtcctctagcgcgtgtaatgtgtaaggtgcttgtatccctctatcccaatttatacatggttcagaaagtttgtgcctaagatctaagggctttccatttatatcgtgcagagcacgttgaattttctataaaccttcagtatgaaagttgtcgttgtcggtaccaggttgtgccctgattgggtccgaatggtccaagatcgaatatccccagatggaaacccgcggtcaaaattttttaccccttttgtggttcttattcaacctttttctttccttttttttcacccgggttccacagccctttgttaacagtccccgtccggcttgggac

SEQ ID NO: 651754 - DNA, 123 bp, Homo sapiens
gtccaaacagtgctcagagtcaaaacagtgcccagagtccaaacagtgctcatagtccaaacagtgctcagagtccaaacagtgcgcagagtttcaaacagtgcccagagtccaaacagtgct

SEQ ID NO: 651755 - DNA, 105 bp, Homo sapiens
gtactatgggtatcagtctgtgctgctgagcatctttgctggatgacacagaggccctgaagcctctcattgtcccaaactggatcatcttcctcaaccatctct

SEQ ID NO: 651756 - DNA, 253 bp, Homo sapiens
tcctcctcctgcgcgaattttccaagtaataaatacaatacataaaataaaactgctctcaaatgtaaatggagaaactcaagggtctgtgagtagctaggttacccttaaaagagctaagaggctaggtgcagtggctcctgcctgtaatcccagcatttcgtgaggccgcggtgggaggatcgcttgaagccaagagttcgataccagcgctggaaacagccagaccccatctctacaaaaaacgaaaaaa

SEQ ID NO: 651757 - DNA, 417 bp, Homo sapiens
ttggtcgtgtggttctcgtgcgggtatgtggtctgtgctggagaggatgtggagaaattacattgttggtgaaagtgtaaattagttcaaccattgtgaaagacagtgtggcaattcctccaggatctagaaccagaaggaccatttgacccagcaatcccattactggggacacactcaaaaggattataaatcattctactataaagacacatgcacacgtgtgtttattgcagcagtattcacaacagcaaagtcttggatccaacccaaactcccacaatgatagactgaataaagaaaatgttgcacatatacacatagaatactatgcagccataaaaaaggatgagttcatgtcctttgcagggacatggatgaagctggaaaccatcattcccagcaaagaaccacacg

SEQ ID NO: 651758 - DNA, 178 bp, Homo sapiens
ggccgcggttattcagcgacgtgtgtgcagggcagctcaggaagggacaggagactgggccaatatgtgaaggatggggcctgcgtgttcaaagccaatgaccgccccttccttgtgctcaaatggccaaagctgttcacgtctgtgctcaaccatcgtgcttcaaattgaagtaaaa

SEQ ID NO: 651759 - DNA, 497 bp, Homo sapiens
  misc_feature (384)..(384): n is a, c, g, or t
atattgaaagctttggagaatgccaaaaagtaaaggaaagaaggtggaaagtttggttttgcagagtctatagcaaatcaaaggatccaggcatttaaaatggaaaaggcccctattgatacctcggatgtagaagaaaaagcagaagaaatcattgctgaagcagaacctccttcagaagttgtttttacacctgtgctatggactcctggaactgcccaaattggaaagggagtagaaaactcctggggtgttcttgaagactttgaaaaggaaaatgatgaaggcggtggtgatcaagctatcatttttgatggtataaaaatggcccctggagtagaagtctttgatattggaagccaaaatgctcccataattctttcngataagtgaagaagaagaaatgatctttttggaaccagccaagaatccaaagaaaataagaacccagccccccagtgcaaaacaaaaaaaagccccaagtaaaaagccagtga

SEQ ID NO: 651760 - DNA, 752 bp, Homo sapiens
  misc_feature (452)..(452): n is a, c, g, or t
ccaaatctcatggtttctggggccaaaattccctttcctgcctcccaatagctataaaaaatggtaaagccaaaaaaaaaaaaaaaaaaaaaaaaaaaaaaaaaaaaaaaaaaaaaagggggggggggctaaaatttcccctgggggggcccggtttacgggccccaagttttttgtaacaagggtgcccctgagagggcagctgtgttatataaacgcagaggcggaggcgcgaggtaaaacaaacggtcggtgctgggggaaacatgggctacgctggggccatcttgggggagggacccttactttcgtgtgggtggtggcctatattcgggcacaacattcacctacagaaagatattaaacggctccaagggtcaaatcataacatttcacacggtggtatcaagtggtggataaccaccagccgcgtgcttatgtgtcgtgggcgngggcttggaagaaagtttgtgggctacaggggcgagtattgtgcattttgtcgggggaccaactttttttattcactcgggggagcctttggtgtgaaaataaccggggaaaataaatatagtaaaagcattcacgagccatcagtgagcaaatatatgatcgaatagaagaggataataagcagagaatgaaacatattacataatatattatagacatagggatgcagaaatagtagatgagaccagggaaaatatagtattaataacaaaaatacagcaacgagattaaaacacgaa

SEQ ID NO: 651761 - DNA, 1777 bp, Homo sapiens
gagatgaagatgcttacaagaaacagttctctacaatacatacaagcaacagcgtaactccagcacatgcatggcaggcagcatgtcatcaagcaacagctacatagctgcatcatacgcagcagacatccgagtctcatgcacacaagcacagcccgaagacacagcacagttacaaacagcaagcaggtgagaaccagtccgctaaacatagtcacctatgcctcaagcacagacaggcatcgcggtcagctaccaacacagcacagcgcacagcttcctacagcagcatcaaggacgcgggcttgcatgcagcagctacaacccaagacaatatttcatcatgatatatattcagaactactcagactacactaacacacttatagacacaagaccaacaacaaaaagaacaacagaacaagacaacaacacacaacacacacagacgagagaacacacacaaacgtcccgcgcgagagagcgagaggaccaacacgaggagacgcaagacgagacacacggagccacaaccaaagagagaaccacacatcgaccaagaacaacacacagcgaaaacgaccaaacaacaatacaaaaaagaagaaaaccaaccaaaagccgaggcacaacaaaacaaaagaaagccaacaggagaaacaacacaccacacgaatatcaacagcagacgacaccacagacaacagacataccatcaaccagcacgacaaacaaccacacaacgaatcatcaccgagaagcgggacaatgacaacaagaaagagaaaacacacgtgatgagacaaagagccacgaagaacagaagaaaaagcaagatagacagaaaacagaaccaagacatggcgcaaacaagaacaaccaaacacagaaaaagagaacaaacaacagaaaaagacacaagccagaagcgaagacgaagaagcagaacaaagacacaaacaaacgcagaacaaccaaacacacacaacgaacgcgtgataaaagaacacaaaaacagaagacagcgcaggagccctacccccgccacggcgaaacggagaagcgcgcgagcacagacaaagaagctcaccggacagaaagacaacagaggacacggagacacgcgaaggctgcgagaaaaccgacacagacacgagcagacgctgatgcggacaagacacagatgaaacagaaaagaggagacagagcaggaggaaaggatcacggaccagcagcagcacaacagcacgaaccatcacacagacgacaaggagaggagaggacacgacacaattagagaagaacacagaggcagcaggccacagagagagcaatagacacagaaaagggagcagacacaacacaaacaaccgacgagaaaagaggagacagcgcagcaagagacaaagccaaagcagaacagacaaaagagccaggcaaacaagacacaaagacagaccagcaagacagaacaagagacaaaggcagcagagcggagagaagcacggcacgccacacacacgcgaccacgtgaaggaggcgagaggaagaagcacacgagggagaacgcgacgagacacacaggcagtgcagcgaggaacacgcagagaagcagcgagagatgcataagagaaaagagagagcacataacacgacacgagagcgcagcgaacgaaagcggccgaaagggacaatcggaagagcagacgaaaggcgaagcgcaggcgaccagagagaaggggacaacgcggacagcaccgcaggccgagcgagagtg

SEQ ID NO: 651762 - DNA, 783 bp, Homo sapiens
acccctctgttgtatgttactataacgagtgggggttgtttatgaacagcaccgtcccttcattgggggttgcttatcactggacggcggtcattgatatgtcttctgcgggggaaacccgtcttgtggggcccgtttgtgtagcaaggccccgcgctgtgtctaatatatgtttgtttaatgctccgcgttagatagtgttgacggcttgggcgttgccagcccttcgtctgatctcgtacaacatttcccaggtattaccactggtagatgacccgccggcttaatccattttacattgcgagctaatggtacttactaatgtaaaagtcgacacccttttctttatcaagatttgccctgactctaatagtaagtgccttctcgccctctgttaaactaacagttatcactggcacttgttgtacgaccctttgtctttgccaactcttccactatttgcgacaaatggttgtcatctcatccataccttccctacctccacgcatttcctatttgtataataggaatttattatgtccagggagagaaattttactctaaaacgcttttgctctttttttgtgcgacaaaataatccgtttcacctacatgattagtaatctcctagagacatcactgctttattgctctgtaaattattagcatgatcaatatcctcctaaagttcaaagcacgaccgagagctacaggaaaagagaaaagaaaaataatagagataaagtaaaaaacaaatatatcacgaagaatttgctaagcaga

SEQ ID NO: 651763 - DNA, 110 bp, Homo sapiens
cagaggtagttgggatgaaacgtgggtgtcagcctccgaaggacacgggaccaggtgtggctagaactcctatgattctgcatccaacctccagtctctagggttctctg

SEQ ID NO: 651764 - DNA, 97 bp, Homo sapiens
  misc_feature (18)..(18): n is a, c, g, or t
  misc_feature (33)..(33): n is a, c, g, or t
ccgcacaatatgggaatnaccctgcataaaaangcagctgaagatagactggcaagcacaggctcagaggcaagtcatttctgccgaggcagaggca

SEQ ID NO: 651765 - DNA, 177 bp, Homo sapiens
aagctgaagcgaagagatgttccccctaatttctctctagcccattataacctgctatcttggaggcaacttctgatgtatgacatgtcacccttcccaacttggtctcctccaaggatgctgtcttcatgtggagcggggaccattatccctgactccggccattcaacgcctccg

SEQ ID NO: 651766 - DNA, 199 bp, Homo sapiens
ttttctctgtttcccttttcctagagggggactcacccaagtgagttggagacgtgaggcagaaccatgtgggggacggtcaggggctctgctacctaaatgccaggcagatgcatgggttccttgaggtgaaactgaaatgtatgttggacattcagtgttgcaactgagaaatacagggagagttgccgataaagga

SEQ ID NO: 651767 - DNA, 293 bp, Homo sapiens
gggggtgggggaaatttaaaaaacgggggttttttgtttaagggggcctttttaaggtgggaagttgaccaggggtggcattaaaaatttttggttttttatggaaattttgaaaccaaaggttttgatttttttgttttgtggaattgcaatgttcaggattttttagggggggggggcggggattttttttgtaataggcctttgtttttttttggggggggggggtataaggggtcccccctttttgtaaaaaaatatttatattaaaatgaaagaaccattccccccca

SEQ ID NO: 651768 - DNA, 131 bp, Homo sapiens
tgatctagaggatcccgctattctttttcttcagacgagttcgcactgttgcccaggctggttttgagctcctgggctcaagcgatcttcccgtgtcagcctcctaaagtgctgggattacagtgatacct

SEQ ID NO: 651769 - DNA, 434 bp, Homo sapiens
  misc_feature (319)..(319): n is a, c, g, or t
  misc_feature (322)..(322): n is a, c, g, or t
  misc_feature (346)..(346): n is a, c, g, or t
  misc_feature (348)..(349): n is a, c, g, or t
  misc_feature (369)..(369): n is a, c, g, or t
  misc_feature (378)..(378): n is a, c, g, or t
gcagaggggtgtcccacgcacatcgaggtagagtcgggtagagaaagggagacagtcaggctgaaacccctgctgagatgctccgagtagaggcaaactgaaattacaataataaataagcaacagcaccaacactaacaaaaacaaggtgatgacaatcacagaaaagcgaaggatacaatacacttaaataatctccgggaggagctcatggtacagagagaacagtgtagattatcctgggccacaaaggggctgtcctgggtagttcacttccccagcctgggctctgccgcaggagttcccatcaggaatgttngtncagtgatgccctgaggtgacgcgntnntgtaatccccagtcctgccnttcgaacanctctcccccaagcttctgcactctaagggtggcatggtcctgggagacccctcgtg

SEQ ID NO: 651770 - DNA, 240 bp, Homo sapiens
  misc_feature (9)..(9): n is a, c, g, or t
  misc_feature (31)..(31): n is a, c, g, or t
  misc_feature (37)..(37): n is a, c, g, or t
  misc_feature (48)..(48): n is a, c, g, or t
  misc_feature (52)..(52): n is a, c, g, or t
  misc_feature (69)..(69): n is a, c, g, or t
  misc_feature (94)..(94): n is a, c, g, or t
  misc_feature (98)..(98): n is a, c, g, or t
  misc_feature (126)..(126): n is a, c, g, or t
  misc_feature (130)..(131): n is a, c, g, or t
  misc_feature (155)..(155): n is a, c, g, or t
  misc_feature (159)..(161): n is a, c, g, or t
  misc_feature (171)..(171): n is a, c, g, or t
  misc_feature (175)..(175): n is a, c, g, or t
  misc_feature (184)..(184): n is a, c, g, or t
  misc_feature (200)..(200): n is a, c, g, or t
  misc_feature (209)..(209): n is a, c, g, or t
  misc_feature (235)..(235): n is a, c, g, or t
  misc_feature (239)..(239): n is a, c, g, or t
caagaatancctcgtgtggaatgggatagtnggaaangttatgcatgngctngtgacaacagggacatngggaactctgtaatgtttcttcagntttnctataaacctaaaactgctctgaaaaanatgnngtttattttaaaaataataatgcnttgnnnccagctaggntttnctttaaaantggcacaatggttcantcatttcantgtcaagaatctagtaacataatttntctnt

SEQ ID NO: 651771 - DNA, 117 bp, Homo sapiens
gcatggttagctgactgctctgattcagattcacaagactgcactgagatgtagaccaggccgcagtcatctcgtgtatgagggagcgtttgcttccaaggtcaccatgtgaccgcc

SEQ ID NO: 651772 - DNA, 148 bp, Homo sapiens
gacctccctcttttaccgctcggacctgcggtccgggtcacgttttggtgctgatcgtcctgcgacctcgacacgaccggccaaacgctagtgctagaagcgcgattaagcaacgggtgcctgcgcgcctgcgttacttgcaacggtg

SEQ ID NO: 651773 - DNA, 305 bp, Homo sapiens
  misc_feature (7)..(7): n is a, c, g, or t
  misc_feature (23)..(23): n is a, c, g, or t
  misc_feature (25)..(25): n is a, c, g, or t
  misc_feature (38)..(38): n is a, c, g, or t
  misc_feature (44)..(44): n is a, c, g, or t
  misc_feature (59)..(59): n is a, c, g, or t
  misc_feature (76)..(76): n is a, c, g, or t
  misc_feature (81)..(81): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (120)..(120): n is a, c, g, or t
  misc_feature (123)..(123): n is a, c, g, or t
  misc_feature (163)..(163): n is a, c, g, or t
  misc_feature (217)..(217): n is a, c, g, or t
  misc_feature (227)..(227): n is a, c, g, or t
  misc_feature (232)..(232): n is a, c, g, or t
  misc_feature (282)..(282): n is a, c, g, or t
gagtttntccttcaccctcgctntntaacaaccccatntcattntcattcagcagcatnattctcctctcgctcgnttctnaacccaccaacaanananaagcccacctcctcgcttcanaanactcgcttctctcacatcatggtcattcgcacacttctcnctctctccactaaaaaccctctctctccactctctccctcgctctcgcactcanacactcgcgngcaantcccccctctcaccccccacaccctctctctcgctctctctctctcacanacacgctccctcccactcacgga

SEQ ID NO: 651774 - DNA, 309 bp, Homo sapiens
caagaaggtaagctagagaaaaaaaaatgttattaaggaagtaatatattccctattcgttaggtagaagtgaatcatcctaaaggtcttcatcctcatcttcccgctgagtagtttgaggagcaaaaggagttggtctttctgtcccagtggcaaaggtggaaaaaaatccccaaatacgtggacctgcgcagttcaaacctgtgttgtttgggtcaactgtattgtaaaagcattttaatgtttttctcagacttttacgagtatgaatttgagctttttttgaataaacctgcctgctccccctta

SEQ ID NO: 651775 - DNA, 183 bp, Homo sapiens
ttttccaagcggagatgctggcaccaatagtgatcctcccgaatcaaccctgacccctctccttcataacattattgcagcttcctacactattaaacgtttgccacaaccaccacgcccatcatactcgtttcacaccacaagcatctcctgcttgtggaacagggtaccggagctctgaat

SEQ ID NO: 651776 - DNA, 407 bp, Homo sapiens
  misc_feature (72)..(72): n is a, c, g, or t
ggggtaaagtcttgctctgtcacccaggttgatctcgaattcctggcctcaagcaatcatcctgcacaaagngttaagattacaggtgtgagccactgtgctcagccttaaactttatttaggaattgttgttggccaggtgtggtggctcacgcctgtaattccagcactttgggaggccaaggtgggaggatcgcctgagtcccagagttcaagactagccttggcaacatagcgagatcctgtctccacaaaaaaatttaaaaattagccaggcatagtggttggtgtgtgcctgtagtcccagctacttggggaggttgagatgggaagattgctttagccggaggttgaggctgaagtgagccgtgatcatgccagtgcactccagcctggttaacaaagca

SEQ ID NO: 651777 - DNA, 128 bp, Homo sapiens
actctagacgatcccatgctctggaaaaggggatccccagcaagtgcagagctgagcaggcttgggcctgtcatggcttcctccaaagtcccaatactctagccccgctctcttcccctctttctgtc

SEQ ID NO: 651778 - DNA, 266 bp, Homo sapiens
gggacaccagggaagaagatcaacgcctccacttgaaacataggctgtgtttgcagcctgctctagtggggacagcccagagcctggctgcccatcatgtggcccacccaatcaagggaaggagggaggattctggacttgaggcccctcgagccagatggcaagaggtgaacagctttctttcctgtgtgtactctgtcagttctttagaaaaatggtgccaaaggctccaaccctggttggggtaagaacagcagcgaggtgag

SEQ ID NO: 651779 - DNA, 1014 bp, Homo sapiens
  misc_feature (93)..(93): n is a, c, g, or t
  misc_feature (232)..(232): n is a, c, g, or t
agcaaaccgggataggagaggatcccggagtccgcgtgatggcctacgaggcctgggggccccccactgggtgggctgtggtgactgctgacnctgggacagacccttgtggtgctctcgtggatggctcggactcgtgcgggtcagtgaccgacctgctactgacgactctgcatatgcaggacttaccactaggcgcacagtcctaccaggacactcgagcatgaagatntttccacgcagtggtccagcaggccttgccccagtggccatggccagattcacgaggagcatctggcatggacatacccacgtatcacgaccatgcgtacattcagcagtgacggatttagcaccatggaccgatagaccatggattactcccatgagaagtcctctaccgacgagaatggacatggaatcatgtaccattgaagcatggaccatggatggctatggggagtctggggctccagggcatcaagtctggagcctggagtgctgtcatctctctgggcttatgcggctgtggggccacaggtgctgatctcatgcaggctctcatttagggttcctcttccttatcccccggtggatgctctgatctctccgccggtcatctgccgtctctttacgtttccagagatcgttggcctctaggacttccgcgttcccggtgcggactccatggtcgagaatgctttctcctgtcgaccatccatttccttcgatcgctcttgtaactctccatttctcaccacgaactctggtagctaccccgggatcgtggagcactcccttcagctgtgcctagtggcccctattctgtcctgtggcgactgttgggttctcagtgccaattgttgccgtttctttgttcggtggaggataccttggtggcgactctggtgatacgcggcgaccgtggtcctcagtcttgggcatttgtctcgctcgctggtctttaccctttggattgttcctggacattggaagctcaggaatcgtcctccc

SEQ ID NO: 651780 - DNA, 172 bp, Homo sapiens
aaatcgtatttgtagtagagacagggttacaccgtgtagccaggatgatctcgatctcctgaccttgtgatccacccacctcggcctcccaaagtgctgggattacaggcgtgagccagtgcgcccggacacattcagttcttatcaaagaaataccccagacttaatcttg

SEQ ID NO: 651781 - DNA, 102 bp, Homo sapiens
ggcactgaaaggggaaggaaagaaggaagaacaggtcatcagcctcggccctcaggtggctgaggagagatgtatttgtgtctgcatatcttgcatcttatg

SEQ ID NO: 651782 - DNA, 1544 bp, Homo sapiens
ctagttctagatcgcgagcgtccgcccttttttcttttttttcttacaggaaaaatttaaaggggttacaacaacatatgttgtttccacaacagccagcaccccagcaatatggagggctatccggttcccacgaggcgcccacgtgtgtttatccgaggaactaatcctcgtggtggcacagtgtgtcaccgtgaaagccatctggtcgtgacattccacaggtggagaaagggaacctgtgctgtgtggtgtttcccaccgcgacgcgtggtctatacatttatttgtgggtgtgacaatgtgacatattttgtgtggcgcaaaaagcggaggaatagtgaaaaaatgtgggattcaaagctgtgaaaaaaaaaccttgggacatggcgacgagcatacccacagcacaaaagcaaccgaggccaacgcctgtctgcgacacgagaggcgaggagacacaccgaacaacgggccgctaacaacaacacataaaacagcgcaggccgggccaaacgagagagacccacaatgagagcacaaaacaggaggacaacaaataaaagaaaaaatcagacaaaacaacaaaaacaccatgagacaaaaaaaagaggaacacgagaagagggagaacccaaccagagcgacgaacacgacgcagaagcacagagaaaaccacagaaatcacaacaccactcaatacacacctaacgacgacacacgaacaaaaacataacccaaacaccaccaagcagaaaaaaccgcagcaatgtaccacagcaaaccacagagcgagaaaacaaaagcgacaccgtagaaaacaaaagaccaccacccgactctagacgaacacagcagcaagcacaaacataagaggacccggagagacaccccaggaggaaacgacacagaatacgagaggacgcacaaagaagccgacacgaacacaaaacacggcaacacaacacaacacaaagaaaaaaacaaacccacaagaacagccaccatagcgttaacccagatggagacccacaagacgacaacaaaaacagaagacgaaaacacagcccacacaaaagcaccacaaaatcaaaaaacaaaagaaaaaaaaacgaaaaaaaggaagacgagacagacaacaacacacacacaaacaccacaaagagagcacacacaaaagcaacaaacaccacgaacgaccagcaaacacagcatgatcagcaacacaagaaacacacacaagaaggaaggcagcgaagaccgaacaactaggagacacaggaaaagcacccagagcacagacaagtcaagacaaaggagaacagacagaaaaacaagccacacccagaggaaaccaagacgaaccgagagaagacacacacagcaacagcgagaagcaagacaaaaacacacacagccaccagacgacacgcacgccccgcagccccaaaaacaagccaaagagcacgaacgacattcgcacccacacaacaaaaagcgcacagccagaaggacgcaaggaccgaggcgacgagccgaccaaa

SEQ ID NO: 651783 - DNA, 371 bp, Homo sapiens
  misc_feature (15)..(15): n is a, c, g, or t
  misc_feature (76)..(76): n is a, c, g, or t
  misc_feature (86)..(86): n is a, c, g, or t
  misc_feature (192)..(192): n is a, c, g, or t
  misc_feature (194)..(194): n is a, c, g, or t
  misc_feature (207)..(207): n is a, c, g, or t
  misc_feature (261)..(261): n is a, c, g, or t
  misc_feature (293)..(293): n is a, c, g, or t
  misc_feature (332)..(332): n is a, c, g, or t
gggctccggtatctnagggtcaatcctacagtaggactctgggggcctgggttctgggggggggcagggctcaggnacctcaggcngttcctggggagagggctccggtatctcagggtcactcctacagcaggactctgggggcctgggttctgcgggggggtagggctctggtacttcaagctgtgcctngngggtggtgctctngtatctcaggctcgctcctacagaaggcctctgggggcccaggcttctgccggnagggcagggctgtggttccccgcactcctctngaagacagggctttggcagccctgagtgttttaacagtncaggaaggtgggaagtccagagttatgctctgtggcatt

SEQ ID NO: 651784 - DNA, 568 bp, Homo sapiens
atctaccaggacctccggagagactgcccagcccacatcatacagttgaaacgaaacttgccacaaccagccttgccgtagcatacacatatatcactgaacctgttgaaataaagttttttttctttttcatgattcgtctttggaggtaccctcccgggtggaaggaacggtcgtaccagtaaaaacttaaaggcacaaattctccttgaagaccttctccctcttatgtgaccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacacagatctatttaggccttcattttatgttttttcttaactgttatattatgatcg

SEQ ID NO: 651785 - DNA, 336 bp, Homo sapiens
atgtttagctttaaaccccttttttgtcatctctgctcagatttacattcccaggaggcagaaccctgttacgcgtggtgcaagggatggctgattaacaatatccaccattgcccccagaccacagagaatgtctcaggcaaaggctccctaaaggaaaagcaggggggaaagacaaacactacatgtttacatcaaatgcaatttaaatagtatgtgaggctggcagcagtggctcacacctgtaatcctaacactgggaggctgaggcaggatcacttgaggtcaggtgttcgagaccagcctggccaacatggcattaccccacctctacta

SEQ ID NO: 651786 - DNA, 275 bp, Homo sapiens
tgcaggcatgaaatactgaacatttgccttattatgtcgttagactcacaggtaaaaaaccaggctttgagtgggcacgtatatatattttgttactacaacacgtgctgttggtgacctttgtcgaacgtttcggtgctgatgtgaaaaaaaaaccttgtggactattatcatggggacactaactcctactacacttatggattcgttataaaagaaagtacattttcaaatttgtaaagaattgttgttttgaatacaaaaattaatgggtg

SEQ ID NO: 651787 - DNA, 662 bp, Homo sapiens
tataggagcagattccctatttggaggcatcagactataagatttctatatttgggttaatggatcatcagagacaagcctatcagatccggtatttcacctttcagcttccaaatataggtgaaccttgccccagtctatcttacttttactcgggagagttcatgtgaaattaagctgaaatggagcatacccttgggacctattcccagccaggtgttttgattatgaaattgagatccgagaagatgatactaccctggtgactgctaccagttgaaaatgaaacataccacccttggaaacccaccaatggaaccccgaccaattatgctttgtagtaagaacggccaagtgaatatttattgctccagatgacggaatttggagtgagtggagtgataaaccatgctgggaaggtgaagacctatcgaagaaaactttgctacgtttctggctaccctttggtttcatcttaatattagttatatttgtaaccggtctgcttttgcgtaagcccacacctacccccaaatgattcccgaatttttctgtgatacatgaagactttccatatccagagacctggtattgactccaccgtttcccgatcatggcccaatgttccatatgagtttccataaactgaatttttcttgcga

SEQ ID NO: 651788 - DNA, 333 bp, Homo sapiens
gttcaccgcttattcgctagcccgttccctttgttgtggtttcgctggcatacgtagtgcggcgggggactctcttcctccattctgcgcgtacttcttcgatatccacggcctctggctacctttcgagagtcatagctatttcctggtgtaaaccgcgcttcattgaatttcttcactttgacattcagagcactgggctgaaatcacatcgcgtcaacatccgccgcgggccttcgcgatgctttgttttaattaaacagtcggattcccctggtccgcaccagttctaagtcggctgctaggcgccggccgaggcgaggcgccgcgcgg

SEQ ID NO: 651789 - DNA, 102 bp, Homo sapiens
catgcctgaacccgggcgacaaggccagagtgaggaggaggcgtccatttacctcaacgctatctcttccccaacgctatctcttccccaacgctatctctt

SEQ ID NO: 651790 - DNA, 1250 bp, Homo sapiens
  misc_feature (56)..(56): n is a, c, g, or t
  misc_feature (115)..(115): n is a, c, g, or t
  misc_feature (118)..(118): n is a, c, g, or t
  misc_feature (124)..(124): n is a, c, g, or t
  misc_feature (126)..(126): n is a, c, g, or t
  misc_feature (132)..(133): n is a, c, g, or t
  misc_feature (136)..(137): n is a, c, g, or t
  misc_feature (144)..(144): n is a, c, g, or t
  misc_feature (150)..(151): n is a, c, g, or t
  misc_feature (156)..(157): n is a, c, g, or t
  misc_feature (185)..(186): n is a, c, g, or t
  misc_feature (196)..(197): n is a, c, g, or t
tgtcctagctgctggttttccacgctggttttagctcccggcgtctgcaaaatgangattgaggaggtgaagagcactacgaagacgcagcgcatcgcctcccacagccacgtgnaangggctngnggctgnnacnnagagcgngcttgnnccaanncaggcggcctcagggcttgtgggccagnnagaacgcgcnnagaggcatgtggcgtcatagtcagcacattcaatcaaacagccacagcacacacatggctggcacagcagctgtcttgttaggcaggcacctcctggaactgggccaagacagctctggctctaggctcattgctccaggcagctagggtagtcacaggtcccgcttctgccccacatggctggggcagtgcacagtttcactcaactagcagcatcgaaagcaagcacagcaggtgctgcatggcagcaacttccgccagggccatttggcgctgcgcaatccaaggcagcaccaaggcaagtttcatgcaaggtgcaagtcacaagcagctcaactccgatgtgcagcacagcagccatccccatggagcaggcatcatggcaaaacccattcagccaatgtgcacccatcaggcactcaaaaacaggccaatagggaaaccaaaaacagggtggcaaccgtggcacccccagcaataatatgcaccagttggcgagcaaagcagcggagtaggaaagctggcagcatggtgcaatttaccatagcaagagccaacacaggtgcggggcccgtgacaagacgcgccaggggcagcggggtagacttacctactggcgcacaagacaattacgaccctaggacaggcatgaagacggtactgtcccgcttgggcgcaccagggtggctgtggcacacaagagaacaggacactacatccaagcatgtgaacctaggcgctgacactgggcaatgtgggcaaaaatgacgccgcaccccaagggggggacacaagcgacaacagccctggtcccacgagacgtgagaggcccgaaaaaaatggacaagcccaagcgaaaccacacggcactgaccggaaccaaacaagcagcaggagcagacacaagaagggacgggacacacagaacatagaacacgggaccatgcacgactaggcccggaggatgaggcagtgaacacagccaccacgatgcacataaagacaacacaccaagagacccgaagaaagctcaccaacaagcatataaacaag

SEQ ID NO: 651791 - DNA, 436 bp, Homo sapiens
gccccccagaaaccactgggagttctttattacatcaggggtggacctatttcgcctcggtcctatttgattcatgggcacatggttattctgatcgcattgaaaccatggctcacctgggtttctttattttcggagtgtgtcatgccaaggaaccttcaaactgcgacgcagagaaacttttaaaggttttcagaaacgtgaagccagcaattgtttggtaattgggccttttgaaaacaaatttgccgtgggaactttaatttgtttttggccagtcaagaaaaccctttttgggggaaattaatttcccggcataccccccccctttaccttttgggcagggattattttttaaagttttttttcatgtaagtagcaaacaggggtttactttcttttcatttcattaattcaattaaaacccttcccttta

SEQ ID NO: 651792 - DNA, 618 bp, Homo sapiens
  misc_feature (56)..(56): n is a, c, g, or t
  misc_feature (115)..(115): n is a, c, g, or t
  misc_feature (118)..(118): n is a, c, g, or t
  misc_feature (124)..(124): n is a, c, g, or t
  misc_feature (126)..(126): n is a, c, g, or t
  misc_feature (132)..(133): n is a, c, g, or t
  misc_feature (136)..(137): n is a, c, g, or t
  misc_feature (144)..(144): n is a, c, g, or t
  misc_feature (150)..(151): n is a, c, g, or t
  misc_feature (156)..(157): n is a, c, g, or t
  misc_feature (185)..(186): n is a, c, g, or t
  misc_feature (196)..(197): n is a, c, g, or t
tgtcctagctgctggttttccacgctggttttagctcccggcgtctgcaaaatgangattgaggaggtgaagagcactacgaagacgcagcgcatcgcctcccacagccacgtgnaangggctngnggctgnnacnnagagcgngcttgnnccaanncaggcggcctcagggcttgtgggccagnnagaacgcgcnnagaggcatgtggcgtcatatgtagaattaatcaaaagcaagaaaatggcttggaagatgctgtcttgtttggcagtgacctcctgtgaacttggcaagacatgctctgtgctcttgtggctatttgctcatgtgagcttggtgtagtaatgtgtcccccttcttgcccaagttggattggaggacggtgaatgtttaactcaaactgaggcatcaatgaatgacatgcaggtgcttgatgtgagaactatcctgcaggggccatttgggcttgcagaataaatgtgagaccaaggaagtttaattgaatggtgaagtcacagagctaactccgtgatgaaacagagaatcccatgggaggatatggcaaaaccatatagccaatgtgatcataggacctcaaaacatgccaaaggaaccaa

SEQ ID NO: 651793 - DNA, 932 bp, Homo sapiens
ttaacatccctaataggagggttctggttactgtgccactgcgcttcttggcagagctgtacacaaagaatttcagcagaataattggatgcagttggctgtggtttcagaagagccagaacaaaatttgaaccaggttaattcctgttgggatttctaattggcgaggtttcaattcaaccaatcaatttccagtgatttttgcaggcccccaagttataggtaacatttgtgcagcagaggagaagacccagatgtttgtaggaaaaatcaggccagaatgctgcctcttcaaacttaaatgttggatgcttctgggaatttagcaaagggaaagcaggcttgctgttggagcatttctccatctacattagctcagattatgtattttgatggaacaagatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgttgataaagtgcagttcagcaacaagtcagcaaacatggatcactggcagcagaggttccccacacatgtcaaagatgttggcactgtgtgtccggagctagccgagaagagaatgctggatcatccattaagggaacttttcactggtccggaatggaccgattgttaagtttgaatggctgttccaattgagattgccttaactcccccagagtcttaagactattatgaaggccggctacgaggacaacggtcggaatggctcgcttgttgtgcccttgggcctcgggttgggcacgaccattttggtacaacatgtgtcctggagaaggaaaggcgcccataagggggattaaaaa

SEQ ID NO: 651794 - DNA, 778 bp, Homo sapiens
  misc_feature (169)..(170): n is a, c, g, or t
gagagtagattcgtaactgttcattccacaaaaagcactggttctcgtgttctagtgccgcggatcgtccgcctgagcgttgagtcggaagactagtcccgtagtgacatacatcgcaccagtgagaaggatacctaatcgatcgtggtagttgctcatctacactttnnctactacagcagatcgggtaacgtagtgcatgtacattgttcgatcgtatatttgaagaaaagtcctcttgcgcttcgtagacgacgataagaagatgcactaagtaggtggagagacgagaaccgcttcggcataataacgcctgagacgtggcactcaatataggatggctctccactcgaggcgctaaacaatacatggctgagagaaccacgtatacaataagaagtctagactacaaaaaggagtggacatggagggcccccatacagcttggtttctagacgaccaatcacacgagtaggctctcgcagtgcactttttgagagaagtatggtccggtcaatcgaatgtgacatcgtgaaagattatgccttcgtacacatggagcgggcagaggatgcgaggggaggcactcaggggccttgataacaagcgaagagtacaaaggtgggatgtgtgtgggctgaaattccgagctgcggttgtgcctgagaatacacccttgcgtggtaccccatctccgggacgttctcggcatctgtgcgtcagctccctcaggaaccgtggaccttgaagtttaccttgctaagttcagacctttctc

SEQ ID NO: 651795 - DNA, 340 bp, Homo sapiens
  misc_feature (159)..(160): n is a, c, g, or t
cgaggtcgggggcccctgcacccgcgcactggccacgctcaagctgctgtccatccccctcgtgagcctggacatcccgtcaggctgggacgcagagaccggcagcgattcggaggacgggctgcggcctgacgtgctggtgtctctcgcgggcccaanngctgcgtggccgcttctccgggacgctcaccttcgtggccggcaggttcgtgcccgatgacgtgcgccgcaagattcctctgcgctgccgggatacacgggcgaccgctgcgtcgcggcactgtgacggccaccggcggccacacctcagggaccctcgccaataaacagccctccgtcc

SEQ ID NO: 651796 - DNA, 167 bp, Homo sapiens
gggtttctgtattaaaccatgatggatgagtgtataagtataatgtatatggtatattatgtgatatgatgatatgtggtatgtgtatgatgagtgatgtgtatatgatatatggatatgtatatagtatggatatgtatatatatgcgaatgtatatgtatggata

SEQ ID NO: 651797 - DNA, 458 bp, Homo sapiens
tcgcctctacgacggctccccctgtagctatggacaccaatcgactccgacagggctataacctctctgaacacacaatagctacgaaccaaactcgggattagctaccccactatgcttcgacctacacctcaaaagttacatccacaaaactgctcgccagaacactacgagccacagcttaaaactcaaaggacctggcggagcttcatctaccctctagaggagcctgttctgtaatcgctaaaacccgctcaacctacaacacctctagcaacagactatataccgacaatctaacaacaaaccctgatgaaggctacaaagtaagcgcaagtccccacgtaaagccgtacggtcacggtgtagcccatgaggtggcaagaaatgggctacatattctacccccgaaaatacgatcgcccttatgcccattaagggtcgaaggtggatcaagc

SEQ ID NO: 651798 - DNA, 221 bp, Homo sapiens
agcaaaggtgatggaactgttcgacagcatggcgccatagcccaggggaggggagtccttgttccagcgtagggcaggggtgtccaggccgtgcacggagcagttcacgactgcactgctgtttagatgtaagaaaagcaccttgccctggctgagctccaggaggttcagataggccacgcgcagctccagcgtattggagagctgcacgtcatctgcct

SEQ ID NO: 651799 - DNA, 325 bp, Homo sapiens
tgtagtgctgcatgagaatacttttggctccttctttgccttccaccatgattctggaggcctctccagccttgtggaacggtgagtacattacaacctcgtttttctttataaattacccagtttccagtatatcttcatagcagtatggaaagtaactaatacattaccggagacgtcttaggagatatgtaatagctgtaaatgccaggtccacatggatgggggggcctcaaaatcatggaggacggtgagtgagtgagcaaggtctgactgtaacttggttggccggcaagagagcttgtgcaggggaactcctttatat

SEQ ID NO: 651800 - DNA, 780 bp, Homo sapiens
  misc_feature (696)..(696): n is a, c, g, or t
acagaaaggtaaattagaaaatagaaaagattatggagcatgaaatttacctttctataaggcatattccatgcacatcatttacagagaaggtaaattagaaaatagaaaagattatggagcatgaaatccggtgcatgtaatgtaagcatatgttttatatgtatttttctctctgtacagaataatacatataaaacatatgcgtgcatgtaatgtaagcatatgtttcatatgtatttttctctctgtacagaataataaatatcactatatctgatgcaagtaattcacttccaggattgtgcatattaagcgatcagactaatcccatcattaaattattatcttgcacttatcattaagactccattaccatgtatgtgatatatacaggacatgttccatgtaacatgattttccgctttacaaaatgggtctgatttctgtgtttttacagagctgaacaagtcagcaaagcatctacaaaatgcctctgatttgtataaatacactggtgtgtaaacacaagtgaagatttcgacagtgggcagtcattctcacacttcacgtgcagtactatttccttgccctcatctcccatgctctcaattgttgtctacaggacttaaaactgacaaaggtattttaccatttgaacgttcttacagcaacaaaacaaaagcatctcacgtncaactccatgtgggcacccttaccggtccgctgaagttcctggtcacaaacgccagacacgcatgcccaccttccatggatacc

SEQ ID NO: 651801 - DNA, 397 bp, Homo sapiens
aatggcacgtagtgtagctctttcctagagaactcattctgactagattatgtacggagctggctgccatcatcgatagtctctcctagccagaacgtagtttcttgtccgatgcagctcctataccagtacttggctgggatgtcatcaggttgggcccggatactggtctcgccacgtagagaaatcacagatatacttagagagcatccatagtgcatccttggttagggtcaatccagtcatacccactgctccacactgggatgagctaagtctcaagaacacggcatgctgcgagctgggatcttactagagcctacaggaataagaagggtctcaatctggtagtggagagacttcagagtagcatccacttcatagtccttgggtctgg

SEQ ID NO: 651802 - DNA, 498 bp, Homo sapiens
tctgcagctataatttaggcatggtaggagctgtggttgtaacactctacaagatgggttgtccggaagccgccagcttcttttagaactcatcacattgaacgctgttccaaccagactctgcaacgtgatggactttcaacggcaagatctctgctttttacacgcgacgacttcgacgaacgaaacctctgaacgacggacacgcgggaacccacttttgttgaacgaacaactcgtgtggctattaatttggcccttcaacggtcgacaacgactgcgccctggcgggctaaacgcacgcgtccaccacatgggctggcctgcgactgtgcacacgaactggcccacacagcgcctccaggatggcgtatcacttaatctttcaaggcacttaacgtaacagcggctgaacatggcctaccaaattccagcatactgtggctgcaccattccaggaacgtttaccgttggccttgtttaccacttgcacttgcg

SEQ ID NO: 651803 - DNA, 354 bp, Homo sapiens
aggaggctcactcgagatcagtagaacacaaccgtagagaggccattgagcctaagacgcagaggagttagagaatggacacggcgcgagagatattgtcccggacgggaaagagagttaattatataccacacataagatattgaggattaatcgatatagcttctggaaactggaatgaccatctaagaacagcttaaagagtgcactcctatatctaggagaatgttgccaagaatcacaatttgaacttaagagcctaccgcgcctcctgaaatgtggatgtccaagattgcctatgtggactttacactttcccagagcaccctagagaccgccttggtgagatctgtg

SEQ ID NO: 651804 - DNA, 536 bp, Homo sapiens
tcctgtgtgtgttgggattacaggtgtgagctactgcgcctggcccaacaatattcttgctgtagctccaggggtttccaggaagaattgggggcaatgtggtgctcccaggaaggagttggattctttctcaaagactatgcagagaatagaaagatgtgatcctttatgatttgaaatcggccctactccagcctcctgatattgttggtggatgaaaggtatattgttgccaaagtcattaggtctgtttgaggcagctggtttcagtttccgtttctggggttaagctgttttgcctctgaaatttcttccatcagaagctactctttttttgttgcttgctaataggaaatcttttgccatttctgtacatttaagagtagccttcttggtcttcttgattcttttgatagcttgaaaccaaaaaattgagcttcagtttcttcttggtttagtgctttcctccttgttcttccttccgtttttaggagttcttgtgttctcaacacaccaggaagtccggaccgagctca

SEQ ID NO: 651805 - DNA, 187 bp, Homo sapiens
  misc_feature (40)..(40): n is a, c, g, or t
aaaaaataaaaggggttttcttccccaaaaaattatggcncccgcttgggtttttgggttgggggggccctggtaatgcccccgcgggtttattttgggttcccttaaaaaaccctttttttcccttcccaaattgcgggagaaaaactttccgccttcccaaaaaaggggcccctttaccctttta

SEQ ID NO: 651806 - DNA, 535 bp, Homo sapiens
  misc_feature (54)..(54): n is a, c, g, or t
  misc_feature (122)..(122): n is a, c, g, or t
  misc_feature (159)..(159): n is a, c, g, or t
  misc_feature (277)..(278): n is a, c, g, or t
  misc_feature (470)..(470): n is a, c, g, or t
acttggctctcgccctccggccgggaagcatggggcttcccaggctggtctgcnccttcttgctcgccgcctgctgctgctgtcctcgcgtcgcgggtgtgcccggagaggctgagcagccngcgcctgagctggtggaggtggaagtgggcagcacancccttctgaagtgcggcctctcccagtcccaaggcaacctcagccatgtcgactggttttctgtccacaaggagaagcggacgctcatcttccgtgtgcgccatggccagggccaganngaacctggggagtacgagcatgcgtgctcatgcctccatggacatgatggggcgtactcttggcccatgactcaatgtcaccctcccaatgactgatgctgcattcttctttgttgccatggagcaatgctgcccgtcgtgtacaccagtgaagttacgctgcattccatgcttcctgctgtacttaacaanatggctacctgtgcagtgatgtctcaaagcattccatggtacaatcccacctggtgcattcctcg

SEQ ID NO: 651807 - DNA, 217 bp, Homo sapiens
catgtctttattccatatttatagtctacttcctgtggctgggcgcagccgctcctgacggttccgtgggggtgcggggggttggacaggccactccttcttggaaggcaccaattttcccagccccactcccattacacacacacacacacacacacacacacacacacacacacacaacagacgagtgagacgagcggcgagagcactcaccccc

SEQ ID NO: 651808 - DNA, 362 bp, Homo sapiens
catttgcgtccaggtatcagattagactgagcaacacggggagacctcatctctacaaaaaatttaaaagaaaattaagtgggcatcatggcacgagcctgtggttcccgctactcgggaggctgaggtgggaggatcacctgagcccaggaggttgagacttgcagtgagctgagttcacaccactgcactcgagccttgatgacagacatgtgacggtctcaaaagaaaaaaaaaacaaaaaattgggtctcttaatgtccaggtgggaccccttaataaggtttgggggcccaaaacaggctttccctctgagagggcacagtccacgggtgggggagactccaagtttaaaattgggc

SEQ ID NO: 651809 - DNA, 426 bp, Homo sapiens
ctccaggtttctctaaggagatgctgcagccctggccggagtgcctggcttgaggtgtcagcagctggatggagctagggcctgagccatggcgggacaggcgtgaagggatgccgggttaattgagcccgggctggcgaatcactaggcctggagagagcgagtcagttagcgggagcgtccggctcctaagtgatcgacacgctcatcatgcatacccatctttcttggcccctagacccccaaccacataactctttccctactcctatcccaccatgagaaaggatagaagactaatactgctcttgtacccccaagatactctagtgctagacaattgagatggaaggatgccaaagaatagagacacaaaagcaaaggggttagggcaaagtggaccgcctgaatgctgcgccatgggat

SEQ ID NO: 651810 - DNA, 891 bp, Homo sapiens
ccaaggtgccaacgggggtgttgattccagcgcgggcttgtaccagaactaagatacgaagtatttgtggaggtgcgataaatagttaggcaggggctggttgctgagcagtgccgtagtcaaaaccacgtgttggttggggtggtcgcgggttccacaaacaacaaacgccaagacgacttctcgtgtgtagtggtggatggaatcgatcccccgccacgcgcagggctgtctctgtataaggagatgcgacgtgaaggaggtgacgtgcgcagattctcctgtgccgacggcggcgcgacggtatatttattgccatcgtgtacgtgcatagctctaacagttagtgtgggtgataacacacatctggcgccgggtcatagttcctgtgtggtatagacaacactcacacgtggcccgtcgcgtcgtgtggttacatattattcttgggtgcacgcgcacacttagctagtgattggtcatagctatgcgcttgtttacgcacgcacgcacacaccacgtttgctgctcgcgcgcgacggggcgcgtggtgctcactacgcatacacatcgcatgaagaatgttttaggggttggtcggcatgcgaatagaccgagggtctccatgtctgtgtataatagtaagggcgtggcttttattgtcggagagcgggtgtttttctcttcctataaaaatcagttgtgcccgagttctcggagtgtcttgtcccagcgtgtaatacgtcagacacaacaccgaggtgttgttgaaagcacgccaagtcgtggccacgtcaggaggagaaaggaattattccagtaagagcaggcgtttacgcctccccaccacataatcattacatacaacaaaacaaaataaaaaaaaacata

SEQ ID NO: 651811 - DNA, 192 bp, Homo sapiens
acctatttcatgtggaaaatgcaaacgaatcctgtgaaacattgctgtaaaaaacatgaacatttccatccaagccgagagttctccaagacaatgtctggttcctggggaaaatggcatggcaactgctggacccaaaaaaatggttgccagtctttaatctgcactgatggaacactttgggggctttcc

SEQ ID NO: 651812 - DNA, 299 bp, Homo sapiens
  misc_feature (186)..(186): n is a, c, g, or t
  misc_feature (199)..(199): n is a, c, g, or t
  misc_feature (213)..(213): n is a, c, g, or t
  misc_feature (256)..(256): n is a, c, g, or t
acctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtnagtttcctgaggnctccccagccacgnttcctgtacagcctgcagaacttctggcatggaaaagcccctntgcaatggtaaagatatcaataagcaccaggaggtatctaaat

SEQ ID NO: 651813 - DNA, 196 bp, Homo sapiens
gatgtgcagtgtaaatccagcacaaagtcgtcacttactaaagaacgtatgagattttgtgtgtgtgtgtgtgtatgtgtgcgtgtgtgtgtgtgttttttagctcatcagttatcgtgagtgtattttatgtgtggcccaagacaattctttttctaccaatgtggcccaggaaagccaagagattggccacccc

SEQ ID NO: 651814 - DNA, 118 bp, Homo sapiens
attagaggactgccggccttgtcttcatatgagctttactgcagcaattaatatagcatggagctggaataccgggtgtggaccagatgcctccaatgatcctgttaaaggattaaag

SEQ ID NO: 651815 - DNA, 681 bp, Homo sapiens
gggcggagtttggtgggagagcgagttcgagatgctccgggggcttagatgagataggggtgaagagcggtgactggttagaagcggcttgctggaatgaggagctatcgatggagaattaagggtggtaaggagtagacccgtgtgcatgtcgcagacttcggtgtagaatggccagagaaaggtggttaaaaaccttggtgccaagtcaaatgtgggcaagcgcgtttttgacagaatgactaatgcagggagaatgggcagtcaacttctgaattgattggccagtttggaggcggtttctatgtcaccttccttgtagcagataaggttattgtcacttcaaatcacatcagcggatactcagcacatctgggagtctgacgccaatgaattttctgtaattgctgactcaagaggaagcactctaggacggggaacggcaattacccttgtcttaaaagaagaagcatctgattaccttgaattggatacaattaaaaatctcgtcaaagaatattcgcagttcataaactttccgatttatgtatggagcagcaagactgaaactgttgaggagcagcatggaggaagaaggagcagcccaagaagtgaaaggtggatctgatgattgagctgcagtagaggaaggcggtaaagggagaggactcgctcgtgccg

SEQ ID NO: 651816 - DNA, 474 bp, Homo sapiens
  misc_feature (34)..(34): n is a, c, g, or t
  misc_feature (85)..(85): n is a, c, g, or t
  misc_feature (98)..(98): n is a, c, g, or t
  misc_feature (137)..(137): n is a, c, g, or t
  misc_feature (143)..(143): n is a, c, g, or t
cgtataaagaccagcttaggctgggcatggtggntcacacctgtaatcacagtgctttggaaggctgaggcaggaggatttcttnaggccaggggttnagaccagcctgggtaacatcgtgagaccacatttctgcnaaaatnaaatacaaaacttagccaggtgtagtggcatatacctgtagtcccagctacttgggaggctgaagcaggaagatcacttaagaccaggagtttaagactgcagtgagccattattgtgccactacatgccagcctgggcaacagtgagatcccatctctaaaaataatttaaagaccagcttaggccaggtacagtggcacacacctgtaatcccagctactcgggaggccaaggcaaaggaattgcttgagcctgggaggttgcagggagccaagactgcgccactgcattccacattccagcctgggcaacagagggagactctctctc

SEQ ID NO: 651817 - DNA, 320 bp, Homo sapiens
  misc_feature (8)..(8): n is a, c, g, or t
  misc_feature (18)..(18): n is a, c, g, or t
  misc_feature (71)..(71): n is a, c, g, or t
  misc_feature (180)..(180): n is a, c, g, or t
  misc_feature (253)..(253): n is a, c, g, or t
gtttcctncaatcaggcnggtctgtgagactggggttcatatcacttgggtattaagaggaaataagaaantatatggcagtcattggttgttgagactgggacatttgggttttactaagttaagagaaaagatcactctccccttttcaataacacaatgtcttttcattagaagccngaaatagcagggtttttctctgctgttccattccttcgaaaccctactcataattagcttcccacaactcctnctaggtttcttccaccattactcatcagcccggtctatttgtttttacagattatggtttctcaact

SEQ ID NO: 651818 - DNA, 190 bp, Homo sapiens
ccctcgtagcggacaactttgaacagcacgtacagcccgtacttgtattcctggcttcccatcaatcatccgcatgtcatggattcgggtctatggcagtgtacacaggcatggaggcagcagtggtgacaagaccgctgatcatgctggcacagaagtggcacaagatgttgtcatgagaagtagcctg

SEQ ID NO: 651819 - DNA, 377 bp, Homo sapiens
  misc_feature (377)..(377): n is a, c, g, or t
ccttctacgtctcatcactgggattgccagaaaaaatgtaggatgttttggttaaactagaattttagatcagcaaaaaatagtgtttaataaaaggcaatatttgggacatacttatactgaaatactcttcactgatgctctgtctgaagtttgaatttagccagcatcctgtgttttgatttactaagtctgacagctctacttgaagtggcaaaatgctccctgaccttttatccccgagatgtcaccatactcatttgacttcatgaggtaaacagctctgtccctttggcccctgtgggacgctgtgaaggtggagattatatatcctgtaatcagatcacttgtgcctacagtgatgagacgtagaaggn

SEQ ID NO: 651820 - DNA, 778 bp, Homo sapiens
gctctttccttgcctaacgcatgccatggctcgtggtacccaatgaagcatctgaagcggtgtggtcagctccaaagctatggatgctggataaattgaccggtgtgtttgctcctcgtccaagtccaccggatccccacatagtgagagagtgtctccccctcgatcgattttacctgaggaacagacttaggtatgcccgtgacaggagatgaagtagagaagattgcatgcagcggttcattaaaatcgatggcaaggtccgagctgatataacctactcctgtctgggattcatggatgtcactcggccattgacaaggacgggagagaattgccgtctgatctatgacaccttagggttcgctttgctgtacatcgtattacacctgtaggaggccaggtacaagttcgtgcaaagtgagaaagatctttgtgggcacgataatggtaactccctcatctggtgaccgtcaattgatgcccgtatcgcattcgatagcccgagtcccctcatcaaggtgaatgatagcattcagattgatttagagactggcaagattactgatttcatcaagtacgacggtggtaacctgtgtatggtgactggaggtgataactgggaagaactggtgtgatcacaagagagagaggcaccctggatcttttgacgtggttcacgtgaaagatgccaatggacacagtttgcgactcgacttgccaagattgcggttattggcaagggcaaaacatgggttttctcttcccgaaggaaagg

SEQ ID NO: 651821 - DNA, 249 bp, Homo sapiens
  misc_feature (74)..(74): n is a, c, g, or t
tacccggtcccatgcacagttaggcatgccccgatgaacacacagtcaggcattccagcaaacacacaggcagnccccgatgaacacacatgtcaggcattcctcagcaaacacacagtcaggcagcccctcgacgaacacacatgtcaggcatctcccagcaaacgcacagtcaggcaggccccgatgaacacacagtcaggcatctcccagcgaacacacaggcaggcctcgatgaacacacagtca

SEQ ID NO: 651822 - DNA, 241 bp, Homo sapiens
cccgactagcccgacaggagacactcgaacccgggaggcagaggctgcaggagccgaaatcgcaccactgcactccagcctgagcaacagagcgagacactgtctcaaaaaaaaagaaagaacgaaaagaaaataccttggaatgaaagacgggggggccattaagatgatgctgggggtgaaggtggaaagtcacggatgatgctgtcgggctagtcggggggggactcctctagagtcg

SEQ ID NO: 651823 - DNA, 578 bp, Homo sapiens
gctgtccaaataatcccatacagcagttatggttgtatccctattttacaaatgggaaaggtgaggctcaggaagtccaggtggaaatgtactcagagggcaaatggtggaggcaggctcgacagtccagttctggctggctcccaggagctgggtctatctttggaatcgttttgtatcctggaaccgattccacagggcctcttttcaggagtccagggctctcctcgaaatgtctctgtgctgcgtcggcgacttccctaaatccctttgaggcgccgggcaccacctccaagcagatttcatgggaaatggctgtcccacctcgtggccagatggcaaatcccagacatttgccgggaggaggcgagggctgtgtgacgggaggggcttggtggagcagctggtgcaggccttgctttccgagggcggcgtgacagccacatgtgcccgactgcggtgctgctgggggaatggcagccttacaggctgaccacctgcctcctcagggtggaacggcggggcttgggtgtgagcgtgctgaatcaagaactttcctggaaagtaggcactaggtg

SEQ ID NO: 651824 - DNA, 1057 bp, Homo sapiens
ccccacgggggctccactcgtgagaacagtggaggatgcagggttggcagtgtttacctgtcctgtggctgccagtggatgcccaccagggtactgtccaactagtgtggcactcctgcccagaggacgggtgagtgacaaggagatgaagacctaccgacctgggatgctggaggaccgctgatccccagtgatggcttgtgtgacctggagcgaggagcgctgaggccgtcatccagggccaggcagtcaggaaagagcagcaccggtggcccacgctccagtggcactcctgaccacggagaccccaggacccccggcccagcctcggtccacgccccttggaggagaacgtggttgacagggagcagattgacttcctggcagcgagacagcagattcctgagctctggagcaggcgaacaaggagggcccatcatagctccccggccagggggaccctgcaggcacaagcccaggggccatgcaggaccccaaggccttcaacaagccccaactggccaacgggcacgtggttcccatcaagccccaggtgaagggggtggtcagggaagagaacaaggtgcgtgctgtgccacctgggccagtgtcaagttgtggatgaccctggttccttgggctcagtggaagtcccggggagccccagggagacgcccatcgagcggagatcgtctggtcaggagcgtcaggagacctgcgaaagcaagaggggctaaggcagagaaccgacaaccaggaactggtggaaatcccacagtgcgctgtgaccagggtgagctgatcaggcccaggggaaaaaggcgccgtcctcaacgtcatgcgaattgttacaggcaaccagatttatgaaccacgggctgacgcctgcacgatggcggagtcacaaccaaagtgtctaaggaccacaacgtgcaccgaaacccaagcctacactagataggcgagtcctgagcgcaacagctaagatcgtgacaaccacagagtcagacaccggtcgacgaatagatcagagaagtcatagaccgagatcaacact

SEQ ID NO: 651825 - DNA, 855 bp, Homo sapiens
cgcaacacgactgccaacggcagagagcatgtcccgcccctttgaatggtgttctcggagttccccgtgttgtcctgcccggagtgcccccgcctggtattctcgggcaagtgtttttcagatgttgagattgtgggcacttgggccgcaatgccccggcacgtgcctccgccgtgtttcgtgcccccccgctctatgcccccgcttcctctggtttgggttccacgcggctcaacgacaagcaagcttttgtggccgaagactagtcgtgccccgccgttggtcaacacttggatggccccccattctgagtgttggcgtgacccccctgcctatagggtcccctggccaaccaactgttgtgaccctcctcccggtccacccccgtggggcgcctttcgtccgtcggttaataaacaagaccagcccacaccggggggctctcaccaaacaccagggcacacacaaacgagtgtctgcgatgtcggccagagggccaccaagctggtgccccgaagcatcttgagagcggtcgaacgaggctatttattccccgttttgcgcccccccccctcctaaacccccggctggaaacaccctcctcaaacacccttgtttccaaacggcccctaagagtcaagtagcaaaaaacacctctttagacagaacaggctgtgttaacacccctcccacaacatacaaaaaacatttttccgacccccactggccattctttacttgccgacgggcccatcttaaagataacaagtctatttaaaaccacccagactttttcatggaaccaccgccccccagtccccacaatgacccccccaaaaaaaacacaaacaaaca

SEQ ID NO: 651826 - DNA, 807 bp, Homo sapiens
  misc_feature (161)..(161): n is a, c, g, or t
  misc_feature (236)..(236): n is a, c, g, or t
  misc_feature (239)..(239): n is a, c, g, or t
  misc_feature (247)..(247): n is a, c, g, or t
  misc_feature (251)..(251): n is a, c, g, or t
  misc_feature (271)..(272): n is a, c, g, or t
  misc_feature (275)..(275): n is a, c, g, or t
  misc_feature (277)..(277): n is a, c, g, or t
  misc_feature (291)..(291): n is a, c, g, or t
aatgttaggtatagctctatagtagtctcgaggagtagggcagtttgccgtaaaagcctagatagggattgtgcggtgtgtgatgctagggtagaatccgagtatgtggagaataaatgtgcatagtggggattttattttaagtttgttggttaggtagntgaggtctagggctgttagaagtcctaggaaagtgacagcgagggctgtgagttttaggtagagggggattgttnttnggaagggngatncgggggaaatgttgttagtnntgngnaatcctgcgaatangcttacgtttgtcatacgtattatgatgtttagttgtgttgatgctattttcgttaacgttattatggtagttgattactaggttatacttatttattattttattttattatattatttttttatattttattatattatataattattatgttgtttcctgttctattttatatttttttatgtctttttattatttgatgtactattattttttattatattataatgatattctcttatgttcctacctttatatattttatctatatcattattattatcattattctattatttaattttgtctttttttttattgttactttcatgatattttttattattttgatttctaattttattacatattcttcattttcttattattattttcttttttattattattatattaattattttccatatcatctttgacattatctttaattattatttatgattatttattgatcttctttattatgtattatattttatactttttcgttg

SEQ ID NO: 651827 - DNA, 391 bp, Homo sapiens
cgccaataggaggctctcagaggcaacagcaaataggtaacacttatatcacccatggccatattattcttattattctaatagcctattcaaaacttttcatcttgatcagctgtaagagatcataagttccatacgcttgagtgttcaaactgagagcagatggtcactcaacagtgggtaagcaaggtgccaggttgccagggatcagtgtggaatattagcttacctaccctcagctgagtaagagcttactcagcttggggccgggtacagtggctcatgcccgcaatcccagcactttagaaggccgaggagggcagatcacgaggtcaggagatcgagaccatcctggccaacctggtaaaacccccgtctctaccaaaaatac

SEQ ID NO: 651828 - DNA, 717 bp, Homo sapiens
  misc_feature (161)..(161): n is a, c, g, or t
  misc_feature (236)..(236): n is a, c, g, or t
  misc_feature (239)..(239): n is a, c, g, or t
  misc_feature (247)..(247): n is a, c, g, or t
  misc_feature (251)..(251): n is a, c, g, or t
  misc_feature (271)..(272): n is a, c, g, or t
  misc_feature (275)..(275): n is a, c, g, or t
  misc_feature (277)..(277): n is a, c, g, or t
  misc_feature (291)..(291): n is a, c, g, or t
aatgttaggtatagctctatagtagtctcgaggagtagggcagtttgccgtaaaagcctagatagggattgtgcggtgtgtgatgctagggtagaatccgagtatgtggagaataaatgtgcatagtggggattttattttaagtttgttggttaggtagntgaggtctagggctgttagaagtcctaggaaagtgacagcgagggctgtgagttttaggtagagggggattgttnttnggaagggngatncgggggaaatgttgttagtnntgngnaatcctgcgaatangcttccgcatgccaggcgtttaatggggtttaatagggtgggattattttcattaatggtagtaagggtggggaagcgaggttgacctgttagaggtgagaagaaatattcgagtgctataggcgcttcttagggaggtagcgatgagagtcatagatagggctcaggcatttgtgtatgatatgttagcggtttcgatgatgtggtctctggagtagaaacctgtgaggaaaggtattcctgctcatgctagactgccaatggtgagggaggttgaagtgagaggtatcgtctttgagtagtcctcctattgttcgtatatcttgttcattgttaaggttgtcggatgacggacccggagcacatatatagtatggcctttgacaaagcgtcggtacagatgtgcatgaatgctaggtgtcgtta

SEQ ID NO: 651829 - DNA, 696 bp, Homo sapiens
  misc_feature (268)..(268): n is a, c, g, or t
  misc_feature (544)..(544): n is a, c, g, or t
tcttttaaaaagttttttcacgaaaaaaaccccccttcaaacgagggcagtccattctaacgcccgggcatctctgttttaagggcccctcatgcccccaggttggaacagttttcctagggcccaaccctgttggggttggttcgggtacccaagggtgaagccaaacaaatttttctgtggtacccctttccctttcatgcccaggctttattcttgcccctcaccagttgaaggtttcaaacaccagtattcagaaggcatccgnctccattaagtgtgcagccctaaaaagacatttccaattaggccagggattaccccctgtgggagggtggacagccaatggttcagtggcctggctgttggcaggaactccaagtccccagcccttttgggcagtttagggccccccctttgtttcataaggcatgggtcattttttttgggggtcctatcccaaatggaaaaaaaaggggctttaagttttggcttttttttttttggggttctctgcacctaaggaaaccaggccctgggtganttttcaaattttgttccccctcggtgagcaacagtttcacccatccaaccaggacaaaatggtgattggggccccttggtgagctgtgtttttcctaggaggtaaaaaactttgggaaactgtggttaataaaaactaagtgtgggggtcca

SEQ ID NO: 651830 - DNA, 390 bp, Homo sapiens
gtattactctcctacacgtaatatcgtttggctgtgcacctaccataaatctcatcttgtaactgataactcccagaattcccacctgctgtgtggaatgagctggtcgtgaggtatctgaatcatgggggtcaggtctttcccaggctattctcataatagtgaatatgtctcacgagatctgatggtttcaaaaaggggagtttccccgcacaagctctcgtcttgtctgctgccatgtgagatgtgcctttcaccttccaccatgattgtgaggcctccccagccacgtggaactctaagtctaataaacctctttcttttgtaaattgcccagtctcggttatgtctttatcagcagcatgaaaacagactaatacaggcggctag

SEQ ID NO: 651831 - DNA, 394 bp, Homo sapiens
  misc_feature (49)..(49): n is a, c, g, or t
  misc_feature (71)..(71): n is a, c, g, or t
  misc_feature (90)..(90): n is a, c, g, or t
  misc_feature (117)..(117): n is a, c, g, or t
  misc_feature (137)..(137): n is a, c, g, or t
  misc_feature (174)..(174): n is a, c, g, or t
  misc_feature (176)..(176): n is a, c, g, or t
  misc_feature (204)..(204): n is a, c, g, or t
  misc_feature (218)..(218): n is a, c, g, or t
  misc_feature (224)..(224): n is a, c, g, or t
  misc_feature (240)..(240): n is a, c, g, or t
  misc_feature (250)..(250): n is a, c, g, or t
  misc_feature (271)..(271): n is a, c, g, or t
  misc_feature (276)..(276): n is a, c, g, or t
  misc_feature (281)..(281): n is a, c, g, or t
  misc_feature (285)..(285): n is a, c, g, or t
  misc_feature (294)..(294): n is a, c, g, or t
  misc_feature (333)..(333): n is a, c, g, or t
  misc_feature (372)..(372): n is a, c, g, or t
ctaccagaatgggcagggtggctgtagtaatcggtgaagaaaggcatcncgccagacccgccctgactccnttagtgagtggatgaggtnggcgaaggctgaaagccggggcttggnctggcaccctatgccatgcntggcacacaaggcctgcccccggggagccactctgtngnaatcctctcgaggcaccgcgggacacanacggcgcccaaccnggaagncgacgcgtcccctganccagtcattnacggcagactcgtcgccattncatgncgccnggcnccgggtggnaacccagtccatgtcccggtcatgaccaatgtccatggnaatctggttcacctgtgtcacccacacaaaccagtcgcntcccaggaacctgattataaag

SEQ ID NO: 651832 - DNA, 236 bp, Homo sapiens
agttcgacggagactctctaagagtcctgaggtggtacaggccatcgcaaggtgagggggctaagtctgctagctcatgtctctcttcctctatacctagaaaaccaccagtctcactcccatgataagccattaagttcatgaatggatcaattcatgcatgaaggcaagaaccctcaggaccccacttatcaataccaccagattagggattacatttctttcttttttttttt

SEQ ID NO: 651833 - DNA, 1693 bp, Homo sapiens
  misc_feature (320)..(320): n is a, c, g, or t
gtattagtcgcgctgatcctattactacgatgtttggtttcttttcgtctaggctccacgtgttctacaaatgcgttgttggttgctgcgcgctgattgtgttccgtgttctatgttgtactcccttggtgttcatattttctccagggggctctttctccgtgtctactttcctgttaacagctattagtttgtgtcccgtcacactatccgctgggggtgacctactagagcatatgggttttcgctggctcccctttggtcgcccttgcacacagaatttgtggaatcaggatcaacctctgctcagaatgattccngctggtggggaagatggtgaacatttatgacctcccgggggtcctctccgctttggataagagatagctctttggggcccgataaaagttgttgctggacgaccgacccaacccccccacggggttttaatgatatatttggtccccccccgcccaacggacagtctttccgttgggggaagatggtttcctttaaaatttttcaaagggggaaaaggcctgtctaagacaaccacccctgggggtgcaccttgaaccacgagatacccccggaagtggtctgtgcccccacgccaccggtaaagggatgttcccccccttcaagtccaggatggaaaatttggggcaactgaccaaatgtggtcacgtcggcggtggggatgcaaacacaactgggagaggggggccacatatgagacaaatgtaagaacaacagtggggcacacaaagtgccctctctttccgcgagatatatattgtagggggcctttctcggggcgccttaccacaaaaagggggcacacaacaggctgctctccacccgcccgcatatatttttacttttggacttggtgtttatactgagagcacagggacacacagtgccccgttctatagatcagtgtgttggagacagatgagtccccacatgccttgcactgctcacatcctgcatattctggtgagagaacaccacaccgctgtgcgcacaaaatttgctaaaaagggtgggtggcgtctcactgtccgctgtataaagaagctatatgtatagtcttctcacaagggccaccacgcgcgtggcgtgggcacacacgcgtgtttataccacgggctcgcagagtgtgggaatgaacatatattgtggcaccacacaactcgtgatacgagagcacagccttgttcctgtggagaaataaggggggtgtatagctttgtgggagacctcgaaaactcgtgtcctcggagaggcgcccacagagccaattgtttccccacaggttcaagtgtgtgcacatgtaataaatagaagttttccgtcctttcctggccccacctctggcaatgtggtgagagacacctgagaccacgtcacagagatggtaagttgagagggtgagactttttcctcgctgtcctcggcctcttattaaattttaactcacctcacctttgagatttaatgttttgtagtcacaaatttgaaacttcacttttggggggtatttttggtaactgtgaatggggtcacatccaaattaattaaatctgaaaaatagccaaccccgaatgttaaaaagaaaaaactgggggggaaaagacccggtttaccgtgatagagccaagccatccaagaatctttaaggaaggtt

SEQ ID NO: 651834 - DNA, 952 bp, Homo sapiens
  misc_feature (303)..(303): n is a, c, g, or t
  misc_feature (448)..(449): n is a, c, g, or t
  misc_feature (645)..(645): n is a, c, g, or t
  misc_feature (686)..(686): n is a, c, g, or t
  misc_feature (764)..(764): n is a, c, g, or t
gtaatcagagaaaaagtctttaacgtccaccgattagtcatccccataagctaaagaattctaattttaaacgtattctctagttctttcatgggagaagcacgatttggtgtaccaccgcaagtattgacgtacacctcatcagataaccggctatgtagtatcgtgacataatctgccatgtcatccatgaagtatttgtacggtaccataaagtaccttagtccacgcttagtaggtagcattaaaaaacccaaataccacgatcaagaatcgcgccatccatctagttgctgtacatangcgaatcgtatcaaagcgaaatcaaaacgcactcatatataatcgagcaccactcaatcgatgcgaatcgtcccaataagtcatctcgcctctgacaccgatttaagcgaataaccgaaactaaaatcataaactcgacctcatnntaacatgttgacattaggttaccaattaatatgctgccatgtgtactctgttaacaattgagtgcgactattttacgacgtcacatagtccagcttcttcgatacctccaatggaattgtaactcctctctcgtctaggaatagcggtgtccgcgtttgcgaccaatctctagtctcttcacgtggaaaattcaantaatccactgcgagcaaaagaagttgcttaccttcattccntcggcgtcgcggtgtgtcctcattgagagacatctttggtggggggtatgcttaatatgttgacaccttgtaatccgngaccattcttgggtttccttactttcagtggttccataaatgccttaaatatgccgcacaacgttcccccttaaaataatgaccatcacagattgtgatcaacagggttctatcgacccttatttaaaccaactcacagggaagctctcccattgcattttggtaatttccgtcttggggaggttgtg

SEQ ID NO: 651835 - DNA, 227 bp, Homo sapiens
  misc_feature (47)..(47): n is a, c, g, or t
cccccccgccctcacccccacccactcccaaagcacgccagaaaaangcctagcacactcaggatccgttcctgcttgtcttgccctacctccacgtgcacacagccctgttctccagcaaagactttgctggcaaaagtcaacaccggagtctacgcgggatgctcgttgaggaaatggactgcgagtgtgcgcaggacctcgccccttgctatcgcgaccctgct

SEQ ID NO: 651836 - DNA, 115 bp, Homo sapiens
cctcagactgcgcccgctcgcaacgatccaaactacgatgctttttacactagcagtcaactttacatcatacgctgattggagcttggaatttaccgtggactgttaggcacca

SEQ ID NO: 651837 - DNA, 947 bp, Homo sapiens
  misc_feature (855)..(855): n is a, c, g, or t
tcaagaaaaacacaaacacaacctcacaaataatgtgatcaagtctgccacatgcgcttgccgatctgcgtcccacactctgtttgaacctcgttatctcctcgctctttcgtttgcgttgtgacaagtatttggtccacttgccaattccatccaatctgccgctcgactctacacttgccgtgaagccatgtgtcccatacaattggtttccccacacatcacgataatctcgttgccactatgacccttttatccacggctaacatctgcttcgcacatttttccatacactaaccgcacgtgcctcgacacccaaaggaaaattggtagagctccccaggttccgtgacatctccgaaaacaatttattaaaatgggcacgccaattaatttgcttccgtataggccccacacccgtcatgttttccatcacaccccatgtgatatttcctgaacctctatcaaaacacgttgcccctactacttgtaataattttataaaaggatatactttttcacaggcccacgaattgttctcctcccctagatcctgtgaataatatttcaaactctgcctcgtatataaatatacacacgcccccctccactaaggtgatatatccccggagctctgaatgcggttattgcccagtgtaaccaccagattgtctgtgggaaatgggtcgtctgatatcaatgtgccacaccagaagaattgtcatcacacattcgcgagtaccacttcggtggagaaattctaatccccaaatgcatgacgccccctgacagggcggcagcaaataaccagtcctctatagagtgattaaaatatggggactctttttgcgaccntttaatcttcgaaagcgagaaattggccaccaataagtactttacaaaatttgggggcccaaattccaataaatgttttccccccccaaaga

SEQ ID NO: 651838 - DNA, 425 bp, Homo sapiens
gggattagcagtcgcgagaagtatagctttctcctgcactgaactctttaggggatgaaattcccagcccactgctgccatcacgcgagtcagtctggcttatgagcttgagttgactgctggaagaagacgctattgtactgcaatgtataaactttggaggatgaaggacaagaaacttataacgctgacaactctaagctctcactgctcctcgagaagacttccttgtagacccgtgccaactgtctttagatgcacatgtggatataggcttggtatcatctgctgctggtctgactggggctctgacacctgagccttctccaacagacagagatgctacagaccctgatgcatacactcttaattttttgaaagcagtctgtatactctccttctttccatccctggcttcggatttc

SEQ ID NO: 651839 - DNA, 252 bp, Homo sapiens
agtcatcaagatatgcgatcatggtgcaggcttccttgtggtcaactggagactgacttggatcaggtgcattgacgtcttgtgtgttagttgccgttgagacggtcttgcctgtcgccagcggatgcatggtcgatcttggtcatagaactccacctccaggttcagcaatctcttgcccagcctcccgagtagctgggattacaggtgcatgccaccatggctaggtaattattgtatttttagtagaga

SEQ ID NO: 651840 - DNA, 1240 bp, Homo sapiens
ttggcgcgcgcccggggcggtggcgctggaggagctcgagacggagcctagttatgtctgggaggcgaacgcggtccggaggagtccgctcagcgctccgggccaagggccccatctcctactaagcctctgcggaggtcccagacggaaatcagtgctctgaactccactgagcatccatccctgtaaatctggccgaagacacccagtgcggctgcagtcagaaagcccatcgtcttaaagaggatcgtggcccatgctgtagaggtcccagtgtgtccaatcgacctcgctaggagccctaggatttcactttcttcttgcgcagaaagaaaacggagtcccgccatggccacgtggcagcattacgtacaggagggacgcatttatgcgaagacacagcaggcgtccctgaacagcccacacagcactcctgtgccgaaccctgaggccgagtccagctccaaggaaggagagctggacgccagagacttggaaatgtctaagaccagtcaggcgttcctacagcgcggctggagaccctgggctctgcatctatcgtccacccaggccgccaggtcctgcatttggcattcgaggtggctgctgggggcagaagacttgtacggagtctcgccagtggtgtgctccaaactcaccgaggtcccccaggatacgtgcaaatgcctgcgacccagaagtgactctccctggaaatctcgccagcaaccgaggaaacagaacacgtagagaacgaagaacaatgcaagcacatcttggagaaccggagctgcgctgagtgggcctggggccatgaactggcgagttagaagctgctgagcaagttggagatgtccagggctgacctgagaggcagaaggggagagaggcaccatggacaagcatcgcaccagacaggccacggaaacataagcaacctaccacatgagggagaaggacacataccgcgaccacctcacgacgggctacgcacatagaaaaaaagagcaagcgaagacactagcagaccatgccaccccaggaagagcataccggccgacacggccacgcaaactaggtgaaaacaaaacagagacagaagggacgcaccacaaacggaggcacaagcacagacgaacacgccaacgaaagaacacagaagagaaatgcgaagatcgattgcacaaacaggcgagcaacaatggcacgcaaaaagtagcgggtgaaagcagaacgaccg

SEQ ID NO: 651841 - DNA, 471 bp, Homo sapiens
atatccttcttgagtatataaaccaaaaagcatccaagacaggtttcaatcagtttagaagtttattttgccaaggttaaggatgttcctgggagacaggtctgtgcctttctctaaagatggttttgaggtcttcagtatttaaaggggaaacgcaggctggagaggaaagatggaggggatgatcacattattgaatccatatgttacaagagaaaaggagcaagtaggggaacagtcaattatgtatttgtcttgtgctcagtaaagtggccctttatataatagaaggtgaacattacagtagctacctgtagaggtatttaaccctttatctgtagctatctgcttaggaacaaaaggagagacagcttcttgcatgactcagctttcagctaaattatttccttttggcatagtgatttggggtcttgagttttaattttcctttcacaagtaccttaccagaaa

SEQ ID NO: 651842 - DNA, 874 bp, Homo sapiens
  misc_feature (502)..(502): n is a, c, g, or t
  misc_feature (707)..(707): n is a, c, g, or t
agcggctcttgaggtgacgtggcgggcggagaacctgtagtgactctagggcaggcgcatctttcgcgtcacgatctcaccacctgtgatgttaccaaggttgacgccacttctcacacgagagttctcgaggcagagcaagccacaagttaccataggtagcaatcgggcggtgtaactcatgggaaatcctgaggcggtcaaaggcgtattgctggagttcatactgtcagagttcacacaatgatgcgtagcaaacgacaatatttagagatcaaggctggcgatactgcattacatgcatacagatgttatagagacttttgactgacaccgagagttgccgctcgagtgcatgacatcgtgataggatccttgttcgggagcagctagcacctgtacgacgtttcctagcggacagttccaagggtagccaaagggtacacttcatgattatactcagaccactggtatctctattggtctgagctgataccgtggntccaacgcattgagttctttcgaatgcggcgtagcctagtgacgtgaaatcggttggcacgcgacgtgagtcggagtgctaggacctctgtcgtagattgactacggctggctaattagacactcttatggctcctgccagactcctcccaggaacattcgtgcaaagcagcgcatgggacgtagcctactaggaccgatgcatngagagactctgatagcaatagtttgtcgatgaactaacagaacatgacccattgatttaggtcgtcacacgacatagttcaaggcttaccaggaatccaagtacgagacaggatgcctttgtcattttggtccaagggtaagcagtcaggcaggagggagactccca

SEQ ID NO: 651843 - DNA, 374 bp, Homo sapiens
ggaaaaccgattttatcttgtgatgggggaaacccctgtgagctcttatcactgaagagacatgctatgggcgacgagagcgaggaagacgagcgcgacggttcacgtggatcacgccttccgggaagagctgatgaccgtgctgcaggctgggaaggcgctgggtggagaggacagtgagaacgaggaggagcccttgttgtggtgggatgaggccatgatggccctggaccagagcctcgccagcctctttgccgagcggaagctgcgtatccaggcccggcgagacgagaagaacaagctgcagaaggagaaggctctgcggcgcgacttccagatccgggtgctggacctggtggaggtgctagtgaccc

SEQ ID NO: 651844 - DNA, 901 bp, Homo sapiens
gtgcagtggcagccctgggggccctattcccttctggagtgaagcacaagcctcagtgaagggggaagcagttgatgctgtgagtgtgccaaagcccgggacctctacttgaacagttctactgtggtgagtgctggagaactaagtgaaacacctgtacaatatggttgtacctgctgccctgactccctgcttagcacacccttatgtgcagtgctgccccttccacccttttcccctgatgacctgtctgctcctgcattgtgatgtgtgtgtgcatggtgtccaagcccctgacttgtgaatctggttgtgttgttgcaccccttgaattgtggattttggtgagaattgtgtgctactcctgtaagatggctttttattctttgctttgtgcttaggctttgtcgatgaactggtggttcctctttccctcttgttgtcccgttcttgtgtgtgacctcgttgttttcccgcatttctttggcttgcttgttgttccgcctcagcacagtggttgccttttggccagtgtcgactatccttactgttttgtttacagagttgcccctattgtaagttctacgcgctttttgcctattagtggatgagcacccacggttgtgcggtttgctttgacttccccatttgcccttggatatttatctctttacacatttgcacaaaatgtcccttggaagtacaaagtttgttctttcaactacttccccagatccccattacttttgcccagtagtttatttgggagcccgcgttcaattaattgcatatatgtggttggtgcgttcaaatgtgacctgtcggttaagccccgtttggccatggaagccactgtgggtgtatgaacttggggatcgaactcgtatctttgggaagggag

SEQ ID NO: 651845 - DNA, 194 bp, Homo sapiens
ctgacttctctgtccattgatctatatgtctatgcggtacatactgtattgattaccattggtttgtagtaaatattgaaatcaggaagcataagagtcctctccttcttcttcttttaattaatataattttttggaaaacaacccttggcctggaccccagggaaaaggaaagggaattaaatgaaggccaa

SEQ ID NO: 651846 - DNA, 490 bp, Homo sapiens
gcacgtttaaagtaatacattgacctacaatatttacataacttttatgttagaaaaagatcttgtaaccaaatgagaagccttaaagaagctgaatgcacgggcttagcaataacaaccacaatcactggaggagcatggctggccggcgggaacagaacctggatgacaccctccatcatgctcactatctagttgacgactgcaatgactttatgtgtgcgctcagtagggctgatgtcaggtctgtactggtgggacaatacataccggcatgccatatataatacatatgtaggggacaacttagagtggactgtaagagctattagtataatctatactggcagacaaaaatgaatcttcagaactttccctgaattccatgctgtgcaggtagtatcacgatccggcccagaagcatcctgtgtacaaaaacaacgaagctgaccatcacttaaaatacggtcacatggctaccaatatcact

SEQ ID NO: 651847 - DNA, 158 bp, Homo sapiens
cgagttcataggggtatcttgagtgatagctggtagagtgattcctacgaattataggtgatgctgcctgacttaaaatgtcgtatctctatggaccttagaagaatacattctggaatctggcatatgcacaaagaaatgtccatatcagtacatag

SEQ ID NO: 651848 - DNA, 427 bp, Homo sapiens
  misc_feature (93)..(93): n is a, c, g, or t
ggggggggggtggtctccccccggggggggaaaggcccccctcttttgggaagggcggcccccccagggggtttgggggtctttccaatgttntgggcggtgtgggggggggggcccctctttctttttcccgggggggggggtccaaatgtggttttccccgcgccgggaccaccataatttttgtgggggggggggccccccccccccgggtccccccccccgggggggggggggtttttttaggggggtttaagggggggggcccccccccccccctctcttggggggggggggggggggggggggttttttttttttcccccccccgggtgggggggggggcccccggggggggccctttttttttttccccccccccccctggggggggcccccccccctttgggttttttttttgggggga

SEQ ID NO: 651849 - DNA, 481 bp, Homo sapiens
cagtatgtacctgggtgttaaacggactccagtgatgaacggagtagcaggactaaatctgagtgccgtctcctgaacaggaagccgtgtaaaaacgtgtgccgagcatatcataagcagatgggcactgacaagttgagtcatcttaatagtgattctgttactttgactgagttctatttaattgctgctctacgtattacttggctcagggcaatattaacgttgaggttatgggtcactgcttttaatctccagcccacagaactaccattaaccagaaataagacaagcagcggctattgggtccgttttagtcttgaatatataataacgtgccttgggctttacaaactgctatgtagagttagcagttattaagatgaaaatcactagacagctcattggaataagggcttctccaaagaactctgtagggttatatctattgttactatttcatttaattaagatatactgt

SEQ ID NO: 651850 - DNA, 301 bp, Homo sapiens
gctcgacccagatatacggctatacatcctacaatgcacaggacaacattatccagccagaatgtcaatcgtgttgtgtttaaaatcctgctttttggtgctagggattaggggaaagtacatattagatgaggtctagaagttaggaggtattgtggagtccagagttggcctgcctaatcattcttgaattctcccgttccccaaaaggagacaaaatcccagaatgaagatcaccagctcagtcatttcatcttgctgcttcaaacacacttttttttttttttttttttctgagacg

SEQ ID NO: 651851 - DNA, 222 bp, Homo sapiens
ctaatctggcattttgctattaacaaaaacttgatggaaacattttggatttaaatttgctttggtaaatcaaatcctatttttatattaaattgtatcatggtatttttaaaacgcttcatcttaatttctgcgtgatcttttgttggttctgtgttactattttaattttcactgctgtaaatatgtgttcgcagattattaaatatgtgttaaacatga

SEQ ID NO: 651852 - DNA, 271 bp, Homo sapiens
  misc_feature (140)..(140): n is a, c, g, or t
  misc_feature (178)..(178): n is a, c, g, or t
attgagctcaggagtttgaaaccagtctggacaacatagggagaccccatctctaccggaggaaaaaaaaaagagtcaggcctggtggtgtgcgcctgtggtcccggctactcgggaggctgaggcaggacgattgcttnagcttgggaaatcaaggttgcagtgagctatgattgtntggccacactccatcctgggtcacagagtgagaccttgtctcaaaaaagtaacataaggtaaaaagaagccttgctttagcacaggtatgaag

SEQ ID NO: 651853 - DNA, 508 bp, Homo sapiens
gtataagtcattaatttaaaaaggggggagtaaaggcttttatgcggccattcctataaactaggacttgaacatcaagggaaaaatagacaaagactaaataataaagtcattcaaaagcacagaagcacatcacatacaccagcaaggtttccaactacggcacggattaactaaaatactctcaaatagctttcaatagctcgtcctaaaaaaaaaattaaatttcctttttcttacaagtcccaggcttaaccaagggcaaaaattcctgtgcaacaacggatacactcataagtggcacatagtgctccagggctctttattagataccaataatggctagcacttggtcacggccatcaaattttctaatagtctaagagtcaggtaaataaaagttcataaggaatttaaagaaaattatttttcccattcttagatcagttccatagaaaactattaattttttaaaagtaggcagtaaaagggggtggggggggggtgg

SEQ ID NO: 651854 - DNA, 290 bp, Homo sapiens
tcctaggcctgtaccagtggcgtgtgagtttgagagtcttttagagaggggctgcaaagaagaaggtcgtccacatattgaatgatgactgggagacaggtttaaggaagtgaggtttcgggctagagcttgtccaaagaaatgagggctatccctgaagccctgagggaggacggtccatgtgagttgttgtgactggagggtgtcagggtcagtccaggtgaaagcaaataggtttggggaatcagggtgtagggaaatagtaaagaaggcatccttcaggtcaattg

SEQ ID NO: 651855 - DNA, 113 bp, Homo sapiens
tgtgacggaagcgtctccgttgggtccggccgctctgcgtacctctgaggaaaagcttgcaccagtgtgacgcggatctgtcaacatgggtaccggagaccccaacaatgccg

SEQ ID NO: 651856 - DNA, 801 bp, Homo sapiens
ggccgggctgacaggagcgtggctgtctcctactctccgaccatggacgtgtgctcgcccactgatatcggtgtactccgaaagagggggagtcgatctaggcaacaaatgtcactattagcctgctgtattcaaggctcctattcgaccagatcattgtgaacatttgttcacaccaacttgctgctaaaaacaacagacagccctatgctgtcagtgaattacgcaggtcatcagactagtgctgagtctatgggcgtactggcagcagcgtagtggctcgaattcccagagttcgaggtggtgcgactcaccgtgtctggccagggtgctttacggaaacatgtgtcgtggaggccgcatgtttgcaccaatccaaaacctggccgccgtctcgcgcatcgtagcacgtgaacacaagccaaaaacgatacgccatctgtactggcctgactagcctcaggccctatccagcactaggtcatgtctacaaggtcatcggtattgcaggaagtccctgaactatcctttggtatgttgaatgatcacaggttgcacacggctacaagcaacgaccaaggcaagctagtctatgcctccttacacaaacttacaagcctggaactgatatcacaaaacggtctactgcccttctcatgcgaactgacacaccctgggcaaacgcgccaacaccatcgagaaaaccggaacgccgtaatccaagcgccaggggccccgtggcattaattctcataatgacggataaatggtactcactccaaggactataaaaaacatacc

SEQ ID NO: 651857 - DNA, 355 bp, Homo sapiens
gtgttaccgtctgagcagctgggaacaagagccccccagctggaccaccctatatccttctcacctccagatacccacctcctggagagaagtgttccagtgccccaggcaatgcgatggtaggtcccctacaaaggtgcagcatgagggaggctagggaaagtttggggcatggagaagagaagggtgaatggaatggagacccattgctctacagtcccactcctggcacaggtccaagccccctatagtgtcacagtctcaccactgcccaatctcaattccgcacccacctacacctgcatgctcagatgagaacccagacccacccttaccccttcccagcttgctcaga

SEQ ID NO: 651858 - DNA, 109 bp, Homo sapiens
gggctgggtcggagtggtaaaaggctcagaaaaatctggaaaatcgggatatggatcgtgagcttggacaggtggtgtgtggtggcctagccatgtgatttcacttcca

SEQ ID NO: 651859 - DNA, 385 bp, Homo sapiens
ttgtcccctataggttccgcgaaaagtcgcccgtgtgcataatttgtctccaaaaagggtataatgtgatttgtcacattttccatctctctcttcagcaccccatgttttcgcaaatccggtcctctcatcccctattttcacgtgctctccaattgcaccctgctgaagattctgaccaaggccactccacccagagcctttgaaatttccttctcccaatcctttaaccctatgacgcaccctcactctgtgtgtcgcatctcgccgaacacacccctgtggatatgaccgagtctagagagaaagagcagggatatagaggtccccctcctctgtgtgaaaaacgcgctcgtgccgtctcgcacagcccgggggacccact

SEQ ID NO: 651860 - DNA, 389 bp, Homo sapiens
attggcggccgcgtcgacccaggatctgtgatacgtgttaaaggctttttaatatcatacactgcaacaggatctggaatatgtggtaaaggctttttaatatcatacactgtaccaggatctgtgatatgtgttaaaggctttttaatatcatacactgtaccaggatctgtgatacgtgttaaaggctttttaatatcatacactgtaccaggatctgtgatatgtgttaaacgctttttaatatcatatactgtaccaggatctgtgatacgtgttaaacgctttttaatatcatacactgcacaattcttaaaatgcaaaaggaaaacaagagttctgaaaaaggagtcgacgcggccgcgaatttagtagtagtaggcggccgc

SEQ ID NO: 651861 - DNA, 329 bp, Homo sapiens
gatccctgaatgcagcctgctgaggaagacagtggtgaatcttcacacaatatccagttttagtccaaacccgagcctctctcctgtggtctgccttcccggcccatccaggtgggtgttttcatctgtaccgtacccaaatctctacttcttatgtacggagacaggacacacctgattttatatgtttgctcagagctcaagagggcagggctctgttgccagtccctgccttccacccacaacccacgcctctaattgtcttaggatttaacactgagccacacactgactatctccaggatgcagtgggccttcgcctcagcagg

SEQ ID NO: 651862 - DNA, 283 bp, Homo sapiens
aaagttgagaactagtaagtgtacacattgttgtactgaagcacttgttcgatactcgttgatcatcaaacaacctgtgtgtaatatgtttttccaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 651863 - DNA, 1057 bp, Homo sapiens
aaaaaactacgagctaaggtacgaggcctgcgtgttaatagatatctcccagcgaagttcacttctccggaactctgccttttcccagaaggaggaggggaaaaatgaccaagttccagcgaggcagtgacattcaacggattggatgtgaacctacactgaggaggacactgagctgctggatctaaccagagagtaagctgtacacgagagtgtgatgctggagaactttagagaaccatggcatcagtgggacactcaagatcacatgtaaagacacagcactatgcatatcccacgattgagagacgggaagaacaggcattaagagaatgaaacgacgctctcacaacacaccaaaggaggatacagcactacagaagaacgtgcaatagagataagcgttgtcaatagactggacgaaaccactaacacagtgcagagaaacccaatgagcagaaaaacaccacatgaatgacacatgacactgcacatgatctctgcccaagcacaggaaccagcatcatcgtgcaaatgatcgaccacggcgatctgaagcaaaacatgcaaacaacataacaatataagagagaacagtggagacaactagccaacacaactatagaaaacacaggcaaaaatgaaaacaatacaagaccaactacgcaatacaatacagaaataatcaacgacaacacaaattacaccatgacacataatacatgccacagacaagagcctagacacaatataaacacccaacaaccacaacacaacaatgacaaaacaaatgaaagccagaatctaaaagaaccaaaataactattaactgcgaggagacaacatataacacacaatgataacaccaaacaaacaagacattacaaatatgaccaccaattgtcacacctgaaccatcacgaaccagcatacacacaatcatacggaataacagcaaaaaaaatacacaaaccttagactccacaccatcacacacacacacataacaaagaccataaccgacagaccttacaaaacagacaacacagaaacataa

SEQ ID NO: 651864 - DNA, 417 bp, Homo sapiens
gacctcgtaatcagaagttcaatagcagagtaaaagtattcacatctttatgtccagaaagtcagtgagtctataaatcgagagtgattagagtaatactttttcacatttccaaagttggcatgttaactttaaatgcgtacaatcttagagtggtaggcaaggttttacactatggaccttatatagggaagggagggggtgcctgtgtggtattgtagactgttcacttggcagaggcatttcatccttcatgaagccattcaggattttgaatggcatatgagtgcttggctcttccttctgttctaacttcacagagaatgcagttgtcttgacttcaggtctgtctgtactgtgggcaagtaaatgcagtactgttctgatcccgctgctattgaaacttctaaaactagg

SEQ ID NO: 651865 - DNA, 342 bp, Homo sapiens
gtttcttggagctttcacacacttaaaaccatgaaacatctattattgctactattgtgtgtgtttctagataagtcccaaggtgtcaacgacacatgaggagggtttcttcagagcccgtggtcattgaccccttgacaagaagagagaagaggcttccagactgagggctggcccaccgcccataagaggaggtggctattgggctctttcagccaaagcaggtgtcactcgaaagtggaaaggtgtgctacacgatgtcagatgcaagaagctttgctacaacaggaaaggccaatcacaaatagtgttgatgagtttaacaatgtgggctgttttccg

SEQ ID NO: 651866 - DNA, 428 bp, Homo sapiens
cccgggttcacgccattctcctgcctcagcctcccaggtggctgggactgcgggtcctgccaccatgcccagctaatttttttgtatttttttggtggagatggggtttcgccgtgttggccaggatggtctcgatctcctgacctcgtgatccacccgccttggcctcccaaagtgctgggattacaggcgtgaaccaccgcgcctggctgagttcaaaaccattatgagcagcagaggaggacctcatctctatcaagaacttaaaaaaaaaaaaaattagctgggtgtggggtcttggccctgtaagtcccagctactgaggaggtcaagcaggagaatcacctgagtccaggagttcaaggttgcagtgagctgtaatcccaccactgcactccatcctggcaacaaagcaagaccctgtctcg

SEQ ID NO: 651867 - DNA, 700 bp, Homo sapiens
  misc_feature (205)..(205): n is a, c, g, or t
  misc_feature (356)..(356): n is a, c, g, or t
  misc_feature (442)..(442): n is a, c, g, or t
gtcggcacgaggtcgtctcgaaggaaaaaaaaaaaaaagaaaagaaaaaatgatgtcgatgatgatagcaaatatgtagtgttcctgtgtcaagtttgggggtgtataactcttaatcttcacaataatcttataagatactattattatccccttttacaaacgaggacactgattgcacaaagaattgtgagaaattttaccncaaggtttactttagccagttaaggtgaggggagttcaagaatttaggattcaaattctagaatgttttgggtttcagagcacttggcccaatccgtgcctttcttaaagttaagaacaaatgtgggtgtctcagaaccaagtgtggcccnacaattttctctctagaaatcttattaatctcgaagaggggcccacaaagaagaaaaaagacacgagacagtgtgtgtagaactcnctgtagcctgtgaagaggggtctttaaggggggcaaagggttcccctgggaaagccacaccctgtgctctcttctcaggagggccaccacattcacctgtggccctcccatcccttttcgtgggaactcttgggaagccccatttcttccgcaacaacaggtgggccgaggccatcttcccgtgaacggttcattcgagaaaggctccagaatgtggccgtggcccaatataagcgttactccggtggggggactctt

SEQ ID NO: 651868 - DNA, 194 bp, Homo sapiens
cgatctagaggaccccacgccgacgcgatcaaagtggtcagtccaagaatgtacacttgatgaatcgtacgttacccgcgactggtatatgcgtcaaagtggctcgtatcaaagcaactactccccgcactgtggtatcagttccagatatcatcgcaggttttggtcctgagacagcaggaagatcaccaagc

SEQ ID NO: 651869 - DNA, 106 bp, Homo sapiens
agattggaggagttacgcgcgagagcctttgcccatgtgcgaattcgtctgatgaactgtgtgggtgacgccttttacgatggggttacaatttgtgtgtgtgtga

SEQ ID NO: 651870 - DNA, 110 bp, Homo sapiens
ggagctcggtaccacgagttcggagttccagacacacaactcgagctttggccccactctccatgatgaaccgcagcacaccatagcaggccctcctcccaaacaccccc

SEQ ID NO: 651871 - DNA, 738 bp, Homo sapiens
gagcctgcgcatgctcgagcccggtattgtgccctccagaatagatgtgccccaaccccgaggaccctgctggaatgcgctgtgagcagcggatatgagcgggtatccatgttggctgcagaccattgtcaatgagccacgtgggacccagctgtgaaagctcgtaatgcacgagctgcatctgtcgagcaatacccaagatgtccattctgagtcccacaaggcgttgggctgaacctgtggcatgtacgctgaatatggcctgtgcccccatggcttccccgccaattccatgggccttggatgggcaccaatggccacccatgcagacgtcttggatgggctgtccatggacgacttgccattgaaagcttggtcaaaccatggactgtgcccacaatggactgaatgcgtacttgaactatcacgatgccccttgttgtggacccgcatatggctcatggccactatagagcttccataataccttcatactacacttgccccaggtctgtcgacatcatggtgcataccctcgtccaccattgtgcctctcaatgccaaccattcacccaatatcccgacgcatgtaggctttgcagttaccttaacacgccctcacgataacatgttctttgcaggactgaacctagcgcgccaatcacagaggacatgaaccattgattcgttgctcaggatactccgttgcgacaagcccgctactggtggccctcctgg

SEQ ID NO: 651872 - DNA, 420 bp, Homo sapiens
agtggcatacattaggtctttttcttttctttttttctgtgactcatacggagctgttagaagtgacttcatataatattatacagtgtaataaaatgggttttcgatgtgtgaggataccctcatgttatttagattatggacacaattaacaattccagacagaattattttctcatgtttgaagtagtataggcacatggccctttatgggaggggggaagctcttctctgtgtgcccacttttcacatccctctccagcatgactctcccctttctgtcagtcttaccccaggagtccctggcctccttcctctccttgacactgtttgctttgcaagcatatgaaatactggcaccctatgaccagggtagactacaaccagggttggggtgcaggagccatggagtaaatggca

SEQ ID NO: 651873 - DNA, 267 bp, Homo sapiens
cactaatcattagagaaatgcaaatcaaaactaaaatgagataccatctcacaccagtcagaatgaatattattaagaagtcaaaaaaataacagatgctggcaaggttgtgaagaaaagggaacacttatactgctgatgggagcaagatgcgcatcttcgtcccatcagcggatttctatacattgacctctggtgggttataaaaacagcagtaacgacgtgtcagacaatgacgctggtttgatgggactgatgggagcaaga

SEQ ID NO: 651874 - DNA, 160 bp, Homo sapiens
atctcgccaagtgtcaatcactgttgtgtggattatttatttgttttaaattagtcaccatggaaaacactccttgcattcttagtgttcaccctgttgactcatccaactgggctcatgtggcccattgactgaaacggatacactgggtacctgagct

SEQ ID NO: 651875 - DNA, 100 bp, Homo sapiens
tccaatgctctcacagaggggcgggagccaaggtggtgaggtaaggagtgaagatacaggagagtggtggaataggaggcagcgaggaactgctgggagg

SEQ ID NO: 651876 - DNA, 199 bp, Homo sapiens
  misc_feature (45)..(45): n is a, c, g, or t
  misc_feature (128)..(128): n is a, c, g, or t
  misc_feature (157)..(157): n is a, c, g, or t
  misc_feature (185)..(185): n is a, c, g, or t
gggtgtgcaccagtctgctcagccctctggaggaaccagagagcnccttcttgacgtgtccttactagcagggcgccgtgctgtccccaccagtagagcaggcagcctctttcttccctggcattganacccagccagttgggccggcatcagctgngtggggtgtggagtgtgtgtgtatgaangcgtgtggtggccc

SEQ ID NO: 651877 - DNA, 213 bp, Homo sapiens
cccccccttttttttaaagaaaaagggtaatgggttttaaaacgggggtttttttccctaaagcaattttttttttttcggtttaaagaaggattggcagccgaagcccgtttgccaaaaaaaaagggccgatttttttgaaagggggggggcccgtttttaaacccacccccggccccctttaaaaaacaataaaacatttttttcccccca

SEQ ID NO: 651878 - DNA, 387 bp, Homo sapiens
  misc_feature (53)..(53): n is a, c, g, or t
  misc_feature (152)..(152): n is a, c, g, or t
  misc_feature (197)..(197): n is a, c, g, or t
  misc_feature (215)..(216): n is a, c, g, or t
  misc_feature (222)..(223): n is a, c, g, or t
  misc_feature (227)..(228): n is a, c, g, or t
  misc_feature (241)..(241): n is a, c, g, or t
  misc_feature (248)..(249): n is a, c, g, or t
  misc_feature (251)..(251): n is a, c, g, or t
  misc_feature (257)..(257): n is a, c, g, or t
  misc_feature (260)..(262): n is a, c, g, or t
  misc_feature (282)..(282): n is a, c, g, or t
  misc_feature (353)..(353): n is a, c, g, or t
ccgagctcgggtcacggggcgcccccgccgccctcctcgtcgtcctccacgtngaggcccgggatgccgcggatctggcgctgcagcgccctcccagcaagggcacggcgccctcctcctcctcctctgggggcggcggcggtggcggcganacggccccgggggctggctctgggggcacgggaggctgcgccggncacgccctctgcgccctnngagatnnctgnngcttcgcaatgcnaaaaatnntnaagggnaannnaataagaataataatgctcnttctcctcctcggggctgttggtgaaagggttctagaaaattaaggtagagataaagatttttgatgtttngtttgttgttgagaataatgtttgaaaaaatgag

SEQ ID NO: 651879 - DNA, 861 bp, Homo sapiens
  misc_feature (661)..(661): n is a, c, g, or t
tcttgggtgcgtccccgggtttcacaaacaagtgtttggccaaccattttttgatgtaattaagcaagagggattctgggggaatttgcccgctgtcctgtttggcttgtggcgaccatataatcctggggggctaccaatgggtctattttagagcttctgtccgcttccctcccaattgcaaatgtgcaccccacgatggaggacacgcctgtgagtactaggtctcttgttcgacctcctcattgcaccgtccccggcttcgagactggttgtcttgtgcttgggacatgggccttcctatactgtggtttctcccaagtcaggagctgacccggggagccaccactaaaggtgctggtcaatagcatcaataaacccaaccatatcacatcatctgggacaattcttaagaaaaccattgtatgaaatccatttccagccagtagtactttgtattgtgttgagcagatttcaccagagctctttgacaataacagcgatcttagtctttaccaataaggaaaacagctccagtttgggaagtatccagagatgggatatcaaacacccagatcctctggtcaccagattgtatgtgcaactgcaactaatcaggccaggaaaaaagccccagcccactgtgctcaccagattgttnttttgtatattgggagccgaaatccctgaaaccaattggggtcccttcccagtctccatcattaccaaatggccattttggctgggtcggtggttcaagcctataatccccgtgctttacaaggctgaggcaggaggcttttttgagaaataggagttcaagaccaacctgggcaacatagccagatcctgtttttccca

SEQ ID NO: 651880 - DNA, 201 bp, Homo sapiens
acgcacagagtaagagaatgcttgggaacgcacaggagagagaacgcagctgaacacacggtggtggctgaggaagaacgtcgggagatcacacagggaggagaacgccaggtgaacgcacaagagaaaacgcctggtgaacggcgcaagaaagtagatagccaggttaacgcacagggagaacgccgcgggaacacacag

SEQ ID NO: 651881 - DNA, 94 bp, Homo sapiens
atcgccagacgcccacgagtgtcgtagttcggcaagtcatcactagcaagctcttctccataagcacacaatgtagaagagcttggggtatgtt

SEQ ID NO: 651882 - DNA, 883 bp, Homo sapiens
  misc_feature (27)..(27): n is a, c, g, or t
  misc_feature (74)..(74): n is a, c, g, or t
  misc_feature (88)..(88): n is a, c, g, or t
  misc_feature (120)..(120): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (219)..(219): n is a, c, g, or t
  misc_feature (233)..(233): n is a, c, g, or t
  misc_feature (235)..(236): n is a, c, g, or t
  misc_feature (352)..(352): n is a, c, g, or t
  misc_feature (357)..(357): n is a, c, g, or t
  misc_feature (359)..(359): n is a, c, g, or t
  misc_feature (411)..(412): n is a, c, g, or t
  misc_feature (438)..(438): n is a, c, g, or t
  misc_feature (782)..(782): n is a, c, g, or t
  misc_feature (820)..(820): n is a, c, g, or t
ccccgcacccccaatgctcttttgctncctaagccccctatgccctggaggtgagggcagctctcttgtctctnccctgcctcctccnttttccctccccacattttgtataaaaccttnaatttcttttttttaaaaatggtgggggtgggtgggtgccgagggataggggatattccgtgtntntgnggntttctaagctctgggaaaagtggtggnagggggagggaggngnnagttaagggggtcacctccattctggggaatttatatttgaattgaggctttggccttaacacccaggaacttttctattacaatcgcttaggaagtaaagccttgtctccctccntgttntntgcctcttgtacccctctgacccacccgctctgccccactcccagccctccnnagccccagccctgcctgccctgcccntccagggggccatgagtgcctaggtttctcataccccacaaggtcacagcaggggagggagggacaattttataatgaaccaaaaattccatgtgttggggggtggggggaggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaanccttattctgtattggggactgagggtggggggagtanaggggcccctggagaatgtattcaaaacaataaaactttggacctttggatgcagtgaaaaaa

SEQ ID NO: 651883 - DNA, 419 bp, Homo sapiens
atcttagaccgtgaagtaggcaaccataagctacacaaacaagtggctattgtagcagcaggtaacttggaaactgacaatgccattgtaaataccatgtcatcagctttaattagccgttttgcacactttgaagttaaactcaaaaacgatgaatggttagactgggcagcatctgttggtattgacttccgtatcacttcatttcttggcttcaaaccagacctactctacaccttcaatcctgatgcaactggcccgtatgcagcaccccgtacttgggatatgcttagtcgtgttgtcaatggcaaccctattgacagtgatgatattccattattggcttcaatggttggtgaaggtgttgctcgtgagttcatcacttacaccaaactctataaagagttacctgtcgacgc

SEQ ID NO: 651884 - DNA, 770 bp, Homo sapiens
  misc_feature (2)..(2): n is a, c, g, or t
  misc_feature (8)..(8): n is a, c, g, or t
  misc_feature (30)..(30): n is a, c, g, or t
  misc_feature (62)..(62): n is a, c, g, or t
  misc_feature (65)..(65): n is a, c, g, or t
  misc_feature (73)..(73): n is a, c, g, or t
  misc_feature (76)..(76): n is a, c, g, or t
  misc_feature (79)..(79): n is a, c, g, or t
  misc_feature (106)..(106): n is a, c, g, or t
  misc_feature (120)..(120): n is a, c, g, or t
  misc_feature (122)..(123): n is a, c, g, or t
  misc_feature (239)..(239): n is a, c, g, or t
  misc_feature (244)..(244): n is a, c, g, or t
  misc_feature (246)..(246): n is a, c, g, or t
  misc_feature (298)..(299): n is a, c, g, or t
  misc_feature (325)..(325): n is a, c, g, or t
  misc_feature (669)..(669): n is a, c, g, or t
  misc_feature (707)..(707): n is a, c, g, or t
anaaaaantgggtgggggggtggggtgggntgcccccaggggcttatgggggcctatttccnctntcctcttntgnggntttctaagctctgggaaaagtggtggnagggggagggaggngnnagttaagggggtcacctccattctggggaatttatatttgaattgaggctttggccttaacacccaggaacttttctattacaatcgcttaggaagtaaagccttgtctccctccntgttntntgcctcttgtacccctctgacccacccgctctgccccactcccagccctccnnagccccagccctgcctgccctgcccntccagggggccatgagtgcctaggtttctcataccccacaaggtcacagcaggggagggagggacaattttataatgaaccaaaaattccatgtgttggggggtggggggaggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaanccttattctgtattggggactgagggtggggggagtanaggggcccctggagaatgtattcaaaacaataaaactttggacctttggatgcagtgaaaaaa

SEQ ID NO: 651885 - DNA, 380 bp, Homo sapiens
  misc_feature (102)..(102): n is a, c, g, or t
  misc_feature (114)..(115): n is a, c, g, or t
  misc_feature (118)..(118): n is a, c, g, or t
  misc_feature (146)..(146): n is a, c, g, or t
  misc_feature (168)..(169): n is a, c, g, or t
  misc_feature (171)..(171): n is a, c, g, or t
gggcccgcctaacgacccggaaacgggaacccaagcgtttaatgaagacaatctcaaattcatccctcatggactgcatggagggcccgtgtagccaatcanccccgatttggnntgncctttctgctgtgttatgtattccaagnagaccgtgtggctttggaatgnngnttagccaaggcccaggctttggtgcagtacctggaggagcccctcacccaagtggcggcatcttaacggcattggtggaagctggggtcagaaaagagaaatgaccatttggagggcggggcctcctagaagaaccttcttagacaatggggggaggatgggactttgttttttccaagaataaacttcaactcctgtcaaaaaaaaaa

SEQ ID NO: 651886 - DNA, 371 bp, Homo sapiens
cgaagccatggcttttgaaatttccaatgggagccatgagttactgtctcagggacagaagcagatttttattcagacttccgatgggcttatcttgtcccctccaggtacaatagtgtctcaggaggaggatattgtcacagtgactgatgcagaggggcgtgctgccggatggccccgctaaagggattcctcttaaaagttttgaagccgcccccccccgtgggccaaggcccctcacattgaagtggagccgaaccctagatccgcctgtttttacccagagaaggtctatggcaagcaatgtatatttttctaatgtcaatattgcacagatgaaccttttatttataaagaataatgtctttctg

SEQ ID NO: 651887 - DNA, 269 bp, Homo sapiens
  misc_feature (260)..(260): n is a, c, g, or t
  misc_feature (262)..(262): n is a, c, g, or t
ggcaggtggatcatttgaggtcaggagttcgagaccagcctggctaacatggtgaaagcttgtctctactaatacaattagccaggtggtagtgagaggtgacaacgggctagcagccctcgctcgctctcagcacctccttggcctcagcgtctgctcttgccatgcttgaggggcccttcagccagccgctgcactgtgggcccctctctgggctggccgagggggagctggctccctctgcttgcggggagctgtgnanagagggc

SEQ ID NO: 651888 - DNA, 155 bp, Homo sapiens
tagcgcggtgcgcctttgccttcggcggtggccggcacagccggagccccttggcaatacgggcacagagcacgcttccgaagcttgggagtagagccaggtacgcacgtcgatcgagcttgcggctgacaccctttgcgaaccgggctgtgtag

SEQ ID NO: 651889 - DNA, 484 bp, Homo sapiens
aggtgttctgatagaaatgtttggaagttagtgtagattttgacaatgtataggcaggggtaccgtcactctgaagaagaatattcaaggaccatttaacagcaactgtatgaagggtcctctttcccatactcttaacttactggtttaggtctggaaatttccatcaagggctgaaggattaccagtgaaggataataatggaaacttcaacatatttcctttgatgaatccatgtactatggagtatctattaggggctgagatttggcagattaacaggataccaagggtcccctataggcgactttgctttgaaaagggtgagtgtggcacattgctaacccacgggcaggcagggaaaagctcatattgcacattgcactgatctggcatagagggtcatcatcccctgggaacagtgacccaagagcttttaggagctcacacactgaacacaccggtattctcccctttcttcttc

SEQ ID NO: 651890 - DNA, 179 bp, Homo sapiens
cctcatctttatggactgtagccaaatgatggaattttctttggtgcgcaggggcccatacaagtagcttcatctgtcaaacctggtctcaatcctggttcctggtgacacccacctggaaaagcatttttcaccatgtcatgtgaacttcagattcacagaaatacttttcttgtgga

SEQ ID NO: 651891 - DNA, 922 bp, Homo sapiens
  misc_feature (253)..(253): n is a, c, g, or t
  misc_feature (321)..(321): n is a, c, g, or t
  misc_feature (341)..(341): n is a, c, g, or t
  misc_feature (360)..(360): n is a, c, g, or t
  misc_feature (365)..(365): n is a, c, g, or t
  misc_feature (385)..(385): n is a, c, g, or t
  misc_feature (435)..(435): n is a, c, g, or t
  misc_feature (454)..(454): n is a, c, g, or t
  misc_feature (507)..(507): n is a, c, g, or t
  misc_feature (543)..(543): n is a, c, g, or t
  misc_feature (618)..(618): n is a, c, g, or t
  misc_feature (620)..(620): n is a, c, g, or t
  misc_feature (651)..(651): n is a, c, g, or t
  misc_feature (659)..(659): n is a, c, g, or t
  misc_feature (662)..(662): n is a, c, g, or t
  misc_feature (667)..(667): n is a, c, g, or t
  misc_feature (677)..(677): n is a, c, g, or t
  misc_feature (681)..(681): n is a, c, g, or t
  misc_feature (685)..(685): n is a, c, g, or t
  misc_feature (691)..(691): n is a, c, g, or t
  misc_feature (695)..(695): n is a, c, g, or t
  misc_feature (706)..(706): n is a, c, g, or t
  misc_feature (712)..(713): n is a, c, g, or t
aatcaaagtactgctgaactgtgagtgcagtattctaaacatttcagctaggaacaccactgatttagaaacaaaactgttgtctctggtttctgaatttaaaatgttgggattacctgtttaaatctgtcttgggggatgtagagattaagtctgtacatgtgcgtgcacatatattcatgcaccctctgatttggttttcttgtttctgagttcttagaaagtacccacatactctttttttttttggtanaagtagctgtcatagagtgaagaaaggataagactttaaacagtggatccttttggtgtttcctacanactattttttgaaatttaanatcacaaactcatttccgngtttnagaaagtagatgatgattcncgaggagtaaggcttgccaagcagcatgctcagggggtttaaggctgtcncatgcagctgagaaaggtntgtccaagtcataagtaggtaatggatagggtatgaactagtcaaaatttganccattatgatccaggtagatttcctctggagagacngatctgatgtcagttctagccaggtagattttaacttccaccttttaatcagtatcacttctgtgcttaactatngntgtcacctggtctgtctccatgtctaaaatnctgcgagntgnctaancttcggcctntggngtcnatggtngtcnggaccttcagncgaagnntaagcaagatgcccatttccccatgactgtggttgtggtaacatttccctttcagtagttcacaccgtttggttcactcatattggcacacaacacacaaaaaaatgtggccgccgcgcaaaatttacacatttgggcgccagtagcagaacagccaaagcgcaaaggggtcaaaaaccgccccctaacaggggggcgcacaggcacca

SEQ ID NO: 651892 - DNA, 174 bp, Homo sapiens
tttcttgcccacgatcgggctccttgtttcctcagacacaagaatattgaagttggccaggcacgggggctcacgcctgtaatcccagcacttggggaggccaaggtgggcagatcacgagttcaggagatcaagaccatcctggctaacatggtgaaactcaatctctactaa

SEQ ID NO: 651893 - DNA, 510 bp, Homo sapiens
  misc_feature (293)..(293): n is a, c, g, or t
atggaaacagacatactgtactaacactaatcatataaagctagagtgcttttgttaatatttgacaaagactccagattaaggaatattatcagagattaagaaggatggcttataataaagtggccaattcatcaagacatacaattcttaaatgtatattcctctaataatagagcttcttagaaatcagtaaaaaaaattttcacaaaaattactaaatatttgaatattaaacaatacatttctaaataacccatgctgtaaaaaaggacatcacaaggtaattaganaatgttttgaagtcaatgaaaatgaaattataacatatcaagaacgtcaggggacagctaaagcaatacttaacagcaaacttatactttaaaataagtatattagaaaattttgaaaggtttaaaatcaattacctaagcttacaattatgaagctaaaaaatgaagagcaagtaaaacccaaagtcattagaaggaaagatataatggtagtagg

SEQ ID NO: 651894 - DNA, 157 bp, Homo sapiens
cgacgcgtgcgacgcgatgatggacaaggtcggccggccgcgcggcttgatccgcttcgatacgctggcgaaccaggcctgccgcgccaagggcgaaccggcgacgcataaattcatccgaaagcgcacgatgatctatgcgggcgttctcgccctc

SEQ ID NO: 651895 - DNA, 582 bp, Homo sapiens
cgtagtatattagcagtgcaatagggaaacgtagttaatactttgttgtattccaaacactacgaaatgaagaaaactaattttttatgtttttttgagtcagtctcgctctgtcacccaggctggagtacggtggcacgatctcagctcaccgcgacctctgcctcctgggttcaagcgattctcccgcctcagcctcctgagtagctgggattacaggtgcatgccaccgtgcccagctaactttttgtatttttagtagaaatggggtttcaccatgttggccaggctggtcttgacctgctgacctcaagtgatccacccaccttgccctcctcaagtgctgggattactggcatgagccaccagacctggcccacacccagctaatttttaaaacttttttgtagagatagagtctccctatgttgcccaggctgacctccaactcctggactcaagcaatcctcctgcctcagtctcccaaaatgctgggattacaggtgtgaaccagcatgcccagccctttaatggtcttattcttacaacccttatttcacattatttctcaaaccaaagtct

SEQ ID NO: 651896 - DNA, 1053 bp, Homo sapiens
gggcgcggtggctcacgcttgtaatcccagcactttgggaggccgaggcgggcggatcacgaggtcatgagatcgagaccatcctggctaacacggtgaaaccccgtctctactaaaaaaaatacaaaaaaaaaattagccgggcgtgatggcgggcgcctgtagtcccagctactcaggaggctgaggcaggagaatggcgtgaacccgggaggcggaggttgcagtgagccgagatcgcaccattgcactccagtctgggcaacagagtgagattccgtctcaaaaaaaaaagagaaaccggaaaaaaaatagcattatacctcttccttgtctcaaccgccatgaaacctcctgaacactccaaattcagttgaataatccaaaacaacaatttaactacggtttaacacatacttctcacttctatatagtaatagtatactttaaaaagcctcagggatatataatcttctaaccagctaccaattcagtgcagctacatttaaccaacctatgtctctagttgaaaaacaactaggccatattatcactgctgtgtaacgcctcagtgcctaacatgggtgccaaataaatatcgtagaaattacccccttgtcaaaaaccattcgtattgggttaccacttgccagaatttcaaagggcccctgtattcactgtaactcccttagagcactcactaacttgcagatgggaagtcctcaggttattgacctgggccggggatggtgacctctgttcacattaaggtacgctccaatatcttataaaacgccgtgcaagtacattgacctgacattgtaaccgaaagcattcgctgcccgtttgtctaagaggttaatttttgtcaacaaagccaactgagggtatcgcctagaatagcgttaacttgtatgggattcgaggcagaccaggtgttcgacaattatgtgggcattgtccgggacaattgcgagaaagacatgccccgagaagagtcaacatcttcagagtaagtgtgggctgagacttcgcgtgagagaggttgagtta

SEQ ID NO: 651897 - DNA, 377 bp, Homo sapiens
ccatcgcacgacatgagcctcaccatgtgctagcctgcaccaagtgctagcctcagccagtcagagcatgcaccagtctagcctgcttcatagtcactccagacagcccagagagacagcagaagtatgtggtcacagcatgcccttaggaccggcacagatgctgatccctatccattctgtgttagtccatttgcttgaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctccttggtcgtggcg

SEQ ID NO: 651898 - DNA, 222 bp, Homo sapiens
ttagcaggagcttatctccacttggttgcagcgcttgtagtaaatgctagcctcctcgctgaaggctccactacctccggggccatgtactccgccgagccgcagggagtgagcagctccggggtggagataggggagcagtcccctgttgagtttggatgccgctgcccagtgtcagaacgtcacagatcttcactgggggagaccctggttgagggtgct

SEQ ID NO: 651899 - DNA, 414 bp, Homo sapiens
acaaacatcttctcaagcagtcaacgtagaatgcttgggaaatagtcataattacccacatatagtaattaatagatggtaattaattgatccttgatgtgatgttcttttgcatatttccttcattctaaagttgtcccctggccgggagcgtctgtttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaag

SEQ ID NO: 651900 - DNA, 288 bp, Homo sapiens
cgtagcgttagtgtgtctctgagctataactcatgtcaactatgtatgctcatatacacggagtatgttcgtatagtggttcatggcctatctagtctggtgtatgtactcttacattgggctcccctaggcagtagcgtcatagtttgcacaacttcataaggtatcaggtttgtccaggcattatgatccatagagttactgagggtcacctctcccatgcagcaggtgattcagggagccaggcttgattcactattcccatatggtaatgcgggtaggtgccag

SEQ ID NO: 651901 - DNA, 204 bp, Homo sapiens
  misc_feature (5)..(5): n is a, c, g, or t
cacangacattgaagttagagtataatcttcgtacgtgtgctcacatatcttatgttaaacaataggtgatacgagcaggtttttaacattgatcaacacagaaacagatgctttgttggtagagctctttactctgcatttttaatacctgtatattaagtgccacttgttaatattactctcccactttatcttgttgggag

SEQ ID NO: 651902 - DNA, 1108 bp, Homo sapiens
tgtatgtctagggtatcgcttattacatctatgtctatggtgttccttcgtggttttctttctgtgctcgctttttttgccggatttgccctatgggtgatgcaaggacgctctcccggctcgttttctatggattgtcgtctccaggtcatgcttgtgtttatccctctttggccccttcgactctctttgatttgccgttttactccattatagtatattttgggaattcggtcgatctgggcagtccctctatgtctcgtatcttttgtctgttctactactgtaagggggcccctcctatctatcgtccatgggtttctcctagttggattccgtcctactattggtgaaaatgttctgatattgtgtggtccttggctctttagacccacttgttattgcgttccgttttgcgtggaacccttatttggtactcttctgcccgagaaccacgcttccgtatctggtgccacttctctggtgggtctcaggcgtcactgtcgcagtgacctgcgttgctttgggcttcttggacacaactgaggcgtacttgccctattggctctcatcaaaggcccacgtcacctctgggcctcgtcactcatgagtcaaggcgacgaaatgaggcgacgacgtgtagcctccttctgatgtactggtcaagagacactgttggaactttggcgctccgcgcaagctgcccgagcgtcatcgttgacagctagcaaggccccttggggcacagcacgcgcacactagccgatgcctctcgtgatcgtcaacagctgaaacgctgatgcctagccccggatgcacagcacctgaccaggtgccgccccggggcaagggcacccagcagccgcatatggtagaccgccacagctgtgccttaatgtctgccgggggcccaggctgtgctgtaccctgcagcacgcctccttgcagggatctgagccaccctccccagcacagccctgcaccccgcccctagggttggcagcctcagatggcacactggcagaggaacaaggacacagacattcccatcagtgtggggggcagggacacagggagaggcggccagagcatcgggcctcagcctgga

SEQ ID NO: 651903 - DNA, 153 bp, Homo sapiens
ctctgaggatccccacatcctcacgttaattgacaggtcaggagatcaagactatgctggccaacacggtacaaccccgtctccaataaaaatacaaaaaaaattagccgggcgtggtggcgggcgtcgcagtcccagctactctggaaagtg

SEQ ID NO: 651904 - DNA, 87 bp, Homo sapiens
aattcaagcttctaacgatgtacggggacatgctatttgacaaaaaccctcaaaagttatccaaatcaatgcatgctcccccaaaaa

SEQ ID NO: 651905 - DNA, 847 bp, Homo sapiens
  misc_feature (27)..(27): n is a, c, g, or t
  misc_feature (61)..(61): n is a, c, g, or t
  misc_feature (64)..(65): n is a, c, g, or t
  misc_feature (67)..(67): n is a, c, g, or t
  misc_feature (69)..(69): n is a, c, g, or t
  misc_feature (81)..(81): n is a, c, g, or t
  misc_feature (88)..(88): n is a, c, g, or t
  misc_feature (95)..(96): n is a, c, g, or t
  misc_feature (98)..(98): n is a, c, g, or t
  misc_feature (102)..(102): n is a, c, g, or t
  misc_feature (112)..(112): n is a, c, g, or t
  misc_feature (118)..(118): n is a, c, g, or t
  misc_feature (123)..(123): n is a, c, g, or t
  misc_feature (128)..(128): n is a, c, g, or t
  misc_feature (134)..(134): n is a, c, g, or t
  misc_feature (140)..(140): n is a, c, g, or t
  misc_feature (148)..(148): n is a, c, g, or t
  misc_feature (166)..(166): n is a, c, g, or t
  misc_feature (168)..(169): n is a, c, g, or t
  misc_feature (190)..(190): n is a, c, g, or t
  misc_feature (193)..(193): n is a, c, g, or t
  misc_feature (203)..(203): n is a, c, g, or t
  misc_feature (212)..(212): n is a, c, g, or t
  misc_feature (222)..(222): n is a, c, g, or t
  misc_feature (253)..(253): n is a, c, g, or t
  misc_feature (257)..(257): n is a, c, g, or t
  misc_feature (282)..(282): n is a, c, g, or t
  misc_feature (284)..(284): n is a, c, g, or t
  misc_feature (295)..(295): n is a, c, g, or t
  misc_feature (310)..(310): n is a, c, g, or t
  misc_feature (323)..(323): n is a, c, g, or t
  misc_feature (327)..(327): n is a, c, g, or t
  misc_feature (339)..(339): n is a, c, g, or t
  misc_feature (341)..(341): n is a, c, g, or t
  misc_feature (343)..(344): n is a, c, g, or t
  misc_feature (348)..(348): n is a, c, g, or t
  misc_feature (374)..(374): n is a, c, g, or t
  misc_feature (378)..(378): n is a, c, g, or t
  misc_feature (383)..(383): n is a, c, g, or t
  misc_feature (396)..(396): n is a, c, g, or t
  misc_feature (400)..(400): n is a, c, g, or t
  misc_feature (451)..(451): n is a, c, g, or t
  misc_feature (539)..(539): n is a, c, g, or t
  misc_feature (836)..(836): n is a, c, g, or t
aaccaagtactctccatcctgcaatgnagtcttggcttgtgaaggacatggggcgcctggnagnngntngggaggttgggnagctttnggccagnngngtcntggtcactgntccacntggtnattgntccacntcatgntgagaggngcttgtgtgttaaacccntnnggaaaaagggacaggcagatnganttttgttttntaccaagcnagcaggagcntcctagagcaatttggagggcattgattttnaganaggaggggtcagggcatagtccctntntgaggtaaggnaagagagaggttgtnccagcacaaggcnttcntccctgcacctntntnntganagctgggcatgggctgaggagaggtnttgnttgcnccctttaattttncatnttagaactataaactgctaggctgcaaggagagaagggctaagtgggggtnagacaggagagaagggcaggaggcagtgagccccgatgacccaccaactccaccaggccctgacaaggaagcccctttggttagtatnattttggccacaaatatgtccccttctcccataactcagtccccactgggggaaggggagcaggtatagaaggagggctcgtgccctggctggaagagccaggtcagggagaaggggtctggtcaagagagcgaacgttgccaaactctctgcacatgctccaggagaaagctcaggacgtggacatttctggcccaacaagcccagtgcccccaccacacagtggtttcctgcttaatacccgcaacataccctagaatagttccctgatctgactccttgagaacgggagaatantctcttgttat

SEQ ID NO: 651906 - DNA, 202 bp, Homo sapiens
tgcagtggcttatacctgtttttccatcactttggaaggttgaggcgggtggggacccaaggtcaggagcgggagaccagcctggcaaacgtggcacaaccccatctctacaaaatacaaaaattagctgagcatggtggcaggtgcctgtagtcccagctactccggaggctgaggcaggagaattgcttgaacccaggag

SEQ ID NO: 651907 - DNA, 184 bp, Homo sapiens
ggctagtaagtgtcagaaatctgactcattatcgcagcttgttccaaagtgcgatacagtgagcatgccctctgtactctttacagtaagcacaacatacatagatgaagctagaactccctcagtcattcctcctttaaatataaaatatggagaacttctagactcaatatagaagcaaagc

SEQ ID NO: 651908 - DNA, 531 bp, Homo sapiens
ggagaggtaaaagaaggggggtctgccccggagccgggaccaagagcaagcgatgggagccactgagcactaaatagagggagcctaaataaggagaactaaagtaagaaacaaggtgaccaaggtcacacgggggaacacgcgaatggggaaaacggagtatcggcagcacgtgggtgcacgacgtttagagggataacgtggagaacgcggaattcaagaaggcgagaatgggctagcaccgaggcggaatggcgggtcccacatacgcggagtcgaaacctggatatccagtagacagcgaagaggttctgacgatggaagggccaagaacgcgttgggaatggcctttaccagcggccatacgtgcgtaataagggggctcaaggggaattttggaacggaccttaagcgggtcatttgaaacaggctttacctattgcaaacaaaaacgtttaaccagactggaaaatgtaaggtcatgcaacccgataagatccgggaatggggtttaacagggcgttttgggtg

SEQ ID NO: 651909 - DNA, 394 bp, Homo sapiens
cagctggattatcccattaccttcactatggtgcccaggcagctggattatcccataaccctcactgtggtgcccaggcagccggattatcccattaccttcagtgtggtgcccaggcagccggattatcccattaccttcagtgtggtgcccaggcagctggattatcccataaccctcactgtggtgcccaggcagctggattatcccattaccttcactatggtgcccaggcagctggattatcccattaccttcactatggtgcccaggcagctggcgttcaggcctgctcaggcgtctcatgaccttcactgtacttcttagataaaacagaatacttgaagtcactagttacagagaacaggaatctataaactcattccttaaacca

SEQ ID NO: 651910 - DNA, 378 bp, Homo sapiens
  misc_feature (4)..(4): n is a, c, g, or t
  misc_feature (10)..(10): n is a, c, g, or t
  misc_feature (29)..(29): n is a, c, g, or t
  misc_feature (78)..(78): n is a, c, g, or t
  misc_feature (153)..(153): n is a, c, g, or t
  misc_feature (207)..(207): n is a, c, g, or t
  misc_feature (277)..(277): n is a, c, g, or t
  misc_feature (294)..(294): n is a, c, g, or t
  misc_feature (375)..(375): n is a, c, g, or t
cttnagaatntatagtcaatcgctaatcnatgttatttctgtaaatgaatgagaattcctggaaaacaactttgtatnagccccactctttttgtatctgtcccccttttaaaaatccacttgtggccaggcgcaatggcttaggcctgtaancccggcaccttgggaggccaaggcaggtggatcacaaggccaggggttcaagancagcctggccaagatggcgaaatcccatccccactaaaaatacaaaaattagctgggcgtgatggtggangcctgcaatcgcagccncctgggaggccgaggcagagaattgcccgaaggcaggaggcagaggttgcagtgagccgagaccgcgccactgcccccaancct

SEQ ID NO: 651911 - DNA, 301 bp, Homo sapiens
tgaacggaaaaatggtgactttataatattggaaaggagggatttcatggccgagtggaacacaacagagaacccagaaataaatccatgcatttacagccagctcattttgcaccgaggcaccaaaaacataccatggggaaacagatggtgtcttcaataagtggtgctgggaaaatgagatatatctatgtgtgaagaataaaactagacccctgtgcttcaccatatataaaaatcaaattgaaattaattaaaaacttatatgtgagaaactacaggctgggcacacattatggag

SEQ ID NO: 651912 - DNA, 562 bp, Homo sapiens
tgtgatcccaggagaggagcagccgaagtcagaggggagttgtggaaagtatccaagaacagtggagatgggaataggctcgcgggatgaaaaatggctgtgcatatgtgtatgagtgctgggaggcctctagctagaaggtttttattagcaggttaatagctggtaagatggtccagtcagatattcatgcagggcatggtatgatgtacgtgagtcttgtggactggggccttacggggggaaacagtcggaaggtatagtggactcttgctgccctgggactatgtcttgcctccccagttatcaggaaatgccataaccttcctggccctcggtttgctcaccctttccaagaggggattcttttacaagttatagggggaattaaatggggtggatgatgataaaggatcttgaagggcctggtgcttggtaagcactaattcctccagcccacaatttctttagcatttcctatgccaggagttctccaggggggttgccagaactcagaatcagtatcacctgggagctcattagcagatattacacaccacag

SEQ ID NO: 651913 - DNA, 250 bp, Homo sapiens
ccaggaaaagctcgcggaatgactgagtgttctgcggagagagaggctccaagcagtctgggaagtgtagtgccagttggcttagcagtagtttcgttggtgggggagccgaggttccgggaagtgtgctagtgcggcttgaaaagagattatgactgtaccttttaacttgtagctggaacacaagaagtgttgttaatgaatgacgtacacattaagatctgtttggacgtcggagatatcctgtgaa

SEQ ID NO: 651914 - DNA, 236 bp, Homo sapiens
taggagtcaggcaggtccctaaaatgagccaaatgggcagatgtgtgataggaactgcagagcgccaacgagtacatctgctcaaagggtcagctctacgtaggcatacagaactagcgctaccagatcacttccctaaagtccaggtttcaattcaggttttatcatgtatagaattcaatatttttttcatcaccatgcagaccaaataaagtacacctacaggttcttggggc

SEQ ID NO: 651915 - DNA, 905 bp, Homo sapiens
  misc_feature (83)..(83): n is a, c, g, or t
  misc_feature (379)..(379): n is a, c, g, or t
  misc_feature (423)..(423): n is a, c, g, or t
  misc_feature (433)..(433): n is a, c, g, or t
  misc_feature (438)..(438): n is a, c, g, or t
  misc_feature (443)..(443): n is a, c, g, or t
  misc_feature (452)..(452): n is a, c, g, or t
  misc_feature (459)..(459): n is a, c, g, or t
  misc_feature (461)..(461): n is a, c, g, or t
  misc_feature (466)..(466): n is a, c, g, or t
  misc_feature (468)..(468): n is a, c, g, or t
  misc_feature (478)..(479): n is a, c, g, or t
  misc_feature (491)..(491): n is a, c, g, or t
  misc_feature (496)..(496): n is a, c, g, or t
  misc_feature (511)..(511): n is a, c, g, or t
  misc_feature (515)..(515): n is a, c, g, or t
  misc_feature (518)..(518): n is a, c, g, or t
  misc_feature (520)..(520): n is a, c, g, or t
  misc_feature (524)..(524): n is a, c, g, or t
  misc_feature (531)..(531): n is a, c, g, or t
  misc_feature (534)..(534): n is a, c, g, or t
  misc_feature (546)..(546): n is a, c, g, or t
  misc_feature (551)..(551): n is a, c, g, or t
  misc_feature (556)..(556): n is a, c, g, or t
  misc_feature (581)..(581): n is a, c, g, or t
  misc_feature (591)..(591): n is a, c, g, or t
  misc_feature (847)..(847): n is a, c, g, or t
  misc_feature (887)..(887): n is a, c, g, or t
gagggagcctctgagcctactctagttcaagaggctacctgaaaaagaataaataagataaagggtcagcaacaacaaagaanaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaagggagtagttttgcatttctgatgacagccttggaaagtatatttgtaactccatgtctggnaatgccaacccaagtcgacatgggtcttaggacactgaccaccncacatgccanacccncagtnaagcatgtnaacattnanaggangnaaaaaatcannttgggagaaaanaaaantcaactcaagcatanagcntcngntacncaggccntcnaaaaagcaggtnaaaangctcnaaaatgagaaagcctgtggttcacntatttatatnactcactgggacattgcaaatgagtaacactaattcgctgctctgaactctctgcaaacagcccactgtatatagcagacgagatgcaggtctctcctccctgcgttagaagtatgagagtcgctaaatgctttgagctttctttgctataagtatgcatttatatctattcatatactattgcatggtttatttaaaaagttgtgctacctttctccaaaaacttaagtagatgactggaaatgcaaaaaaaaanaatttaccgccgcgcctgttcggcgttcgttagtctagtntacttcgtacataaataa

SEQ ID NO: 651916 - DNA, 885 bp, Homo sapiens
gctttcctttcagtagtgactgactgaccagagctcagcgtgtggcgctgagcatgctggaacaaatcgacccatcagatacatccctcaggatgaagacaccactgttactgatgtatgggccaggaggaccggcgtgtgccctgtcaagaccagggcatggagtattaccgatgccctcaatgacccggatactgtgcctgttctggctcctgcatctatcccaaaagcacccacgcattatcagaggtgtgatggtggagtcagacagcttcatgaatgctgtgctctggctacgcacacacttgggcacgctgaagccctgccattctgcatgagctgatcacgtactgtgccacacttcgctcttgacgggagctcaacggatctggcagaggttagacaggtacggcatttcttggtgactctgggactccacgttgtactgcgtgctgccacgaacgtggaactgtcggcgctatgtagtcatacattaaaattacggacacaggaaaatatgactaagacttcacaacaaattagacttaaataataggggatgcccgctttaaaagattcccccttaatgaggtccctattgcccatgtccaagtctccttcgccagagtgggtcacctaattggcgcacgtgactcttagaaactaggcgggcgacggtataataacagccttcgagctcgtgcaacaaccccctgacgggaactctcttggcaaggcccttcctttgttgtatgccttacgaaggttggggataacacacgctccaaatgtctacgctccaagggaacttaaaaacgttctgggttctttgcgtcagcaactgccatgtgtgcggcgaaattggcaccggaagttcgagttcac

SEQ ID NO: 651917 - DNA, 315 bp, Homo sapiens
tgggattgcaggcacgcgccaccatgcctggctagtttttgtattttgagtggggatggagttttcgccgcgttggccaggctgttcttgaactgacctcgagcgatccacctgccttggccttccggagtgctgggattgcaggtgtgggccaccgcgcccagccttgcatttaatatttttataatgtgtctaggctgggtgcggtgactcacgcctgggatcccagcactttgggtggctgaggcaggtggattacttgaggccaggagattgagaccagtgtggccaacgtggcgaaggcccgtctcggcg

SEQ ID NO: 651918 - DNA, 403 bp, Homo sapiens
aagaacctgacatgcagcaagcacggtgttcgtgtggtaacctcgaaacactactccctactgcccaaacccatacatgatttccttgctatcattgtcaggagacgggtagtgccttctttcccttttacaggtctgacctcagtcttcatgggccacaggatgtggggtacctggtgggccttgaccacaaggtgaaagtcaaccatttacagatgacaataagaggagtggggagaagcaggaaggaaatttgatgtttattaatctgtgttaaatgcagctaaaagatgtaactaagaatctgtccaagatcttgctatagggtgagtgaccaagtctaggatagacttcaaagtcccagcttcctatgtggggtcagctgaggacacacagtgtgggc

SEQ ID NO: 651919 - DNA, 173 bp, Homo sapiens
ggtgactctacggatccttactgctgctcttctgtagtccacgtgcattacatttctgaatgacctctggaagtcgatatggttctattccaccatcaagtatttctttgagagcactgtttgtctagtttaatatatctaggatactgtcgttatgactagaaacccaattc

SEQ ID NO: 651920 - DNA, 1071 bp, Homo sapiens
  misc_feature (976)..(976): n is a, c, g, or t
  misc_feature (1032)..(1032): n is a, c, g, or t
  misc_feature (1050)..(1050): n is a, c, g, or t
agtcctttttgggcgccctccgcggtgttccgtcgtgggggtctccgttttgcgcggcgtgggcccgtggctgtgcctgcctccgctttccccgcgggtggcctcttgtgttggggacctgggcagttccggtgggtccctggcacatgtcttccccggaggaactcttcacggcgtcaagtacgcgtggtgccccttccccccacacgtgcctgtgcagtggggaaccggctgtcacagatgaattcccagatgaatcgcggagtgcgctgatacaaagttggctctgctctgagtgtgcctgcacagccaggggacttccaaatgctccttctctgttcagctccctttgtgttcacggtataatgacacacactttctcattggattcttttcactcaccagctttttgtcgataaagatacgattgttaatgctgtcggggcatcgcacgacatccacctcctgaagattgacaatcgagaagatgagctggtgaccagaatcaactcttggtgtacacgtttaatagacagggtgagtcaatcccaagccatcctagcaggctggatgaacttttctagctgacatggaaatcctccctaggtagtggatagaattttcattaaggaatgaaatgaaggaagaaataaaattaaggattatagaattccacactgaagacaacattgcccagagactttaaaacccatgggcttcatcattttcctaattcctacctcaaatatacagagatcagcagaacctggggaggcgctgaagcaaatgaggtttgcagatctaaaggaactattttccccttccctcaaactggattcagtgaaagatattaaccaatgatctgatgtaaggaatcgggctttggtttcactcctcagattcacaaggatgagatcatgaggaaccgcaagcgcgtgaaaggagatcaatcagtacatcgaccacatgccagagngaactgggacaacctggaatgtggcgacatcctagactaggttgaatgtcaggccncaggagcttccttcaaanccttggcaccaggccccagcc

SEQ ID NO: 651921 - DNA, 322 bp, Homo sapiens
cgattagaggatccccggtcccatgcacagttgaagaaaatgttggcaatatatatgacaaaggattgaattcagaatcatggagaactttcaaaaaataggcaaagtaggccgggcatggtggctcacccctgaaatcccagtactttgggaggccgaggcgggcggataatctgaggtcaggagttcaagaccagtctggccaacatggtgaagccccatctctactaaaaataccaaattagtcaggcatggtggaaggcgcctgtaatcccagctactcgggaggctgaggcaggagaatggcgtgaacccgggaggt

SEQ ID NO: 651922 - DNA, 586 bp, Homo sapiens
  misc_feature (162)..(162): n is a, c, g, or t
  misc_feature (282)..(282): n is a, c, g, or t
cgtcggagtccgggcggccaagacccgtccgccggctcggccacgtgcatgggtccgcatctgactccgctccgcgggagagagccgctgctctgggataggtgagttcgcctgctggtactccgatggaaccagctgcgtcgccgacagatgcgctcgagntgagtgaccgcagacattttcaagagcgcgggttagctgcgcggcgacgatcgtacaataggtacatgacgtggcgggtaggcgactcattaagttaagcccttgctggctccccttggnagtcgatgactcgggtgaagggatgggcgcgaggccggcggacagaccgagtcccatgacgaggtagcggtggcgtcgtcgttgaggagtagaatcgtttccgccgttggtccatagagggcattccagggtgcgcggtggcagccggggggttgttcacacactcggacattttgactctaaagaaggaccacttggtattatcggcctggggcccccacagtaagaataggcgttttgttggggccagaccggcccaaggttccccccaaaacaatctttaaaaagccccttaccaaacagg

SEQ ID NO: 651923 - DNA, 647 bp, Homo sapiens
gaaagatgatggttgccggagagtggaaatggcagtgctgtgtactctgtgtgtgaaagtggagcaaggaaggagctacagtgtgcctgacgctggagtgtctgtgctgcagaaaaactagaaaaatgcctggaccattggaacccccaaatgccacgggatccgtgccctgtgcttggtgtcgcaggcttggaccttggtgtgcaacttgtgtatgtgtgctgttgccttgtgtgttgaacaatgagcactgcactgctgcgttccttgcatccccttgttgaatgcactgggcctacggtgcagggattgcacatggcagggatgggatatatctgggagatcttaccatgtgcccttgtgtgcctggatgtgccaacgttgtgtttgcataattgttaccctggtgatggtgggataatggcccaatggaaccttgaccgcaacctttggaaatgatgtgaaattttacacgggctacttggcgcctacagaacgctgctaaaatggcagacgggggtttggctgattataaggccaacgcatggggacgcgtgtggatggccgaatgtgtgtagcccgcttcgaactagaacacgcaagcgattaagaaaagttcttaactaaggttttattggttggaagca

SEQ ID NO: 651924 - DNA, 407 bp, Homo sapiens
ccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagtttgtgaccagtggtgagacacgaagagaggaaggggacccatcacctcattcaggaggagtttgcaaaccaaagctgatcagcaagtcaaacagcaggaatctaagtctcctatacctggggcaaggctactaggacgcgctctcagtctcctctgtacattcagaagatagcggaacagcctcctcagcagcgc

SEQ ID NO: 651925 - DNA, 834 bp, Homo sapiens
agcggactgctgcccgccggaagaaccgagcttggttgtgtttatctcgttggggactactggcgtcggttggcagcgacaacgggattctaggtcttgcaagagcgatgcatcgaggacccgcgtgccccgctcccggtctctggcctggcaagatagctagaggctagcaggccgttgccgggggggcatgttgcttgtaaccagtgtgaccaggggatgttactcgtggacatgtgcaccctggagggctgggcccctgcatggtgtgaaccattgctgtcagtgtgctgtcgggcatcggggtatactcctttcggtgggttactgctctggtgaagactcatgagacactgcgtcatatatgatgtgcacattttcaatgcagtgtccttgtcgttggacaaagctgtcccccggtgaacgtctgccatccgtgtggcaagctcctgtgtgtaccctacagtgcagctatggacgactcaaccagtcctcactcgatcgatcagcagtcctcctttggtggcgggcggacatgacatccgaacggggcctgcaattgttgctctatgcctttgacgtcatagtacgcacaagtggttcatgatcaccgagtgtcagggtacagttcctggggcccgggatggacattcaggctgtgtcctaggcaagatcatgtacatttttgggggctacgatgcagcaggcggacgtgttgagccaatgacattcacgagctagataccaggaccatgaccatggactcttatctgttaccaaggggcaggcctggacgctggcagggacttccactcagaccacaatgctgggcaa

SEQ ID NO: 651926 - DNA, 763 bp, Homo sapiens
  misc_feature (262)..(262): n is a, c, g, or t
gtcgagagcaggttcagcgggatggagcgagctgctagcctcgacccgagggggtctgctccctgaaaatgccctcacagcaccatgtacaggctctgcggagtggatgccacgcgacaaccaggtccgggacagcgtgtgaggaaggacagttgactacgatgcctgagtgctgtcataatatgcatccaccgagatgagcctgcatgccctctatatgcaccgattgatcctacaatgctgaagggccatggctgaaccntgagcggcatgtatgtgaaccgcctgggagagtgatgagagtggcagaacagcgcctccattactggaagggggtgacagggcgcacagtggaacgccgcacgatctttgtcactgtcgacgtcatggatagacctatccccctggattgcaggaccccgcgctgggagctcctggaacagcgctcctgcagtggggcgcttccagaacgtcgctacggtaggcatcacagatcctggccacagtgcccagggttccctctcatttctctcgcgctgcctcttgcgagggtgggcatgaagatgggcagtcggcatcaaaggcaaccctgagaccgtggcccgaacagggctccgaggatgagctacccctcaagtgcaacaaggtatagacaaggctcgagcagggttcctgtgagccccaggatggaagtccatccgggtgccctgccatcccgtctgccttgcaatgggagggctcctctgagtgttccctggcccac

SEQ ID NO: 651927 - DNA, 391 bp, Homo sapiens
cacttcctcaaggctgtggattatcagtggcagagcagggatttgaacccaggtctgtgggcagcagagctgggtgtcttaaccactaaaccagagagcttagtattgtttgtgggattgagtgaatgaatgcctgaatgaacttggtagctgaaaaatctagtaatagttgtcttaaatccagacctacactagtattgtaaattatgtactcagtttcagttttcctcctgtaactcagtgtacaagtgtcctcttcataccagtaagttttctgagaatttcctcaaaggacgtgctttcttatatcctcgctgaggcacttcttagtaatggaagacctgtgtatttcactttctctttggatttgccttagaactacagtgatgga

SEQ ID NO: 651928 - DNA, 792 bp, Homo sapiens
tctggcttttggacgtgggttttgattgtttgtttgtgttgtgcctccgcccgcgctccccccccattccacatcctcaccatgaaagggtgtattttgatttatttttttttcaattatcactaccttctctattgtccgtcaatgtggggtcgagcgccgcgcgactgtatttatatgtggtggtcagagggcgcccccctgtattatatttaggtaaatttcaaacgccccctgccttcccccaccccctcgcgcccactagcccccaccaaccaccccaccgacacataacaggggagtcgaagtaagggatgaggatgaagtgtatatgggattagaaacacgaggatgtgttgttgtcgggtgtggaggataatgtaagattaaacggcacgcacccgcctttccctctcctgctgtcttatctagcttaaataattattttatatattaaatattaattatatattttaattatttttttattgtattatatattaatttagatagttaagtcacacatatattgcgtcaacggaacaacatgactatatcgatggtacgttgttgataggtacgtgtttcaggattttggctcgacatacttgttactaatcctgaatcccttgttttgcgaagaattaacatttattctttgtataccgtacacgtagtagatcggtgtaagggagacgatcgtcgagttatgcttcactcaggttaattgtgttgggttgccatcttggttgtaggtatgactctcgtttcgttagtgtaccaatactgatt

SEQ ID NO: 651929 - DNA, 190 bp, Homo sapiens
ggcccagcctttagatggcagaagtggaagatgagcataattgtgagcgatgtgaccttaaggaattgacgactggggaagagtacttagtgtttttaagacatttatgggcccctttttcatttactgattcactgctgatttccccttttcattttttggaaaattttaagtccaacgtaatcattta

SEQ ID NO: 651930 - DNA, 773 bp, Homo sapiens
tgcgctggcctctgaaactagtctctgggaccggggtctgcgtgccggcccctagcatggccccgctctcccatccccagaagggtattcgctgggtgattctgagactttggctactccagtttcccacgacacgatgttccctttctacaggcctgctggtaggactaggactgctactactactcctggctgctgggcaggtgagagcaatcctggcgaggacgagcatagaagaaaactggcgacttggtaggaggacaaagggtaataggagtcagagaaggagttggctctagtgaggaaggctgaacaccactgtgttcaatcaaccagctttcgagagcacgtgttgggccagggtttcagacgacatacatctacatcttcagggtgtgccgggtaagctggcagaccgacacttctggggcaggccgtggtgcatgagtcaacaatagagtccatggcgcaaggagaccagctggtagggagactcaacgagagtcacatcttcaacggaagtaattggatcatgctgatctatagagggggtgatgaatatgacaaccactgtggcaaggagcagcgtcgtgcggttggtgatgatctcctgtcaatcgagcgtcagcctagcggtcaattttgccctgtgtctgagagagcgtggcaaagtccagattgtgtctactcttgggatgggttgcgcctggctggtcccgatttccccccgggggggttccctccggcggtgggccaggggggcggggggggcc

SEQ ID NO: 651931 - DNA, 687 bp, Homo sapiens
aacaagaattcaagagtcttaatccttgtgcccaaggtttctttcctacctccatgtatcgctctgaagggatagtctgcccatgccggtagttgtaggcaatgtcaacaaactgcttccggtcttgcgcggcacttcaggatctgttacaaccagggtggtaagcatccagtgacgcaccatagctgagtatctgattggcaaatctgtccagctcttgaatggttcttgggatccagagcactgtgtctttcttcttatctcgtgaaagctcatggacagtggcaccaatgtcatgcccaagactcttgataatgtttgtcagagcagccaggatacgtttatacgtatgggtgaaatattcaagctcatctttctttgagcgagaaggtctagattcaatgtgggtcaggtttacatcattctcctcaaataagcgcaatactttggccaatgcaccagcttcttctttgagtgacaagatcagtgatatggcaccattttgattgcagttgtcttcaatatagcttgtttcctgtccaaagtcagagagtgtcctgcgcaagcctgggttttccagtaccgcagtgaacatctggctccccgagagtgaggtctctggccttttagggcctcaggtacaggcaggtttgcaaacagcctggtggcctattcctgcagcccggg

SEQ ID NO: 651932 - DNA, 194 bp, Homo sapiens
gtgtctgcacaaaggatgcgagttccgcgactctcaaacaacttgcgctgtgaccggtccggaattcatggcagaccctgcgatggtggccgcactagcggcctcagttagcgcttcaatagggcactggacactcgacactgtcgaattgagcatctacggcgaagttcgaggcgattggcagctctacgatt

SEQ ID NO: 651933 - DNA, 1069 bp, Homo sapiens
gattcttttttcagtcagtttgctcctgggttcaagtagtattaccaccctttcacaagcaacagactctcacagggcaaaaaaaaaaaaaaaatctaattgattcaacagacagatctgggagcctctcttcaattctcaagtaatggctagtcccaagaaactagaatttggcaattggggccacaacctaataatccttcctggtggaagaaggaggccactctcttggagcctgaagtttccagaaacgagccagttacgtgtccaggagaaattggaacctcaacttcagcaatcaagggactctatttggaagagcaacattattcacaaagctaacagtgtgactggtgccaaacactttaggtgcttcattagggggtcatgctaggcctttatcacgtcactgggaaacctttcctgggcagccacaatctcaatgtcgtaagtaaggaagatcacgaggggtcgaaaaagctgtagacacaaatgtcgggggttacgcattgaaaatctaaatgtaccgcaataatgttgtctcctcacaccctgggaaaagtgtccccagtttcatttccaagctcctgatgtgtgagcacaagtttctgcaagggtccatttactggtcgaaaatacgtataggacagcggaaggccacattgtgggggctctcaaactggcatcgctcctccttgcaccccgtataatggctacagagttccttgtggcggcgtttatttcagcctgacattccagttgtttacccttgactgtggggaacaaacaggtcgattgctccaaaagagctaacacacatgaacagtggcgccactaatgtaaccctttcagattgtgattttaggccgccgaaagcttaaatcaagtcccggcggggctattaatggtataaaggggcaacatatggtgtgcaccaatagttttggccacataattttctataatccagatattcctatacttagtgtcgtgtatttaaccccgcatcttgtgacagcaatctatcgttaaacttgtgcaaagactccttaacttgtgatacactggg

SEQ ID NO: 651934 - DNA, 1421 bp, Homo sapiens
  misc_feature (485)..(485): n is a, c, g, or t
  misc_feature (870)..(870): n is a, c, g, or t
accacaagccggtgggggtggtgcgtgctttgtttcgtgtggtgggacacccgttggtgttgtgcccccctttctaaggggggggtcccaacacccggtgtttctatgtttgctctggtgggtctgccttcccccgcctttaatattggggggagcacccacccttgtcatccaactgcgcgggggttttgcccccccctgtgtggttggtagaacggcagcaggtttttgtcgtagccctgcggagaaagcatttttcgtggggggagaaaatgtgccagatcagaacccacccccccactggggaacgtgtgtggaacaccacagaaattggtacacacaggcgaggcacaaccaccaacatgtgggcttctcttttgtttaatagcggggaagcattttggtggagagacgataaaatattggccttttagaaattttcttcggaagagggaatatggtagcagaacccacacgcggggttnttttttcttctccaacatcatcttttttttacttgggggggggccctttataggagagaatacagcccacttcttaaaattgtgaaggggcacacagcgtttattaattatagagatatatatatgaggtttataaatagacaaagggtgtggggtcgcatatcaccacggagcaagaatagaagatctctcgcggtgtgttttcttttgggctaaagactttgtgcccgcactgtgcaccgtgtgtttgtgctatataaaatttgtgtggagaacacacgcgcccaccacaaagcgcatatatattatgtgtatatatggggggctctatatctgtgtgtgttgtacaacggggtatatcacttatagaacacattgtggtggntctctccacatgagcacttctcacggagagtgacacacatcccgacatgcgcgcgagagctcccacatatatatgtgtgaggagttttagacacacatgtgtagaatatacaactttgtgtgcgtgggagagaaatttgcgtggtagagaaatagagagagaacacacacacggtgtttgtgcatatggtgagtctataaggccccgcgcacatatatggtgaggtgtagaaagtatacttctacggcacacgcctggcctctcgtggtgataacacagcatatatgtacacgggagagggagggagacccacacacacgtggatatacacactttgtgagtccccctttggttttactaccccaaacttaaaataagaaaccttttgaataaataagaataactgcttctttttactaaagacaataagtcttcttaaccctatatatagaaaatgtatatgtttgaaaaccccttattttacaccagccattttgtatcccatttaaactaaccttttatccaataaagccactattgtttagatatta

SEQ ID NO: 651935 - DNA, 297 bp, Homo sapiens
cctcggcttctggagctgattggactcgccagtccagtcgcttcatagagcccgtcgccgctggtggcgcaagttgccgtgaatgctaccacttcctgtggcgtagtgagctgctgccccagcttgtctgtgatctcggccgctcttcatagcgttggggaggtcctgcttgttggtgaacaccatgaggacagcatcccggagctcgtcctccgccagtatcctcatgagctcctcacgggcctcgttcacacgctctctgtctttgctgtccccctgtaaaaatagggcttgtgt

SEQ ID NO: 651936 - DNA, 179 bp, Homo sapiens
ggacacagcaatgtcgatcacccatgacgcttacttgaagctgtatcagctaagcaagcccgacctgagcgaacgatttaacgccattctgctcgacgaaggtcaagacgtaaacccagttattgccgacatagtaaaaatacaacgggtccgcaaggtggcagtcggcgatccccacc

SEQ ID NO: 651937 - DNA, 412 bp, Homo sapiens
  misc_feature (31)..(31): n is a, c, g, or t
  misc_feature (55)..(55): n is a, c, g, or t
  misc_feature (86)..(86): n is a, c, g, or t
  misc_feature (103)..(103): n is a, c, g, or t
  misc_feature (109)..(109): n is a, c, g, or t
actaaaatggaatccctgacccccaaatggnaattttgccaaatttgccattttnagggaccttaccaatttcaaaaaggaaagtnggaaaaccagggtaggnagaatnagaagttgttgatcaagaaacaggccgtgtatatttaaagaatttagataaaactatactagattggctgggtgccctggtcgcacgcctgtaatccccagcactttgggaggccgaggcgggcggatcacgaggtcaggagtttgagaccagccctggccaacgtagtgaaactcctctctctactaaaaataccaaaaattagctgggcatggtggcgggcacctgtaatcccagctacttggtaggctgaggcaggagaatcgtttgaacctgggaggtgggggttgcagtgagccaaga

SEQ ID NO: 651938 - DNA, 1044 bp, Homo sapiens
cagcgctaagctcgcactgatgtgttacctgaggtaggccgtagaagataaacatgctggcgtgttattccagttctatggcaagaacagagtaaaccctcgttaccagcagaaggccgtgccagtcaaggtatttccctcacgcaagacaagcgcagtccataactcctgtctaagtaggctatcctcttcaagaatatactctccggacaagtgaaccataaccaatattaccaatcagtactcatcattaatagtcataatggccatgagcaataagaacgtaggaatagcccccatttcactgtctgagtcacagagggttacccaaggaactccctctgacgatccgggctgctttcttctcacatgacgaaaagactaggcctccatctcaatcatagtaccaaatctcgtcccatcacttgaatacgtcagtccttctccgtcacatcgtcggtcaatcttatccatcgatagcaggcaggtgtgcaggctggcattcaaagccaagaccccagatcacgcatagaatccttgagcatagtacctcgaattagcacaaatagggcatgacattcctagcagtatctaacagtaacaaagcctagacatcaagccatgcttagataccagactaatcgtataatagaatggcgtaaagtataacatatcgggtatgtgccttaagttaggtaaaagtgttaagaagtccaaggagaaagaagggaaaccatacatagtaatgtgtggaaagtgtgagaaaataggttaaagattggaggtcacaacaccgtttaagtgaccagtcagcaaccgagtacgggggacccccgttagggaaggggccgtgccccaacggagtaaagaaacaagggacgaacgcgaaacacagcgacaaagtgggggaaacagaagaggagggcaagcagacaagaccggacaaacgaacataacgagcaccacaaagagagaggaggggagacgcgggcgacggacggcgcagaggacaacagaggggaacgaggggaggacgaggaagaa

SEQ ID NO: 651939 - DNA, 105 bp, Homo sapiens
gggcgctctagacttcttggatctgcgtgctccggcgcttcaggtcactcaggtcgatgggcttgaaggtcttcaggctggggttagggaccttctccacatact

SEQ ID NO: 651940 - DNA, 530 bp, Homo sapiens
caagcaggaagtcaatttttattcttttcataaaacctttttgtaaacatgggccttttctttccatcaaaaatgcattaacaagatcatgcttatagttaggcagaacaagaaaaaaacgacagtttatactgaactatttaagtgttgccacaaagtgcttacaactccgagctgaatgtgttaaccttttcaatagcattcattatgtgacattgtcaccaattacagtaaaagaacttcactaattttagaaagctagaattactcaaaaaattctgcattgtcaataataccaggaatattgcatttaagcctaggatggcgaaattacttaaatcttttctatacttttttgagtaacataggccggaaaatgaatactatataagagagtggaaggtatcagggtcttatgtttgtacctaagagggtttttattttaaggaaagttgactaatacttaaatgattcaaaaaaaaatcaccgttaggtttaaatgccccaaaatttaagaaaagggccccttt

SEQ ID NO: 651941 - DNA, 128 bp, Homo sapiens
gaaacgcagctgagggtccacctgtcaccagaagtctgactttcatgacaccccgggctctcattacccataccacccaccttctcatttagtctttttattttttttaaggtttggaggggaaaaac

SEQ ID NO: 651942 - DNA, 469 bp, Homo sapiens
ggcaagagagaaatcagtcccttgggaagccgtaaaacatcagaacattggatacatgctccgcacattcatctccatccaccccgcagttcccatgggaaaggctaccaagttgtatcagcctccactgtactgcaggtcttctggaatgacaggaagcagccaagccctcttctgtcctcagcggcctctaggcatctagggtattccaagtcctgtccataatcccagacagaaaacagtcacttgggcagccccctgtaaagacagaacgctgaagtcatgctccaactcctttccctgggagaaaccaggagttgggagttttctgctggttccatgctgagctttggaggtggactgtggtgaatgaatgccacaaatgttcttattggagatgcagctggtttcgtgttctcttaagttacagatgcattttaactagtctctggattactcacaaaagaaa

SEQ ID NO: 651943 - DNA, 807 bp, Homo sapiens
taaaagccaggctaataattaccccgtgcacaaggtaacagtcacaaaacagccagccagggcctggtctgggaacccagggggacaattcttcatacacgggtcttgcgggggagatgtatgcaacacagagcaattgggagtaaccctgcagtcccagggaccacagggatggggcatggacaaggcactggacgcagggcctcccagaagggtgttcttcctccgtcgggaaaaggggcttgccagagtgtgcagccatgtggcgggagcgcacaggtgcgtggactgttgcgggacagggccagtgttccccaagagccccttagagaggggtggttcctcgtgagaagaaaccccgaggggccaagatccttctcgaaaagtgtctttgagcgtggttctccctttttgccgtggccccattctgaggctcccggggggtccagggggggcccgtcgtcaagggctccgtgacagggggggcacagaggccaccttaaccttgccaaggaccaccctgtggaaaagtctggggccacaggttccttgaccactttgtgtcacccctttcctcagatggcaggggtggaggcatgggactcaagctaccaagggaagcgaacctggatccttcccagttctctcgggtcaggatctgggaacttccatgcagtcagactccatgccgtgagtagggaggaaggttgtgctggccgaaggaccctttaaacctggtcataaccatggggtaagagccttggctagaggggccctccattctgcccactgagtcagactggttcg

SEQ ID NO: 651944 - DNA, 387 bp, Homo sapiens
cggagtggagagagaacggaacaatatatggcagcagtagaagcttcccagcaatacaggaacagtctacaaagatcatacagcaaataacatcccgtaagaaaagaagcacatttgatggcacaggccattcccgttgtcttgatggatctcttggaaccagactccattctgcttacacttgctagatccaagttcaggtgatcacagtctcagaaacactccttactttgctttttcctacttagtcttacggtgtgccgttctcaagccatgcatattcagggccagactgtcctgcggcagcaattgttcctcttccttcacgtctgctattcgtagaaccatctttagacaaggctgcctattgctgagactttgatttgg

SEQ ID NO: 651945 - DNA, 167 bp, Homo sapiens
  misc_feature (15)..(15): n is a, c, g, or t
ttagcaggagcttantgagttccgagtggacacacttcctatgtgtagtcaatcacgctgaagaactgagccatcctgtgtgggtccatgaaaagagactgttgttttttttttttttggagacacagtttcgctttgtggctaggttggagtacaggggtgcaatc

SEQ ID NO: 651946 - DNA, 681 bp, Homo sapiens
cgggcttttggcccctcaaccaatgtgggaggagtggaattattctcgccacaaggggaagcccttcttttaatcccttagggaaccaacctgtgaatgcccacggtctaagcccaagccatgcctcctaggaatcctggggccccctttcccttctgctccaatgtcacccgccgaggcacgtaatggcggccctcttaccctaccagggccttggtacaccttcggtatacccaactttaaggcataggcctcccagtctgtggcccatattccgcgtgtagttgttgccatccgtacataagcatgagatcgggtcagtctcaggcaccgctgtcaaggtgcatatcatttccggtcaggtttgcagcactgacaggggaatctgtctagagagcttctcggctaatagatacctttcgtcgtgtagcggtctaccttgttcacgagttaggtggcgccttgcgcatggtttcagccatgttcggttctgtgcgtcctcagacagtctgccgacaagccagtgtaccgatgactactaccttagtgcgtgcctatggggcttaagcatgtctattgccggttcacaggttcttcgcagttccttggcatttttaggttcttgaccgccccttcactgctttgctcatgtttcctggaagttggagttaaatccacctc

SEQ ID NO: 651947 - DNA, 429 bp, Homo sapiens
ctatctagctataatcctctgttgttaaacaaacctttctctatccccttccccctacccttcccagcctctagtattatctgtcctactttttacttctatgaatcaactttctttcagcttccacgtataagtgagaacacatagcatttaactttctgtgcctggttcatttcacttagcataatgccctccagttccatccatgttgctgcgaatggcaagacttcattcttcagggccgaatagattcccgttgtgtatatatgccacattttctttatccattcatctgttgttggatatctaagttgattccactatcttggctattgtgaatagtgctgcaataaacatgggggtgcagatgtctctttgatgcacttatttccttgtgttttggagaagtgccagtagtgagagttgctg

SEQ ID NO: 651948 - DNA, 241 bp, Homo sapiens
gcgctcttatgagactcctcccgctctgctcctggcctcctgacagtcagtgcactgaggcaagcatgtggtgaaagggagattgcacaaggcccagcctgctgcccctcctataagaatgcatctggagcacaggttaacacagtaagggcaggttcagacaggaggagtgcgtgaggcagcggcgtccacacagcagccccgagatggggagggctggtgacgagaacttccagctcca

SEQ ID NO: 651949 - DNA, 366 bp, Homo sapiens
gccatcgaggccccgttcaatcgctgggattgggcgctgctgccgctggccttcgccgtcctcatcctgctggcgctggcggcctcgcagatggccaagcccttccacctcggcgagcagctgccgctgagcctggacgtcgcctacctgccctactacctgctgcgcacgacgctgcggatgttcatcgcgctggcagcctccgtcgtgttcgcctgcgtgttcgccgtgctggcggccaaggtgcgcgcggccgagaaggtgctggtgccgctgctggacatcctgcagtccatccccatcctcggcttccaggccatcgcggtcgcgcccttcatcgcgctgttcccgggcaatctgttcggc

SEQ ID NO: 651950 - DNA, 376 bp, Homo sapiens
  misc_feature (2)..(2): n is a, c, g, or t
  misc_feature (365)..(367): n is a, c, g, or t
  misc_feature (371)..(371): n is a, c, g, or t
tnattttttttttgggggacgaagtgtcccctccttgttgcccccaggctggaagtgcaaatggccgtgatcttggctcactgcaagccttcgcctcccgggttcaaagtgattctccctgcctcagccctccccgagtagctgggattacaggcatgctcccacccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatataannnaatnccctc

SEQ ID NO: 651951 - DNA, 1128 bp, Homo sapiens
  misc_feature (625)..(625): n is a, c, g, or t
  misc_feature (842)..(842): n is a, c, g, or t
ggaccaagtggtcctccataccatgcttcgaatgccacggatgggtgacatgctcccacgaggacctgcagcacccccctgtgccaggcggtgtctctgttcgcacatgtgtcctggagaagctgcagctagcaccagtgccacccgtgcatgagatggagccgtgggaacgtggtgagcagtgcctcctcgtcgtgagagtgacccctgatgggacccattttgcgtgcacgaaatttgctagtcccttcgtcatggatgaccccgtactttgagcagcgagggatcagacacacagcgcagggcggatgactttcccgtgcgagatgacccctccgatgtgactgacgaggatgagggccctgccgagccgccccagcccccaagctccctctccccgccttcagactgaagaatgactcggacctcttcgggctggggctggaggaggccggaccaaggagagcaggaggaaggtaaggagggcaaaacccctctaaggagaagaagaagaagaagaaaaaaggcaaagaggaagaagaaaaagctgccaagaagaagagcaaacacaagaagagcaaggacaaggaggagggcaatggagtgagcggcgacgtgcgtgcangcagcggcccccgcgcagcagggagaggacggcttgcctgatgatgctggagtgctttcctggtgtgtgtgctggggcccctgggcgtgcctgccaccctggggtgtggcgactacgatggagctctaggccggcgtgggcagtgtgccgccctgtgggcggggtgtgcgtgcctgtcactgcctggggaggcatttgcctctgtaccatcgccttntgccgctgccccgtggcttgccgtgtgctgcttctgagcttggaagaggccgggcatttggtggtccccagggctgggccctgcagggtgctgggccttcagggcccagtgtgagcctgctctgcaagaagggaggggacagctggcttcagccaggctcggtggacactctggccctctcggggcagagccgccagtgtttctcagggatgtgactgaggcccaggagggactgtgagggtctgtttacagaggctgggcatggggccgcttggctgtgggggtg

SEQ ID NO: 651952 - DNA, 216 bp, Homo sapiens
ctgcgttctcgtgcctcattcaggaggggctcggcaggtggggggtgcgtctttcccttgccggagccccaatgactctgccggctccctcgctttggtagcagcactgcccacccttgtctcgtggtcgttcccccgcgctcaatccactccagctaccccgaaaggcatccatcagtaggcctttctcgtcctttgagggtttgtatttccgga

SEQ ID NO: 651953 - DNA, 230 bp, Homo sapiens
tgcttactgggcgtatgtcgaagttgaacgattagtcctgccgtagtcggtgtactcgtcagttcagtaccatatggtggccaattgatttgatggtcacgggagggatcgttgacctcgtctgtcatgtcaaggatgcgtcaggatgggagggcgatgaggactaacatctcagacgctcaggaaatagaaaacgtctgaactatcctgaccgacatcatcctagtcct

SEQ ID NO: 651954 - DNA, 350 bp, Homo sapiens
gggcagccgcgcagacgtctggcgggctgtggcagccgcgcggaacggcggctttccgcacatcccgggtggtggtggtggccaaaccaccggtacgagttcgagccagcagcggtacgtacgcgagtctctcgagagactgaagcagctgcttgcattgaaggcctagttacagtggacttcttgaacgacatcatatccacaccaaatgtagaccatataatggatggtttacggaatgagggaattgaggtccgtctagtaaagaggagagaattatgatgaagagactgtccgatgggcagatgctgtcatagctgcaggaggtgatggcacattgctgctggcag

SEQ ID NO: 651955 - DNA, 524 bp, Homo sapiens
  misc_feature (403)..(403): n is a, c, g, or t
  misc_feature (461)..(461): n is a, c, g, or t
  misc_feature (482)..(482): n is a, c, g, or t
aattcgggccgcgtcgatacggctgcagacgacagaaggggctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctctgtcagatggatagttgtaaatttttctcctattctgtgggtgcctcttcacttttttgatggcttccttgctgtatagaagctttaaactaatgtgatcccattgtccattttggcttgatgcngtgctaatgggggaatactcacgtcttgcccagactgatgtcaggggagtttcccaanggtttcctgtagtagtttcanagttggaggcctagattggcctttccatttgattgcctttcc

SEQ ID NO: 651956 - DNA, 119 bp, Homo sapiens
  misc_feature (7)..(7): n is a, c, g, or t
  misc_feature (18)..(18): n is a, c, g, or t
  misc_feature (48)..(48): n is a, c, g, or t
tttggtnattaaaatggncgttgtttagaaatattgtcacaaaatganaatttaaaatgaattgtaaaatttaatctttaaacaagcatttattcaaactggtgcatatctttgagatc

SEQ ID NO: 651957 - DNA, 380 bp, Homo sapiens
gtggcggagttgttattaaaacgtagacccctgcgaaaatttccatggggaagattactatttctgaggccgaatttctggacatgacagaaaacgcaaaggttaagacttaggacaaggaaggaaccttcttcgactagtagagatcgactcccgtcggtaagtagtcggaagacggatgcatcccgctcgatcataacacctaaaaggagctcatctcctactccgcgccgagatcctgcggaggcgtcaagaaaaggaagaagaagctccatattatctttaagaagaacaagtataagagaaagaaggccaagtcggtcgcttcgcaccacaaggcggacgagcggtccagctgttcctgctgaggcgtttcctcg

SEQ ID NO: 651958 - DNA, 152 bp, Homo sapiens
gggctcccctacactgtctcatgctactgaataagctcatgagatctgagtttaataaggggttccccatggacttgtttctcattctctcttgcctgctgctatgtaagacgtgcctttcaccttctgccatgagtgtgaggcctcccccg

SEQ ID NO: 651959 - DNA, 339 bp, Homo sapiens
agacacttacgaatggatcatcatctatttcatccttgatccttagaagaatctaacttactatcttatctcttatttgtcgagttgcagggcgttgatggtgaattattcttcttatctagaatgttacaccttattcattttaaataaggaaaaacaaggtttcagtcctggcttttttctgatttctgtcccagttttcctatgctttgaaacaaagatcataatatctctactttaaccatttcacaggattactataaggcctcaaaggaatctactgacttttcatctttccaaatcttgtgagattgaaacttttaattgtatttttactat

SEQ ID NO: 651960 - DNA, 184 bp, Homo sapiens
cccgtaacacttccgtactagttaattttgagtaattgtattgtcagaaaagtgattagtactatttttttttgttgtttcaaaaaaaaaaatttggtgtgtgtgttttttttttggtggttataaaaccaaggcatgcttgtggataactctgtaacaaaccattgggaatggttgaacctgc

SEQ ID NO: 651961 - DNA, 858 bp, Homo sapiens
ggctgtgagactacctatgtagatatggcaccctatgacattggtggtcctgcaatcaagaatttggtgtggacttggacctgtttgctttggataaaccaaactctatctgaaatcccacaccaatcataaaatgtaaactccagttatgtgttcctcgtgtgtctaaatctgatcgaccggcaggtgcaagtgaccgagaaatagttccacgttatttacttgtccagaagatgtctgggagacagtataaattgacataacgacaatctgatacgttctctttctttgctggtaccgaccaaatacgaattcagaatgcttcttgtgtgatcctttataccaaattccaattccaacacaatgtctcagctggtgctatatataaaatacaaactgcatcactctgttatgataacaacactgtgtgtatattctttgaatccgtagtcccatctgcaagggcaatgactgtgctcacgcagtgaaagataacctttctttctgagatagtgaaataggaaattagagttagccctcgctattttggactacctcaactggtcaggaacacaggttgtttctatgagtctagaagatgaagaagattttatacgtgataaagttatagttcctgattatgtcgggagacgggtagcggaaggtcggggcaatgtccaatatttgaggcgcatatttatgtggatacggggtaggggccctttcggggaggggcgcaacaatgggggggtagaggggaggggaggatacggtcaaacaaggggggttcaaaaggcaagtggttcccagaaggggaggaagctagtaggaaacaggtgcggagagaaatagtggtca

SEQ ID NO: 651962 - DNA, 323 bp, Homo sapiens
ccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtattgccaccccgtctgagaaatgaggagacctccgcccggcagccgccctggtctgagaagtgaggagcccctccgcccggcagccaccccatctgggaagtgaggagcgtctaccccgggcagctg

SEQ ID NO: 651963 - DNA, 129 bp, Homo sapiens
gcctccgaatttgctgggattataggcatgcttcaccgcgctgggtctttagacagtcttcattttatatttctagaatgcacatttcacagtgattataaaaattattaatatattcaaatctgggta

SEQ ID NO: 651964 - DNA, 850 bp, Homo sapiens
  misc_feature (850)..(850): n is a, c, g, or t
cgtcagagtgtggtattatctatgagaactgtgagcgacagagtatttctgtgatgaatttatagatcatttgagatgtgagttacttaagtttagtttggtttggttttttcaaataagtagagactattgtaaaaaacgagaaaggacactgaaatgtgcgtgttgatagcaataattggtttcttttaaagattctaaaaggtctgagacctgtagcattatttattggagtgccctcccttctcccctcccctcccttttctcttctcttttttcctctccgtctccttctcctttattcattgtttgctttggagtgggtgtggtccaagtatctgtggttgggtatctggcatttgtgttcccaccatccccgttcccccattaacttcccccctgttgtgcatcctgcagtagtatacctcatgaatacagaccataatttggctgtgtagtataccttggagaaactggcggtttatttccattattttattccactatatctatgataagatgcaattattaggagagacagtgacttgtttctaatgggataaggcgcaagattcttcaggaacacagtgagtacacaactacttcagtggaaccattttttagaggcacttaagggtctcgtggttccaatataattctttgagttcattttctcgtggaatataatggcgtcttacaggctttaccgactttagacacgcgtattctgggagaaaactgaggcccctggggtccacattttccatccctgttaccagtgcgtggtctgtacaaaactgctccctgacttgaaaccccatggaaggggttcctcttagaggagacccan

SEQ ID NO: 651965 - DNA, 280 bp, Homo sapiens
agtattcagcgttcctacactattaaagtttacacgagcagcagcccatcatactctttcagccgacgagcaccaatcctacctccatcgctaaccgccactaaaacactcaccaagacctcaacccctgacccccatgcctcaggatactcctcaatagccacctcaagcccctgacccccatgcctcaggatactcctcaatagccatcgctgtagtatatccaaagacaaccatcattccccctaaataaattaaaaaaactattaaacccatataa

SEQ ID NO: 651966 - DNA, 295 bp, Homo sapiens
gtcctcgtggaagtgacatcgtctttaaacctgcgtggcatccttgacgcaccgccgtgatgcccagggaggacaggccgacctggaggtccacctacttccttaaggatcatccacctattggatgattatccgaaatgtttcattgtgggagcagacattgtgggctccaggcagatgcagcagatccgcatgtcctttcgcgggaggctgtggtcgctgatgggcaggaccaccatgatgcgcaggccatccgggggcaactggagaccacccagctctggagaactgctgc

SEQ ID NO: 651967 - DNA, 306 bp, Homo sapiens
taaatagacatgaggtctcaaactcctggcctcaagtgatcagtctgcctctgcctcccaaagtgttgaaattatgggcgtgagccaccacacccagccataacttcttagcatgatttttcccattggttatgatttcaatggtgcctccccacaaaagatatgctgaaggcctaaccctcggagcctcctaacgtgaccttattgggaaatagggctgtggcggatataactggtgaagatgaggtcatacgggagtaggagggggatagaatccaataggaccggtgtccttataagagagga

SEQ ID NO: 651968 - DNA, 1010 bp, Homo sapiens
  misc_feature (1009)..(1009): n is a, c, g, or t
atttcggtgcacatctcgccaccgtttgtcaccccccgacggatggtcaaggtaaggccttaaagggctgcgtccacgacgagaagtaaagtaagcacgaacggaaagggcgccgttcgacatatcagtctctgcctctatgataactgtcggcgatacgccctacgatacccactttttctacgcgctccgctgggcccccccactacacttgggggccaacaacggcttattcacttattggtggtgtgtcttttgggctatatcatgtgacgataacgcgcgcagtgcccactgtgccacataccgtgccgaccccgaattaactgcttcacgtgatgacgacgataaacgtaacgtgatcggcccacttaaaaacggcgctggactgaacgtcggtaatgtcaacaacgggttatttacgaattttctgtacaataggtcaaatggcggtaaccggaaaaacttgcggctcaatcctacggacattggcggtgtaaacggccgtacgaacttcataaaacgtggcctggctaaccatagcaccaccggcactaaccctctgggtgggaacctgacgcgcctgcataataaccgcggcctggtgaaattcggcaacacgccatctggcggtgacctgcgcaaaaacatgcctgatttcggtggaaatggcctgaatggcctgccactgggtaacggtggtggtcgcaattggaacccaaaccaccctgaaccttacctcaactcataatacgactataatgggccttctgtcggtaataacggcggtggcgggaacaacggccacaaactactgaatcgtaacgacgcttaccaaccatatggtgctccactgtctcatttcctgcctgacgtcaataatggcaatccacgcaatccttttaacctgggtaatgggtacgctggtaaactgggtggcttcggcggcctggcgtacactacactgcctggatatttcggatacggcgctctggcacgtctttaaccnc

SEQ ID NO: 651969 - DNA, 848 bp, Homo sapiens
gggggctgactgatacgcgtctgtttgatgcgtgactgttctagcattggctatagaacacagctcagggtactcccactgtacttctacctttacctgcacgtaactggacttctgaatttacactgcactagtatacgtagcgaacgcgtatcaataatatcctgccagcaatagtacgctgtttgctgcgcctcatttcacgccagcaattgaatgcagtgcttcagatacttgtccattcctgacacaaacttatgaagcttaccatcattcctaatgataacttcattacacccgaaagtaggccaagccgtctgtattattaagccttaatacaactcgttcagcgtaacaagaacttcactcgctttataagccttggcatgcagaacatctaatacttgacagaactagacgcttgaatcgattgcttctcgcaagaggaagtcgagcacacgtacttaacgcaaggaccttggacgaatgaagacaacactgagggaaatcgtggcgatcatccatggaagcttgactaaacgcagacagatagagacgagtactgacagtactactagtctaagactcatgcccaagtctacgttgtacatcttctaggagatagcaactcagaatatacatagagagacatgcgttctcaaccctggtagaagcgagactgagcaccagtgactcctagaactcatctaggtcccacgtcgttgctgcatgggcacgacaagagacacacgatcatgatgaagcttgtctgcgaagactttgaataagctatgatgtcttagagaaaacgagttgtttgcagactttggcatgacaactctggaaca

SEQ ID NO: 651970 - DNA, 1931 bp, Homo sapiens
gcccggctgttattcagccggatgagagagcgagcgcccgtcgacgcgtgtcgcagctccggttgccatcgtgccatgtacccgttcccgtcccgtccttttctcgttcatcatcatcgcagggtcccgcggctcgaacacctgctggtctgtcgcgctgccactgagagcacgcctgacggcgctcattgcgatgatctcattcgataattgcggacccttcgccacggcgtggtactatcgtgcggcagcacacgggctactgcgcgccccgtcaccatgcgtaacactgcagtgcgccattcgtagggtctatgtccgaattgtgcgcttgcgcactatacatgctaacgacatgcgagaggaccgacttcccccgagtggtaggaacctacggacccatgtatatggacggagacttgcgccccctcttggtgagccattacttctcgatggatccaacgaaagaccggccgcacaccatgttcctcctcaagtgagatcgaaagggcatgcgatcactctgggaaaacgctaaactgcatgggaatcttcgtagtagcctgcacacggtgcaaggaaataggcgacgaaaggtagccctctcgcccttttgtcgccaccctttgggatacgccaatgggaacaaaccagtgcaaccgagagtggccaaacgcccataagacccgttaacagggggacagccagcaactttggttctcgaggaggagagcgccattgccgttgttttggacgccccccaagtgaagaacgcccaaagggtggaggggaccagcgccggggtttgccaaacagctaatagaccgaaaggccacattttgggacacaacggcggatgatgggcaagtgaaggacgataccttatcagcagaagaaaaccacgaaggcgaaaaaaagctatgggcccaaatttggtccagacccacttagggataagggcaagcgctggcatataaggatgatggcccaatgaaggataccgatgtacacagcgatttcgcaacgggcgcaaaatgtacgacacctccggaacaactgagggtgggccggttgccccttatagcgagacgccaggagaagcagggcaatttgcgcattggagacttcgcactttccccctgtgcggaatgtgctacgccccctcgcgcagaggagggaggacattgccgcgcgaaggaacgagcgcggcaacacacagccacagcggggcgccacgacacgggggagagttagaaaagttacacagcgttcggaaggccaagccaaggaacatcgccatgggttttggagtcccagggaaaacatccgtgactctccggcaacaggaagcgtgagacatcagcattgagggtctttgtaccagggaggcacaggcgcccacagcggaacatggcgccaggggagaacacccacctatgctctggacacagagagcgccccggaagaggtagagtatatatagtagggcccagatggcctgtgaataagccgaaacatacatccagcgggggacctcaggaggcgcaatatccgatagcgacaattgggcctagaacccgtgtcggaaaggtggcgatccctctaagcaaagggaatgttgcccagcaagaacggccccggggcccaaagcgaggccaaagtgcccatttcctgggtgaaggggcccaccctaaaccgaggttggaacagcccccaacgccgttagtagagcattcgaagacgtctcaattagcgtaggaggcgccccaccgagagatgcaccatagtcatcaagagtgtggctccgcaggcaagtgtgagtcccccgcaggaaccgagagcgcagttcattcagtgaaaacgccgtgccaccatcttgtacgagagaacccatcttgtctgttgaagacttagacagtgcgcatcgtcgt

SEQ ID NO: 651971 - DNA, 1003 bp, Homo sapiens
  misc_feature (246)..(246): n is a, c, g, or t
  misc_feature (256)..(256): n is a, c, g, or t
  misc_feature (407)..(407): n is a, c, g, or t
  misc_feature (409)..(409): n is a, c, g, or t
  misc_feature (943)..(943): n is a, c, g, or t
  misc_feature (1003)..(1003): n is a, c, g, or t
atttcggtgcacatctcgccaccgtttgtcaccccccgacggatggtcaaggtaaggccttaaagggctgttacagttttggaagtgcccgtagggattgggacgagtggagtagggggagcgtgtggtgtaaaagttggagaagaacgatatgagaatgggattaaaataggatacatacggctaagaggaataagtgtaattacggtgacgaggggcgaaggaaatacgggagaaggaaatacnggagactganaagaaagatatgagaacaaggaatcgttcgggtaggcgctacatgggccggtggggccgagtgatgggttgggtaaatggccatgacgtacgtgctaacccggcgtgggaatgttcgggggttacacggtagtgggctgcgatattctgcnanaaggatccgtgaagggatatggggtgaaattggactctcagggataaaatccttaaaccgcaaccaagaaaaaccaaacattactcggtgcgccgcaggcggtacggtacactactatgaaaccggtacagaggacggatgggggcacgttaacggcgggaattgccgatggggcccggcctgtggtcaagcggcatgttacggaattgccgcgtttaacgacgggacgggatgggttaagctaataggaaacaataattctagtgtgcattaagcaccgtacattttttctattttttttgcgcaccggtatacatatgtagaaacggttggcgggacgtggtgacgtatgggatacatgaccattatgaataatgggttaccgagcttataatcaataccaataaagcgtcgatgggcttctccgtgaaacaacaacacaatggatcctttatgtcttttttggtcgggcaggggttaacactgttcgaacggatggtataccataatgcatacggtgctacaatgaatacnataacccgtgatgggctcacgggggcacaacacaacgaatcgagcgtcataccaccatgn

SEQ ID NO: 651972 - DNA, 690 bp, Homo sapiens
tcctcaggggtcactgaggctttttatttggagcacaaaaccacgggggatctacccgggggccaccccggaaataacacgaggctcacttgatctctaaacactggggggaaaggggagggcgaagaaaaacaatggactggggccaattacacgactggcaaagctagagctggccaacggggccccggggagctagggctcctggtaggaagtcctaagggaagcggtacagaactccagggggggggggcgctaactagcggggccccctgcaagtgtggttgggtcggggggcctcgagctgcctgagctggacaccgagggggaggggtgtctggtgtacgccaacgggtgaccagaggggtcttgcctggcccacaggtcttactggggccaggggggttcctgaatgttcctggccggcaaacttagccttgcgtgcggaggtgcaggctccggggtgctatgagggctcgaggccatctccgtgggccgccttgggggccactcgtggctaaacgggtcacggcggggccgaaaggtgggggctcgatacgctgtagaaggcatcaccatttcgggcaatttctacagaaacacgttgaagtaccgggcttacctccgaaaggggatgaacacaacccttccgaggccctaccatttccgggcccccagccgatttcgggg

SEQ ID NO: 651973 - DNA, 966 bp, Homo sapiens
  misc_feature (190)..(190): n is a, c, g, or t
  misc_feature (320)..(320): n is a, c, g, or t
  misc_feature (383)..(383): n is a, c, g, or t
  misc_feature (510)..(510): n is a, c, g, or t
  misc_feature (526)..(526): n is a, c, g, or t
  misc_feature (542)..(542): n is a, c, g, or t
  misc_feature (959)..(959): n is a, c, g, or t
atttcggtgcacatctcgccaccgtttgtcaccccccgacggatggtcaaggtaaggccttaaagggctgtttttggttccgtttatggccgcctcacctgattttctcttggccgtctccgttttgcgtggacttgttgaattatccaccgatatatgggcattttcccgttttcttcatcttcttgancctgtctgcttctggtacgcgcatttaccaaacaaaattaatgaatcaaaatggattttaatacacccgcctgtatcgcacccacgacgattcgtataatgcacaatattgtggggtgactgttaatganaacggtctgatgttactgtggcttacttaacttacgtggaaaattggggtttgactgaacgtnccgagttcaactcgccgcgaacgaagtttgtgttagattggtcggtgtccgtcctcgacgaaattcgaacaggcgtatttctgtggtttcttaatgaccggttgttttcccatgccctcgccatgancgtgtgcttggttgcnacgaccccacgatganatacttttgttttggcggccaaaaggtggtttgcacgaacggcgcccggaactctgtgcccaacgtatattgtggcgcttggccctaaaaaaagctctttgggacgcgaaacccagtgactgactgtacatacccacaacgccgtttgcctacgcggtatgcgtgcaatattttgtggatgttattgctggtttaacggaatagttctgactggtttgattgctgaaacttttttgtgaattgtgatgttggctggtccagcaacatacaactgtcccacacgtcaatacgttttatgtaacacgatgacgtagatatgtaaatagtgattacatgtgggacgaacgggcaccgattatgcccgacttgtgctcaaaccgtactcggtgattatagtctgtgccacggtgtacttancacgcta

SEQ ID NO: 651974 - DNA, 125 bp, Homo sapiens
ggaccacgtattcggcgcatttcaggcagcatcttttccagatccggacatgccggtcataaaggctcagctgtttcgcggtcatgtcgctgatccagaccatacgctttgtggtgtgccccctg

SEQ ID NO: 651975 - DNA, 957 bp, Homo sapiens
  misc_feature (273)..(273): n is a, c, g, or t
  misc_feature (948)..(948): n is a, c, g, or t
atttcggtgcacatctcgccaccgtttgtcaccccccgacggatggtcaaggtaaggccttaaagggctggaaggatgggagtgagatagataaaagccgaaggggatgggaaggcgaagggagcgggatgggcgatgggaagggtaaggggcacgagggagcggggacgatgaaggcgaagggacgaacggaagatacgggacggggcacgatggagaaggttatgaggtataaggggaaacgctgtgcggaggaggagaaaaaggaaagcncgagacagctgggggaaaagatagaagtcgagatgggagaaataacatcaatggacattttaatgaccataggaggagaacagaggaaagaaggaacagagaaatgggcaccaacagtataaggaacagaaatgttacacgcgcacaaaactgcactgcacgacaggcagggagcggcagtggcgctggaatgataattaagaggacggattaaaaataatcatagatggcgctaacgtggtggtctgtcaggcgaacaagggcatggcaagcaccgacggagtgggaatagccaacgatccccgactatacgacggccgcagacgggccggcggaccaacccctccgtgtggtaccggtggtgggacgaccactataaacaccgatgagaatgtaaagggtgccgaaacaggcagccggacaatcagcgtgaagagtactagcattacgagcaggaccggaaaggacaacaccggtaccggaatcaatgagggtgacgaacggggcgccataagtaatgactatgaaagccgaaaataaagaagagaaagaaaagaagaaaaaaccgaacggaccggcgatgcggccgagataggtggcaacggcggaatgacgaatatcgcatgctgaaaatgaaaaagaaactaaggaaaaacagatgtcacgcgtgactgncggcgaaga

SEQ ID NO: 651976 - DNA, 492 bp, Homo sapiens
  misc_feature (19)..(19): n is a, c, g, or t
  misc_feature (22)..(22): n is a, c, g, or t
  misc_feature (40)..(40): n is a, c, g, or t
  misc_feature (58)..(58): n is a, c, g, or t
  misc_feature (153)..(153): n is a, c, g, or t
  misc_feature (185)..(185): n is a, c, g, or t
  misc_feature (300)..(301): n is a, c, g, or t
  misc_feature (310)..(310): n is a, c, g, or t
  misc_feature (417)..(417): n is a, c, g, or t
  misc_feature (422)..(422): n is a, c, g, or t
  misc_feature (473)..(473): n is a, c, g, or t
  misc_feature (479)..(479): n is a, c, g, or t
ttctgttggtgccaaccgngtnggcacgtcatgtgatcgntaacgattgacgaatganactcataaaaaccacgccgactcttaaaatcaaggataacgtccgccgcgatacattcagtcgccggatttgttgccccaaacttataggtcgtntcattaacaacgagatcagcaccaggtgcggntattgacaggccatcttcaataaacgcaaaaacagggaaagcagcgccatcaacatagaacacagagcgcaaatcatcgcccttattactcatcattattgagtgaatggctcgnncattgtttngatattgccagaacatgccataagcataacgccccctgtcagtccagccaccaggcataacaaatccgttaaactcgcagttattcatcggatcgcctgcggttcgngttgncgtggtgataatgactcttgatgccagttcgctttacttgagccagcagancgcatnacacaaacagggt

SEQ ID NO: 651977 - DNA, 943 bp, Homo sapiens
  misc_feature (500)..(500): n is a, c, g, or t
  misc_feature (623)..(623): n is a, c, g, or t
  misc_feature (935)..(935): n is a, c, g, or t
atttcggtgcacatctcgccaccgtttgtcaccccccgacggatggtcaaggtaaggccttaaagggctggggtttgcggcggggctaggcctgtggataccgttagggcggagttcaatgaggcgggtttgcggacggaaacggcgagcgaaactggtattaagcagaggggaacggggagggaaaacggctaaggcgattagtgaggggaagcgtaacggtttggggaaagggcggaggggaacgttcgggagcgggtaaatgggctagtagggtacggaattgggatccagtcggacatatagacgttaataagaattacggccggtattttacgacggggaattcagggtgactgattaggtaatggcggaattctaatcgaataatataactacgagaacaaagtatggggaaagcccggcgggcgatttaaatatgtaaaaacgaatttggcatgtacgacccaccgaacttagttactaccctcatttttccnagaatcaactgtgaatgcaccgggcgctgtccaggtgcccccccatcggtgtggtaacggaaattacggggatacggtgatagtggccgccgtggcacttgccgtcattctacacaccctccngctccccctcagctcgagctctatcaacagccgatgttgttaaaacaacgccaaccctgcgagaccgctatgcacccgcccccccccggttactattttcttaataacccacatttactttccctaccgcggctgggctgtggttcttgatgtgtttttcgcacgcctaccaggtttatgggtatgcgctgttgactcacaattatacgtaaatgtctaatgcgctggcgtacaatgcgcctaacacgaccgtaatccaacgggctgggtatgggtgcttccggccggttggattacgccatgggaacgggncatgattt

SEQ ID NO: 651978 - DNA, 892 bp, Homo sapiens
  misc_feature (218)..(218): n is a, c, g, or t
  misc_feature (235)..(235): n is a, c, g, or t
  misc_feature (238)..(238): n is a, c, g, or t
  misc_feature (252)..(252): n is a, c, g, or t
  misc_feature (257)..(257): n is a, c, g, or t
  misc_feature (268)..(268): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (293)..(294): n is a, c, g, or t
  misc_feature (305)..(305): n is a, c, g, or t
  misc_feature (325)..(325): n is a, c, g, or t
  misc_feature (332)..(332): n is a, c, g, or t
  misc_feature (337)..(337): n is a, c, g, or t
  misc_feature (349)..(349): n is a, c, g, or t
  misc_feature (359)..(359): n is a, c, g, or t
  misc_feature (382)..(382): n is a, c, g, or t
  misc_feature (395)..(395): n is a, c, g, or t
  misc_feature (402)..(402): n is a, c, g, or t
  misc_feature (404)..(404): n is a, c, g, or t
  misc_feature (468)..(468): n is a, c, g, or t
  misc_feature (488)..(488): n is a, c, g, or t
  misc_feature (494)..(494): n is a, c, g, or t
  misc_feature (507)..(507): n is a, c, g, or t
  misc_feature (513)..(513): n is a, c, g, or t
  misc_feature (523)..(523): n is a, c, g, or t
  misc_feature (527)..(527): n is a, c, g, or t
  misc_feature (540)..(540): n is a, c, g, or t
  misc_feature (550)..(550): n is a, c, g, or t
  misc_feature (576)..(576): n is a, c, g, or t
  misc_feature (880)..(880): n is a, c, g, or t
atttcggtgcacatctcgccaccgtttgtcaccccccgacggatggtcaaggtaaggccttaaagggctggcggacggagatagatgcggaccccggcggagataggaaagaggaatgcacgggcattcgaaagacgcgctagcaaaagagagagtgcaaaacacaaacaaacatactaactatctaacataaatgagaagaataataaacaaatgcnacgcgaagaagcggctnctnccacaaacggcacntcatnttttaaatttncgtcnatntaaaacaanaacgtaannacggaacttgntaacgggaatatgtggtganaatactnaaaanacaaacatgtanccgctaaaanagatagggagcgagagggaggangggctaattaaanatacaanancctctctccggcagcgaccgatacatgtacaaacggcaataaatgatgacctactggccccaanacactagtaacattaacgtntaaagnacaagcggtgccngtatantattgggctnaaanaataaaacaaacncgaatgtttntcaccctaaacactggcttcttcaangctgggcgacccgccggcttgttcgacatgatcgcgtttgatgccgcgccgctgcccgtgccatctgtattactatgattacggccgggaagcgccgcacgcgataacataatgccgcaattacgattattgggatttgcgcttgtcagtaacggaactaaatgtgtaaaatataggaacgctgtgctgttactggtttctaaaatggcaacgccattgtaagctgcggcatcctcgtactcgcggctgatttcaaaccgcgaacacgtgggggccgcggggccgttcggacgaaatgggcacncagcgcgggaaa

SEQ ID NO: 651979 - DNA, 167 bp, Homo sapiens
  misc_feature (78)..(78): n is a, c, g, or t
tcagggcggagcctggtaccctcgaggtcagtcatcgttacccgcagcggcgccattttgcccaaaccggtgaaaatnacttcggccttctccgtggtgttctccattgtgatcccctttctctattgtcgggacactcattagcaaggactttgctgctctacttg

SEQ ID NO: 651980 - DNA, 904 bp, Homo sapiens
ctcctacactctggccagagataccacagtcaaacctggagccaaagaggacacaaaggactctcgtaccaaactgccccaagagcctctccagaggttgggggtgaccaaatcatctggagtctaaacatatgaataagctctatatgaatccaagacaagcaacaaacccttgaatgattattcatcacttggatgagtgctcacacacgtcaagctttggagaaagtgtttgactgaataataaagaaatccatatacattgtgcatgagctagatggtcctgcctcaatctggtttatgaatcaatcgtgacgaacacctttctcctgatggtccagtatgtccccaggattatgtaggtagacccatctctgacagtttgagccgatttcacttggatgatattcaaatacgtctctgtgcttacgagagcatgcagtatacacgtcatctagaagattgacaacaatcttctgtgtgtcaggccgttgagacttggaatcaagaatgaagtgtggcgaagactggttagtgtggaagatatagtgtagcacactgattaggttatggtaaaatgtgtacaataactattattaagaaaaagagtggatgacatttgggagcaagtgtactatgttgtgatagaccaattagttgttattacgtgccataagtgaagccgatgattattcgaaaaaatacaattatattgttctggggggtggaactacactaaagaacggcgcgctgctcaaaaatttccagacaagggcccaatctttggacaaccaacctaatgacaaaccgggccccgaatgagcacataatacaataagaaggccgcgttaactagtacctggaaaacgcgacagcgttgggcaagcccaccgggtgcgagggc

SEQ ID NO: 651981 - DNA, 805 bp, Homo sapiens
tctctctcctcccgccggcccaaaatgccgaagggaaaaaaggccaagggaaaaaaggtggctccggccccagctgtcgtgaaaaagcaggaggctaaaaaaggtggtagaattccccgtgttttgaaaaaaggcctaaaaattttgggcatttggacaggacattccagcccaaaagaagacctcacccgcttgtgtgaaattggccccgcatatattcaggtttgcagccggcagaagaagccatcctcttattaagcgggtgtgaaaagtgtgccttccgtgcgaatttaaccgagtttcacccgaggccccgtggaaccgccaaaaaagcttactctcgagctgtgtctttaagctgtggcccccacaaagttcacgagaaccaagaagacacaaagagcagagaagaagagaaaagcgagaagacacgtggtgtggccccgggccccgaaaaagaaaaaggcttgtgtgggcccaaaagggggaaacgttcccaaaagcgaaaagaaagaacccaccgtgttccttctcggaacccagggagattttaaacaaaccggtcacacccacctttggttgcggagaacaccaagaaaagagcctccaggctgtggtgtgcggtgatttgtgcaagccaaccgacccgtgtggatcttccgcaatttcagaacgccgggggtggcaccttatcgtggtcctgtggccccgtggagtgtgtcgggctaaaacacgtgggggggctccccttataccggtggcatttaatacagaggggaacacgggacaaaaaaccgtggtggac

SEQ ID NO: 651982 - DNA, 103 bp, Homo sapiens
cgtgctctgaactaaggaggtacaggaggtggaggttgcatgtgatgccaatgatccatgccatatgcactcctgtgcctggtgcaacagagacaagactcct

SEQ ID NO: 651983 - DNA, 93 bp, Homo sapiens
tctgaggacacggccgtatattactgtgcgagaccgcaggcatattgtggtgctgaatgctttatgcgccctcttgaatactggggccaggga

SEQ ID NO: 651984 - DNA, 1068 bp, Homo sapiens
  misc_feature (188)..(188): n is a, c, g, or t
  misc_feature (237)..(237): n is a, c, g, or t
  misc_feature (247)..(247): n is a, c, g, or t
  misc_feature (286)..(287): n is a, c, g, or t
  misc_feature (515)..(515): n is a, c, g, or t
  misc_feature (554)..(554): n is a, c, g, or t
  misc_feature (708)..(708): n is a, c, g, or t
  misc_feature (782)..(782): n is a, c, g, or t
  misc_feature (1068)..(1068): n is a, c, g, or t
gcatcgagcaggtgagtcagctctcggccctgtgtggatgcacagcgtggactaccaccggctggccgtgcagatcctggacgagctggcggagaagctcaagcgcaggatgcgggaagcttcctcacgccctaagcgggagtataagctctgaagccccgggtagcccttttgaccttggtagagcnctgtagcagtcctaactgggtggcttcccctgtcgatccacagaccccnagatcgcagncttcatcgtctttccgatcttccgacaagcccatccggnncccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcaccccgtgtncccgccccgcgccctccgtccacactggccggcgtaccncctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgttntacacatagcgctgactcccaacaggtgacaggctaccattccccactccatggcgccagcctcctcccccgtncccaacttctcgcccagctggcgaggcgggcaacactaaggtgctcttagaaacactaatgttcctctggggcagccccaactccgtcctgacccgacgggggcccgagcccactgcctaccctcgagtcccgcagcttaacaggatgggatcgagggtcccatgggagtggctcagagataggaccctggttttaaatccctcaccagctggtgctggtgatagggcctggccctactccaggccaatgagccacgactcaaaacgcactccttctctcaagcan

SEQ ID NO: 651985 - DNA, 610 bp, Homo sapiens
gacacccaagggcacgctcactgtggtcgtctgcagtgcgcagacgaagaatttcagggtattcgcctttcaggggagataggcgggcctaacttctgacgcgggacttgatagacccctccccccaactccgccagctgcgctactactgcgcaaatatgaacggaacctaggcgcagctggaagcagacttctcagtagcctgggcgagaggagttcctccgcttggatagccagcaactgcactttggggaatgtacggggggtatctcctttctcctgcttgtgtgaggtggtacacagtccccccttcacctggcgggaagcctgtcccggacagaagctcatgtcagctatccctggggcagcatcgggggcagcagctccagcagaaacagcaggatctggagcaggaaggcgctcgaggccacacagggactgctggccggtgtagatgggccccacccctctgcgagctgcacagcctcttccaggccatacgtgaagagggagagcaggctaatgcgcaagattcatagcgtctgatggcctggggaggacccagacaccaggggcaaggtgacatgagggtggtaaagtgagcatcata

SEQ ID NO: 651986 - DNA, 469 bp, Homo sapiens
ttcacaccagcaaagagtagtggagaatgtgtcactgcagacatttctggcacggaggggaccaagtggaaagtgcttaaatgtgttgcagggatatcaaagggactgagctttggaacaaagaggaacagagcccaaaggacaatgggtacaaattacacaattttcagtgggttctaataaagttctaggaaaaggggcttatgcacaaaggctgagctcttgcctctgtggttcttcaaatccaaaaggtcattaaaatactagtagtggttgtcatattttaataacatttgggatttgaagtgtgtagctgaaacttactcttggttaatggatgtatcactgggtgagcttctagactgcctcaccaatggatctagcattaccttggttaatgaaataaggtaaaacacagtccctgtgtaccagaaagcaggttcatgtgtcagctgcatcatgtcatttg

SEQ ID NO: 651987 - DNA, 162 bp, Homo sapiens
aatcatcggcacttcgctatcatcggcactcgctatcatcggcactcgctatcatcggcactcgctaattcatcggcacatcgctattcatcggcaccatcatagccaccatcaccctccttaacctctacttctacctacgcctaggtgtcgatgaatagc

SEQ ID NO: 651988 - DNA, 219 bp, Homo sapiens
  misc_feature (9)..(9): n is a, c, g, or t
tcctcctcntcagtgtgaatagctgagccaggacttagttagagtgaccgagtgtgacaccctgtcctcctcctctcagtgtgaatagctgagccaggacttacttagagtgaccgagtgtgacaccctgtccttctcctctcggtgtgaatagctgagccaggacttacttagagtgaccgagtgtgacaccctgtcctcctcctctcgggtggtgga

SEQ ID NO: 651989 - DNA, 833 bp, Homo sapiens
gcagcaactacattccgctgataatgtatccatcacctatataatgcagaagcccgtctagtcaggatcccttcttctgcttaaggtccaactgtagtgcagtgtcttaatcatagtctatcatcatatattttaggagaatcttaactgtaagatagtgatatatgacgcaggaatgcattatttagcattcattaagtttctacaggcaagaggtagttctatttgctatggatactttcttcgcgtcatgccaagtcctcataggtgtgtattcagtgagaaagactgtaatagctatactgaaatatctgtaggaaaatggcactttgatcagtaatacgtgtgaagtcagtcgccggatgtgtggctaatcccatagggtgggttagcaagagacaaagttcttaattgtaaattgaaggagtccgtagccggaactagtactatcggacctggtcttgactaaccctctagtaaatggaggcttcatgggctagatataatattcttgatgcctggcatgtgcacagagttttcaagatagagagattgataaatttggcatgaaaaggttcagatatagcgagatttggtgaatggatccttcgaagtgagtgactggggggtatcgaaacccattgggggaaagttggaatgcgaccgcctaattaacggattggcataagtcttcctaaaataccaagtgaggtacggcccggagaaaattactgtatcttgtcagaaactctcgttttcaaaaaaaagacaaaaaaacaagatggggccatcctagaatcacacaaaggggggcgcgtgtaaatactttctaa

SEQ ID NO: 651990 - DNA, 558 bp, Homo sapiens
cctggacctttctgtaccgccgcatgacacagaaccccaattactacaacctgcttgttctcaatggtcttggtgaggtagaccacatgtgcagctggtggagcatgcctgggtgacctagacgctaagtgatcacatgatgagaatggacgtgggcctgaactagcatgatcgccgcctactattacatcaactacaccgaaccattgagctcttcagcatgtccctcaatgccaagaccaaggtgcgagggcttatcgagatcatctccaatgcagcagagtatgagaacattcccatccggcaccatgaagacaatctcctgaggcaagttgtgctcagaaggtcccccacaagctgaataaccctaagttgcaatgatccgcacgtcaagaccaaacctgctcctgcaggctcacttgtctcgcatgcagctgagtgctgagttgcagtcagatacggaggaaatcctatagtaaggcaatccggctcatccaggcctgcgtggatgtcctttccagcaatgggtggctcagccctgatctggccaggctatga

SEQ ID NO: 651991 - DNA, 786 bp, Homo sapiens
  misc_feature (786)..(786): n is a, c, g, or t
cgtactgtctttcacctttccattgttgcatcttgaattttttaaaatgtctagaattcaggatgttaggggctacttctttaaaaaaaaaaaaaaaaaaaaagaattcgtctgaaaatgcccaggttggtaagaatctaatctcccttacttaactaagcactccataattaagtttattgacggtacaaagggagccagaaagaattgactatttattgttcttcgtagatctagaaacatattgtaaattgaagccctggccttgctgggtttagaaattatgtggggcatggttataatttatccaataacatttatgtcccttggccttcctggtgggaaacagttttatcccactaaagctagggaattagggggataaatcacaaacaaaaaaaaacggttggcagcactggaaaaaacagtaactttatgggtttttggcaacctggcgtattgtgaattcggtggtggataaaaacttactttatcccttatttaccaaacatttttgtccaaatttttcctattattttaaaattggtttgcggctggtggctccatatttttaaaattatattggctacagggtcggcggtattaacaggtacaccttttttaccccctttgggagagcgtttaccattaattattacaggccactggggtaggcattagggtaatatctttttaccagagaaaggctatatctggtggaagaacgcaggggtggtatactggtaataatattccccccatggtaatcctaaatcctggatacan

SEQ ID NO: 651992 - DNA, 135 bp, Homo sapiens
caactggagcagcagctgggtgcagcaagcaaggcaacatggtgtttagctcattcatccaccaggccgtagtgtgtgcctggcacactcacacagggcacagctcacatcacacccaggccacatcatcaggca

SEQ ID NO: 651993 - DNA, 269 bp, Homo sapiens
aggatctcggaatgtgtggtgttatggagtatacctagagatgtcagtgtagatatccccaatttatacccttctaaacccgggattaatcccgtaattttctaaggccccgtacatctagagactaaattttggttaacgaaccaacgaccttcgatcaggtccgtgacctctggaaatgaaaatcataaaaaataatgagtaaccccgaaaacctcgtatccatacgacttacggatagccgggaaaacgcataacaccacacaatt

SEQ ID NO: 651994 - DNA, 342 bp, Homo sapiens
catcctcaacaggtgagcaagagtggctgccaatcaggcttgaacaatgcccatgaactgagtgacagaaagagaggctggcttcaggcgaggttcagaaggctagcttcttcatcaggagataaactctggagtccaactcgaatccaatgcaggtagtaggaatccccctgcagcctcatgagcaaggcccccatagaacacgtacgcagaagaggcgtgtagctgctttcagtagacgtttcatctccctcaatcctgtacaacttttccataaattacatactcaaactggtcagccctggaaagcctatcatcagtggggttgtattcaccatcatc

SEQ ID NO: 651995 - DNA, 291 bp, Homo sapiens
  misc_feature (227)..(227): n is a, c, g, or t
atggatcttagggtccttatgggaaattcactttaggattgctgtcagtctcctctttggggaagagcttcatgaaaatgtggatatccagacgagaacctgtctaggttaatgctattgatggtatcaggcaacagtcgaaccattctccagagacacttcataacaagctctgagacatcgggagaactggctgtcgctagcaggctgtcgttggagcaacacanttttggcactcaggatgtcggcctggtctgacttctccagaacctacaccaccacgcaggtaca

SEQ ID NO: 651996 - DNA, 566 bp, Homo sapiens
gccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataaaaaagtaatttttgattttgaaaatctcaaaacttttagatctgaaatacagccatgtgatcgatcataattctaaaagctttttaaaacatgtaaaaggatttggggaacggcagaaaacatgcagttttgggcatttgactgacttggaaagtctaagcttattttagttttaactattaaaatcatttttaaaaaattagttaatttttgctgacaagaaaaaaaacctttagttgttaaaattttgcacaccaacattaaatggtcccaccacaccacggaaatatgcttaagaaaactaatatcattagcgttgataacaattagtcaattggctcaataactgaaccctgttagttgctattaaaataattatttttaaatttt

SEQ ID NO: 651997 - DNA, 433 bp, Homo sapiens
tgcatattcgggacgtgcatatccggacgggcagacccaacagagaacacctgccagatgggggtgctcctatttggagagcccctggctagatggggctgtgctcgagcgtgaccccagatcggactctgggctcatacagatgccactatcattatctgaaggggtgtcttcctcctttatgcactgagggcatcatggccaacgtaagctgtgtagtctggcttcctatctccctcagtgatatccacttcactgcccagctctcaactatcggaatgatctggcagtgtggacacggacccctggggacaggggaagaggttgtaagaaggtgaagggggcaacctgctcgggtttagttcaactttctgggagatggccaattgggttcaccgtctgggggggctgcttattagtctcctggactagg

SEQ ID NO: 651998 - DNA, 602 bp, Homo sapiens
gtgacacggctcgctagatactctgtctgtatattagtagacttacagattggaaatgtaatatgtcttgttatcacgtccatcttctgtggaaactgtgatgtctttggaacttcattccgaggagataagctttaactttccaaaagggaattgccatggtagttgctattctgtggtgagtgaaacaatctgaggtctggtacttgctgaccttgttgccctgcaaacttcctttccacgtgcacgcgcacaccaacacgaaatgccatcactcctactgcggctgctaatgaagcttactggttgtgatgtgttataattaagtctgtatatgtggattgaatgcagtttaatgtttcccgaaagccaaagtaattttcttttccttttcctctctcgaaaagttaaaatatctatgtgtaattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgagtgatgctggcaagaccc

SEQ ID NO: 651999 - DNA, 672 bp, Homo sapiens
caaacggtttgcccttgtggtacagtctcaccttggttccaaaaccgcctcacttgcttaagcccggttggcaaaaaaaacccaagggggacagcgggcaccctcgctcagaacccatcaacattgtgcactgggcaaccccgtataaggcaaccccctccaataccgccaggtacccattgccacccctccttcacaaagaaattatcctggaacagagggggctggcctccaagcttcaaccaggaacttagccataaacccagattggctgcctcttaagccaagctttttctaccttcaccagcctggccccctcgtttttccgggaacaactaagcctgggaagggaaacccacacccgtaagttcgttgggtaatgccaaacctttaaatacagtcatgtatcttttactgtaaacacaaagttgatttcaaaagcggtaacctcagttcctaaagagtgttagtgtaaggggccctccccaatggaagttttaagccgtcttgtgaaccgccttgtgtacagttaaacatccggaaatgacgccccagtgccctttttccagccaccttttgaagccaggctcgcccccttgtacctaaaacatacccattctggatcttgtagcccttttttaatatggtgcccttttaaaataagccaacaca

SEQ ID NO: 652000 - DNA, 332 bp, Homo sapiens
ggctccattttagcgccgcccgccgtcgccatcatgtgtcccttccctcccccataccatagtcccccccggaggatctgagccccctcaggaggaaggcgtggggccctaagggcgcggcagtggggagagtgactgggagcttgggggaaagaagggagaagagggggagaaagggggagtggcttttacagcaaaggggccgggggtggccggggaacaaggccggcggttttccgggcagacgacgacggacgggcccgtggccgtctgccgggctgggccagggaccagcagccggggccgggcgagtcgcgtctgggggcggcggg

SEQ ID NO: 652001 - DNA, 331 bp, Homo sapiens
ggaaaaaagtgatgaaccaaagttttttgggggctttttcaaaaatttgtttttatttggttttgttcccgaaaaacaaaggaactgcccttcatttttaggttcttcaagaatggggtttgcaagggccaaatggaccaataaaaaacgttgcctataacagtgatttgattgccaaggaatgtaaattcccttaaacttgcagtttttcccataaacaaatgtaatgggcatattgggatttgtatgtaggaatcaaaaatccccccaaacaggggatttttttttttggcaaaaagggtttaatgtttaaccaagaatttttttttta

SEQ ID NO: 652002 - DNA, 272 bp, Homo sapiens
gtcacgtgcacaccgcgtttgtggaagtgcagctgtttcatgttgccggcaccgcacgcggaggataccgacgagaacggcggtgccagaacgcgtttgatcccggcgtgccgggccaccccgcaggcgtgcagcggtccgttgccgccgtaggccagcattgtgaaatcctctggaaggtagccgcgcacacgcagttccttaccgataccgatggccatctgctcgtcgacgccgtccttgatcacccgggcgacgtcgatggggtccat

SEQ ID NO: 652003 - DNA, 426 bp, Homo sapiens
gatggcgacccaaccatcggctttattaccgaaccacaggttgatgtgatcaccatgcgccgtctcgggacagcgtgactcaccgtcactggcggtcccacaaacgaaccccggcacaaagtcgtgatccagatctggggcgtggaaatgccccttcatggacaaggttgtaacgctcagcgttctctcccgtgttcgggccgctttctgccaaacagaaaacggtgcgatggaggtctatgtgcatagcccaccgcggattccgtcgcacatcatcgtgggggcccgtgggttattcgggtatggctacgcatagcgattttttcttataacccgcagtagaccatagcagcttaattcatgtttttaccaagcgatctctcatcccgacccccctaaaattacacctgatccacccccatgcac

SEQ ID NO: 652004 - DNA, 213 bp, Homo sapiens
gccgctgctggggactgaatactctatatataacagcaagccatgctccctctaacctcacttctcccatcatgagtgggcagagaagacgtgagcaaaggggcgaccccgtagtcaccagcttcagcaggcagcggcagggagggctgacttcctgagccataccagatgcttgctcattctccagccagaaaaatgccccccattccttcc

SEQ ID NO: 652005 - DNA, 408 bp, Homo sapiens
cagagtgtatagtgcaaaaattgaaggaagactacctagaaaagtaatgtcgagatcagatgaatgagtagcaacgaactaggtgaggataggccgaggtaaaggttcaaagttctgagttggaacaaagcatggcatgttggataatggttaggctgtatccccatccaaagaacatctggaattatagctcccataattcccttgatgagctagtggaggggtcctggtgggaggtaactgagtctttctcctgctgtcctaatgatagtgaataggtctcatgagatctgatggtgtcataaagaggcagtacccttgcacatgatctcacatgtctctcttctctgccaccatgtaaaatgtgccttttggcttctgccaatgagttgttgaacgggctcccca

SEQ ID NO: 652006 - DNA, 216 bp, Homo sapiens
aacccgggggttaacaaaaaaaccgggtgcccccctgccttaattaactttaatttggggggttgttcccctttagggccccgcgttgaatagttcccccaactttcaaaaaaggtcagcagggccccgcctggttttcccagcctcataagtaacgggtttggtcagacttttctggcccccaaggttttttaaccaaaaaaaggttttggggga

SEQ ID NO: 652007 - DNA, 1116 bp, Homo sapiens
  misc_feature (1116)..(1116): n is a, c, g, or t
tgggcggtggtctacgtttctgcgactttgtgtcggcgactgcatgactaggacagatgtcttcagcgcaacatgctaacaatggggcacccatgacccccaacttcaacagccacagctgttatgccagatggtcagtctcaacagatcatcagcctgctctgactacaaaggaaacatatgtcggtgcttctctgttttaccctcttgcacttcacccttggtgtgccccaccggccgcatccattgcttatccacgtgcatcaggcgcccgcagagcacattctaccgcaaaacgtcaaactgccagaaggtagcatcttggctgctttcatcggtggcatttctcaactttccttgtcagatccttagccgatgcgcgctccacaattacgagccctgagagcaaaaccaaaggggcagggcacctgggtgcaaccacaatggccacgccactttgccatgtgggggctaaatcaaggaacccccgccaagtccgacagcgcaatgtgggcgtaccacggcgacatcaacagtcgggcgagcttcccttcaagccaggccgcctggcacctgtgaacaaggggccaaatcactcccgctcctccaggcagggccgacccccttatgcgtacactcccactttggcaactcgcattaaacaggaggggataacatccccttctaccgcgcctcaaggaaacttcccaaccgctgggcgtaaacaagcttggtgacgcgcgtatccccgcgatgagacactggggggcccccgggcacttcagttagctcggcgcactttgaaggaaaccctttatgtggcgacgagagcatgacaggccgaccccacggagggccacgctatccccagaggactgacgcgaccccagtggacaccccacacgcaccccacctatgacgccggcggaccaccagggttggcgtgggccccccccaccagggcccacttggggcgcccgcagtggacgaaacgacacccgccctggcggccacccaggctgcgacaaatctacccgccacgcttccgaaaccgccccccctctggcagctgtgacaccccagcccaaaaggaaaggcagacagccggccaagctn

SEQ ID NO: 652008 - DNA, 623 bp, Homo sapiens
atcactaactgacgccacgtggcgtggtggcgacactgtctgaccagccatccacatagccgatgctcagggtctcgctcgtcggcgctggccagtgtggagctcatcgcaactaccagagtggcagctgcgccgcaagtttttgtcgcatcttcatagtgcttccccgaaagtgctgcgcccggcggatgccgagcgacgtcaacctgttgttatgtggtgcaccgagcccccctcacgcgcatcaatcacgtgggtgcctcgtcagtggagggctgacacttcgatcatcaacctgctgccacaagcgacctgctctgactgcgacctcaggtaagcaagaaacgacatcacatcgccagcaggacgatttgtaggatattcaccgacgatcccgcccgaactttgcatgtcaaaactatgcggctccactgggacggcacaaatccgggtaagatgcgcgcctttgccccagacgggctgatcatgcccgcgactgcacgtttcccgctcctgccctatttatttgccctgatactcggtgtgctggccctcggcggctattggtacggcttggccaccggtggtgctgcggacgtggcagcgccagcacaagctgcatg

SEQ ID NO: 652009 - DNA, 793 bp, Homo sapiens
  misc_feature (1)..(1): n is a, c, g, or t
  misc_feature (9)..(9): n is a, c, g, or t
  misc_feature (81)..(81): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (114)..(114): n is a, c, g, or t
  misc_feature (121)..(121): n is a, c, g, or t
  misc_feature (146)..(146): n is a, c, g, or t
  misc_feature (149)..(149): n is a, c, g, or t
  misc_feature (160)..(160): n is a, c, g, or t
  misc_feature (179)..(179): n is a, c, g, or t
  misc_feature (181)..(183): n is a, c, g, or t
  misc_feature (187)..(187): n is a, c, g, or t
  misc_feature (197)..(197): n is a, c, g, or t
  misc_feature (214)..(215): n is a, c, g, or t
  misc_feature (241)..(241): n is a, c, g, or t
  misc_feature (255)..(255): n is a, c, g, or t
  misc_feature (278)..(278): n is a, c, g, or t
  misc_feature (337)..(337): n is a, c, g, or t
  misc_feature (345)..(345): n is a, c, g, or t
  misc_feature (378)..(378): n is a, c, g, or t
  misc_feature (409)..(409): n is a, c, g, or t
  misc_feature (435)..(435): n is a, c, g, or t
  misc_feature (448)..(449): n is a, c, g, or t
  misc_feature (473)..(473): n is a, c, g, or t
  misc_feature (480)..(480): n is a, c, g, or t
  misc_feature (512)..(512): n is a, c, g, or t
  misc_feature (534)..(534): n is a, c, g, or t
  misc_feature (544)..(544): n is a, c, g, or t
  misc_feature (597)..(597): n is a, c, g, or t
  misc_feature (602)..(602): n is a, c, g, or t
  misc_feature (616)..(616): n is a, c, g, or t
  misc_feature (623)..(623): n is a, c, g, or t
  misc_feature (628)..(628): n is a, c, g, or t
  misc_feature (644)..(644): n is a, c, g, or t
  misc_feature (646)..(646): n is a, c, g, or t
  misc_feature (648)..(649): n is a, c, g, or t
  misc_feature (658)..(658): n is a, c, g, or t
  misc_feature (682)..(682): n is a, c, g, or t
  misc_feature (685)..(685): n is a, c, g, or t
  misc_feature (687)..(687): n is a, c, g, or t
  misc_feature (690)..(690): n is a, c, g, or t
  misc_feature (703)..(703): n is a, c, g, or t
  misc_feature (717)..(717): n is a, c, g, or t
nctggtaangcccttccttcatgcaggagggagactgagaaagcagatgttggctccagaatggggtgtaaaaattttgtnanggggntntnanacaataaaaacatataatgngatctgncaaattaaaaaaacagaagctctgngcncgggtatcagnaaggagataaaatcaatgngnnnctgngcaaatcagnaaaacattttcaaaagnnatcaatattttggatctggggggggnaatggtttatatgngacttggaagaaatagcaaaggncttcatacattccaagggaataaccatccagggtaactggtggcttttcttccaagggnaaacaagnatacttattaataaaaaccttaataaaaggtgngcatacaatctattataggaaagaatttggntaaatatgggacaaggacgctatggntaggggtggagannaaattggtaatttggtaatttggnaattggnctgggtatctttgacaaggctatattcttggntattagattattttacaaaagnttaacatggnacaggggctgggacaagggatatatatatatatatatattttctaggactttnctaanttttctttttgggnactgggntctgnagaccttccttggttnangnnttaaaaganctggggaattgtaaggggcaggtnaananatnaaaggggctcttnaggggagaaaaaanaaaaatggggctcgttggggctcaagggggggggctctgcgggcggttccctttagggaggggggaattctggggc

SEQ ID NO: 652010 - DNA, 167 bp, Homo sapiens
tgctagccatctatctctatattctatgaagttcaacttttttttttccttagattccacttattagtgatatcatgtcagtattggtcttatccatttagtatttttctcttagaataataccctccaggttcatctatgtggctatcgctggcctacagcacatg

SEQ ID NO: 652011 - DNA, 124 bp, Homo sapiens
aacagaatgtatggaagtacgttttcttcccgaagggtggctttgcttccactgggttagagaagagtgtgtatgtgtgtgtgtgtgcagtgtgtgagtgtgcacataaatgtgtgtgtgagtg

SEQ ID NO: 652012 - DNA, 173 bp, Homo sapiens
ccgggagcacttaacctttcgagagaccttaccagtccggcagatcataaccatgcgccagccatttacgctatgacagcagatacatttacatcggtcgcgacacgctccaagcacagtaccaggtgctgagtgagactgaggcggagcacctgtcaaacgaccacgcagga

SEQ ID NO: 652013 - DNA, 745 bp, Homo sapiens
tggacgtgaatgacatcttaagtgtgatttggattttcatttccctaatgtcagtgactatgagcaactttccaatgtgctttggctgttgtatgtcttcttaagataaatgcctatacaagtcaattgcccattttaaaatcaagttttttttgtagtgttgttgaattttaggtgatccttatatattctgacgtgaatctcttattcgatatgatagactggataacactttttaattatctctttttttaatatggatcctcagtagtcatgtgtttagagcagaggaaagtatattgaaggagaagttcactgcactcattgtggccagagtccttactaccttcttaatttttaaaaagtggattacgttcttaaaaagtcaaaatatatgaatatgcttgttctaactgattacaatatattttaatgagtaacagcaacagaacacacaactgtacatgacatgtagggacaagtattaactgctgtatctcctgtggtaaatttacctatgggtgatgtattgacctaattacagctttcatacttttccactctcacattaacttaattgcataactcacatttccctcagttatcgaatggatatctagattacggcctctatttaaaaaaccaagatagcgtctcggtatggaagaaccaaaattgagagcagaccgtgcacgcaagcgagcacttatacaccggggtaaagcacagcattcaattggcggtg

SEQ ID NO: 652014 - DNA, 97 bp, Homo sapiens
gccagcaccaaccagacatctatgtacctctgtgccagcagttttacggtcggaactcggggagctgttttttggagaaggctctaggctgaccgta

SEQ ID NO: 652015 - DNA, 342 bp, Homo sapiens
  misc_feature (12)..(12): n is a, c, g, or t
  misc_feature (52)..(52): n is a, c, g, or t
  misc_feature (306)..(308): n is a, c, g, or t
gaaaacccgagncaggaggattcaccttgagccccccagagtttgagagcancccctggcaacatggtaaagaccctccccgtctctaaaaaaataaaataaatagccggtatttcccagttacttggtggggcccaaggcaggaggatcgcttgagccccaggagtttgagaccagccctgggcaacgtaataagaccgtttctctaaaaaaattaaaaaattagccagtgctcccaggtgcttggggggctgaggtgggacggttgattgagctcagtaggtcgaggctacagggagccgtgannntgccactgcactctagcctgggcaacagagcgag

SEQ ID NO: 652016 - DNA, 178 bp, Homo sapiens
gaaatgtttcatatttacaagatatggccagagactgattctaattcattctctcccacaaagaagaggtaaattatattgattgtttatatcttttcactctacaataatctgtttactataaaaatacagaccagcaaaaggaggaaatggaaatcatatataggcttactactca

SEQ ID NO: 652017 - DNA, 105 bp, Homo sapiens
cgttcagggtatgcaagttcaattcaggcctcaggtttgggcacgagaagagggacattgttcaccactcgagcacaaatgacaatttgactcacaaaagcactg

SEQ ID NO: 652018 - DNA, 808 bp, Homo sapiens
ggccgccccttcgcacataaaagcaacctgggcgcccaaatgaggccccgctacaagatggggccccgcgggaggatatacgcgcggagccgtgaggacaaagcggggcaaccctcggcaaccgcgtcgaaacgaaaaatgaagagcagtgttcggcaccacggcggttcaagacaggcgccgcgcgagggtcgtcacccaagacggcgatgtctctccatcagggcacaattctgtgaaggaaccgaccgtcgtcggttaacatcccccaaaagggccgccgtctaagtaaactcgtgcgagggtaatctctccccgccctcctctggtagagagagagccaatacgcacgcaagagactctctcgccgccacgcccgctcgcaccagagagagaggacgtcacccaccctaagaatgagggccaccacaacatagcagaagtgagagaaagagagaaatacaagcagatcaaacaacagacacagggagagggaaaacagtgagatgcagatacaaaccggggctgacaagagagagagagaaaaaaacggggcctcttcgcgccacatgcgctcccctcggtgggcacatactcaccaccgaataactctctcgtgctaaaagatgctaaaaggggagaaaacaagaaatgaaaccaaaagagagagagaaagaaggggatgacaaccatcatcacgccggctgaggaacaatttaacacgcccccgggtgtaacaagagcatagggaaccgatttgggaacaccagagaataaaagacgaaaaggagaacaacccacatagaca

SEQ ID NO: 652019 - DNA, 162 bp, Homo sapiens
ttcgccgcgtcccccaatgcaggacgtctggctggctcactggggccgccgagtagccggggtctgagagtctgtgaagatagcccagttcttctatacccccagcctaaaccagatcaacgcacgtgactgcagagcatgggagactcctctagactgtcg

SEQ ID NO: 652020 - DNA, 1882 bp, Homo sapiens
  misc_feature (1877)..(1877): n is a, c, g, or t
  misc_feature (1879)..(1879): n is a, c, g, or t
gcagccccgggcggaagcctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaatttttaaaaaaaaaaaananacg

SEQ ID NO: 652021 - DNA, 230 bp, Homo sapiens
ttcacaaagagtaacagcatcattcagcttatttagaaagactgaagtacatcataggtgtgatatattttaatatggaggtgggagtgtagatatggagatagaaaggctcctccccaccatgtaatgacttcctactcagaattttataccaggctagcttgctgcaggtctgggcagtaggatcatggctccactgggatcggggtgaaaagctatgaggggggaga

SEQ ID NO: 652022 - DNA, 753 bp, Homo sapiens
  misc_feature (147)..(147): n is a, c, g, or t
  misc_feature (175)..(177): n is a, c, g, or t
taaacacaaggtaagtgtgataagaagtcaagtccactcttcctcccccacatgaacagaagggctgtttcattcttcttccctcgtttctattcccttggcacaagtaattcaggcatttgtgcatttgtcccaaggtgaactgtngtctatggactggtcccacatgacctgnnnggtgtctttccctgtgctagtcctgacccttcaggaagacttaactgctagtttctccttcctgaagccttaaaaattgggttctgccccacagcacctcctgggaaatatcctaatggtttcagagatgtgctgagggagctgatccgggatgaaggagtcacatccttgtacaaagggttcaatgcagtgatgatccgagccttcccagccaatgcggtgagtagctggcagggctgtgctttccctctggggctcagggcagggtgcatgtggtttgactttgcttgttcctgggataggactggggtctcagttttcccaaagccctatcttcagccagagcattccttatttgctcccttccttgaagctgtcaggaggatttgcctttggggatctctgaggtgaggggctttgatttcctgacctggcattagaagtgggcagttgtgaggccaggcatggtggctagtgcctgtaatcccagcactttgggaggctaaggcaggtggatcatctgaggtcaggagtttgagaccagcttggccaacatggggaaacaccgctctacta

SEQ ID NO: 652023 - DNA, 1828 bp, Homo sapiens
  misc_feature (1823)..(1823): n is a, c, g, or t
  misc_feature (1825)..(1825): n is a, c, g, or t
gcagccccgggcggaagcctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaatttttaaaaaaaaaaaananacg

SEQ ID NO: 652024 - DNA, 104 bp, Homo sapiens
acggccgtgtattactgtgcgaaagggacctattactatgatagtagtggttattactttgcccctaggcggtcctactactttgactactggggccagggaac

SEQ ID NO: 652025 - DNA, 1552 bp, Homo sapiens
gcagccccgggcggaagcctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgtcccagctagtggaatgtatttcatgacatatgaatggctgaaaaatatcttcactccggagggaaagagggtcagtgagctcagtgcccctcggatcttggtggctgggggcattgcagggatcttcaactgggctgtggcaatccccccagatgtgctcaagtctcgattccagactgcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaacgatccttgctaccattaactgctatcctacccaatcaaatgatgcttatgtaagagagaattgaattctgactagaacactggcttatttgaacctataccgagatctagaatttttatgcctagccagaatccattgattgcagatcctgtaatctggtctccattattttactttaagccccttgtg

SEQ ID NO: 652026 - DNA, 1261 bp, Homo sapiens
  misc_feature (147)..(147): n is a, c, g, or t
  misc_feature (175)..(177): n is a, c, g, or t
  misc_feature (1256)..(1256): n is a, c, g, or t
  misc_feature (1258)..(1258): n is a, c, g, or t
taaacacaaggtaagtgtgataagaagtcaagtccactcttcctcccccacatgaacagaagggctgtttcattcttcttccctcgtttctattcccttggcacaagtaattcaggcatttgtgcatttgtcccaaggtgaactgtngtctatggactggtcccacatgacctgnnnggtgtctttccctgtgctagtcctgacccttcaggaagacttaactgctagtttctccttcctgaagccttaaaaattgggttctgccccacagcacctcctgggaaatatcctaatggtttcagagatgtgctgagggagctgatccgggatgaaggagtcacatccttgtacaaagggttcaatgcagtgatgatccgagccttcccagccaatgcggcctgtttccttggctttgaagttgccatgaagttccttaattgggccacccccaacttgtgaggctgaaggctgctcaagttcacttctggatgctggaagctgtcgttgaggagaaggagtagtaagcagaactaagcagtcttggagggcaaggggaggggaatggtgagatccgagccctgtgcatggacttggtgagactgttgccttaatgacatcctgcaccgtgtataacttagtgtgtcattttgaaacttgaattcattcttatcaatttaagggatcttaaaaggatttggaaatggaacaagtagcttccagaccagatactacctgtggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaatttttaaaaaaaaaaaananacg

SEQ ID NO: 652027 - DNA, 688 bp, Homo sapiens
  misc_feature (683)..(683): n is a, c, g, or t
  misc_feature (685)..(685): n is a, c, g, or t
ttcggcaaaagggaccttgggtaaactgttgccttaaagcctcctggccccggggaaaagctaaggtgccatttccaccccggatttcattttaacaatttaaagggtactaaaaggttttggaaaaaggaaaaagtagctttccagaccaaatctacctgggggcaagaatgctgcctaccagttaactgctggtcctaccacagtcaaagtattcctcattaaagagagaatctcaggttctcactggaggcactgtgcatattttcaaccagatcaccaggagctgagatcttcttcagtccctagccaggaatacccatttgatttccagggtgccatctaatcctgggctgtacatgtggatatggacttgaggcccacctctgtgtccaagtggattgagcatatatgcctaggaggagatagactgttaatcgttggattttgattttttttttttatgcctgcaaataatcaaaagtaaaactggagtagcctaattttctgggagcaggtggagaactttccctcctacacagtgaggacagtcccagtctgctgggataagtgagaaagcccagggtgtaggaaggccctttttacatactcttttctcatgagagctcactattttaacaataaacaataaacgttgtttctaatttttaaaaaaaaaaaananacg

SEQ ID NO: 652028 - DNA, 321 bp, Homo sapiens
tgagtgctcacagcgctgcggctctgctgtactcgcttgacccattgcgaggctgctgatctggtccccttccaggcggtcaggagggtgacacacaccaggcgcttgaggccgcagcgctgcacatgcggcaaacaccgaggactccatctcgatattgcggacgccggctgcataggctgcctccagatacgcctgcttgtccttctccgtgtaggagcagagagccccatccagacggccttgcccttcatagaagtccaaggttgccatttgttgttccccaccgctgtggtgaactcgctcagcaggcttgcaaaa

SEQ ID NO: 652029 - DNA, 150 bp, Homo sapiens
acagaatgggggagggttctgttctctcctgcgtgctttggagagcttgggggctataaaagaggcggcacttggcagcttggagacagggacagacgtaggccaagagagggcgaccagataggaccatagggagagacagaccagcaa

SEQ ID NO: 652030 - DNA, 740 bp, Homo sapiens
  misc_feature (33)..(33): n is a, c, g, or t
  misc_feature (37)..(37): n is a, c, g, or t
  misc_feature (45)..(45): n is a, c, g, or t
  misc_feature (49)..(49): n is a, c, g, or t
  misc_feature (52)..(52): n is a, c, g, or t
  misc_feature (84)..(84): n is a, c, g, or t
cgaaagcagcaaggcaggaacacgaacttgacncccnttggaagnaccnaanagacgagaaaaaaccccacccccatgacacantcgaaggcaggcgcaagagatgtacccgagaagacggccaatacggccgggaggtcaggagacgaaacgtgtggatgaagcaccagaaaggagcctgcggagaggaggaagaggcagaccaggagaggccagacccgagctcacggacccaacaaacaatggctctggagacggaaagggagatgagacagatcccactgcagacagacgacttagaaaacggaagcggataccaaccccgggaccagcctacccagcccaacccagaggacgcttaccgggcccagaactacctgcactagaccccaagccactatgcaaagcagcagaaccaagatggaaagcagaggaagaggaagcagccatggacagacggaatgaagcgcagaaaaggagcagatcagaagatggagcaaaggggagcttaacggagaagcctacgacaaagggacactaggctacgcaaaaatcagaactacagcaagaacctatacactggaggagacaggaaggagggtggaggaaaaccacgaaaacaacaagcccagaaaaagagcgagaatcggacggagcggaagagaaaccaggggttcatagaagaaggaagacccaagagagcgggccaaggagcagcaaagaggacccgccaatatacc

SEQ ID NO: 652031 - DNA, 834 bp, Homo sapiens
  misc_feature (829)..(829): n is a, c, g, or t
  misc_feature (831)..(831): n is a, c, g, or t
gcagccccgggcggaagcctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtccgactgcagacacagccaccgagtttgcctggacaacctcccatgtactctgggacctttgactgtttccggaagactctttttagagagggcatcacggggctatatcggggaatggctgcccctatcatcggggtcactcccatgtttgccgtgtgcttctttgggtttggtttggggaagaaactacaacagaaacacccagaagatgtgctcagctatccccagctttttgcagctgggatgttatctggcgtattcaccacaggaatcatgactcctggagaacggatcaagtgcttattacagattcaggcttcttcaggagaaagcaagtacactggtaccttggactgtgcaaagaagctgtaccaggagtttgggatccgaggcatctacaaagggactgtgcttacccttatgcgagatgataagtgagaaagcccagggtgtaggaaggccctttttacatactcttttctcatgagagctcactattttaacaataaacaataaacgttgtttctaatttttaaaaaaaaaaaananacg

SEQ ID NO: 652032 - DNA, 1432 bp, Homo sapiens
  misc_feature (404)..(404): n is a, c, g, or t
  misc_feature (466)..(466): n is a, c, g, or t
  misc_feature (864)..(864): n is a, c, g, or t
  misc_feature (1405)..(1405): n is a, c, g, or t
tattgcattcttaaaaaagcaaatttatgggttataaacccccttttaaaaaatttttaaaccctgaaaatgttcaacccttcggaaatattattctggaaatataaattattattttaaaacagcttatattatttgtaatcatctctgcgcagggctcgcaccaggggtaaatgcgcaaagcgagaaagaccgagtatatggcctgtaacacgtgttgtgactccactaatggcgcatattactcccgagttgaaaaaccctatgaggaattgtgcgcatatatagattctctctgcgtggttacatataaccacatgtgttcacctgtgtgccaaagtgtggacaagagcataattgtgtggatatatagagtgtgccatatatctttctgtgggggatancctctcatttctcccgctgcgtgtgtgcacaaatttttgtgtagacacacactatatgtctntactcacctattgtataggcacaagagacgaggacatctctctctatataaccgctgtgtggtatatatttcactaaaagaaagacgtataacacacgtttgtgggcaccacgctgttgttgtttatctgctgtggcgccccacaagacgagtgtctaattttctcctctacaaaagggggcgggatgccgagcagaaataacaacatctcacctctccaatgtgcgtggtgaacagagtgttggctttttatatactcacccacaaaaggggggggcctactaaaaaacacactacaacaagatcatgtttgtggctgtgtagcataactattacaaagaaagatctaccgagtgtgcacgatggtcctcctgtagtgcttgtgcgagagaacaatnttcctgctctcgtgtggacgtaacaccacgacgagaaccataatctcgctgtggcggcagaacaacaactaatcttctagcgcggcgcagcaaaaccacagtcgtgtggttttaaacaacatcttgtagtaagcaactcacatgctctcaaccgagagatatcatacacgtcgtgacgccaccgaacgccaaataagctggtgcatgctttgttttactacaccgaaccgtattcccccgtaggcacacgccgtgtggcctacaatcatccaacaaagacaagaccacctggagagaacgtatgtgccggaaacagtcggctttatttacaacgcgaccggctctataataatattcttgggcgctcatgtgacacaaccgcaccagcgagcgtgaaaaataaatctcacgcgcaatatataacaaccacaaccattctcttgtgggagggaagggccttccacacgcacgtttctccccgcgctccacagttcaaacacggcgcggcaaatatacatactaatcccgttttccaccaatntcgctctgtctcgccatcaagacaaag

SEQ ID NO: 652033 - DNA, 162 bp, Homo sapiens
ttattgatgtgctacatgatacagatggcagtaatgatgtgtaaatattctagatgctcacatgaatttcatttttgcaggcaatttgcagctcctctgagtagacatttatattcaattacagagtctgataaataggattcccgccaccccacccgttcg

SEQ ID NO: 652034 - DNA, 399 bp, Homo sapiens
ctcccggcgtgccgtgggtagctctttcgccccccggcgatgcatgttgcccagtgccctgtggttcttcagttttgttgggtcgttatgcgaaggtggcgcctggggtggttcgggggcatatggtggcttcccgcactgcgtcgaggaaccgttcttctccgctagatgtggtgacctgtcgcttgttgcggccgagagctcttcaaatggtaggtgggagtgggcgccacccacctgttatggtatgctgggctgtggccgtgccaagtcctgtggcgtgggctcgcgtcttgttctcactgagggcgaattccggctcatgcattcttcttgcttgtggtttccacaaaagatgaaaggaagattatttctcgccccaacaattagacacagaaa

SEQ ID NO: 652035 - DNA, 244 bp, Homo sapiens
aggctctctacctatcacaggcttggtgaattggaaagactcgattcccatctccccttgcagctcacacagcagtgaagtcaccatcctgcgcactccctaccttggtggctccccgcacccccagcgatcccacctgaaccaagggcagctctctcttccttctctctagtgggtgcctcagcaacccagctggcgccctttatctggttccgccagcccctggcttcttgatcacttggag

SEQ ID NO: 652036 - DNA, 160 bp, Homo sapiens
ctggtgagtgaagccgtcagcaccgataatgggcgacatcatcgctcgctttgtagctcagggggcataacatggccaagaccttataccagaagctgtacgacgcccacgtggtgcacgaagcgccgaacgaaacgccgttgctgtatatcgaccgtca

SEQ ID NO: 652037 - DNA, 310 bp, Homo sapiens
ctgtctttcagccaacacctcagccctgtatgcgtatccatgtctgcatggaacgagacaccccttcacggcttacactgccatggtatgtacatatgcatccacgtgtgtgtatgtgtagcatgtagcgcattctgctcagcctcgggtgccgttccacattgctaccagacccattgctgtcactgtcgtcccagatgtccttgccatggccacagacaatctgccgtctcctggaaacgctggggctgcccttcagagagctggcagccccagcagtcagggcctgctttgcagaatagaacttgaa

SEQ ID NO: 652038 - DNA, 357 bp, Homo sapiens
aacaaggggggcaacctgggtaaaaaaggaacggctgggccggaaggggggggcctaacccggtaaaggaataaaaatttcgggaatttccaaaaaaacaaatttgaattactgggtttcccccccaaaggggtgaaaaacaaaccctccccaaggccccaacaatttcggggccccaagccgaacctccggggggaccttggaaggaatgtggcccaaaaaaacaaaccaaggcaaggccccctgggaccttccaaaggggttggagggaatccaaccgcccaacaaaaaaaaaaaggggtggggggttccggcggccccaaaggtcgtgcttcggaacccaaaaaaaaattttgc

SEQ ID NO: 652039 - DNA, 1048 bp, Homo sapiens
  misc_feature (29)..(29): n is a, c, g, or t
  misc_feature (45)..(45): n is a, c, g, or t
  misc_feature (54)..(54): n is a, c, g, or t
  misc_feature (56)..(56): n is a, c, g, or t
  misc_feature (891)..(891): n is a, c, g, or t
  misc_feature (919)..(919): n is a, c, g, or t
  misc_feature (939)..(939): n is a, c, g, or t
  misc_feature (984)..(984): n is a, c, g, or t
aaggactccccgagattgaggcgcgtggnttgtgggcgcgacagntcagttagnancctggaagatgaaaagaaaaagacagacacattgctgtattctgtccttcctccgtctgtgtgtgcgtgcgcctcgggacacatgtgccctgtgcgccggagggtgggtttcttgcacgtcggcctttcttctggtcagcctctccccgcgtctctgcctgggtcgtgtggccggttggcagtcgtcgtcccggcggttccagtttgggggtctgtgaaggcctgggcaacgtgggcatcggcgtcggacccgcaggggttttcatcccctccccatccggagcagcctctttgctaggctggatccagacgagcgctccccaaccaaggacaacggcctcccaggcgctcatcgtccacccgcaggagggtgcccgcagagcttcaagaaggtggttgtcacgcctgtcgccctctgccctcatcgagaaatgtagccacagctcgacgcagggacggagaaggaagccggcaaggggatggggcaagcatgtctgtctctcaaaggctggccttcctggccgagtcacccgtttgacactcctccccggatgccggtggtggtggcatggcccccccgtatcctgcctgggctctggcctctgctctgacctccctcttgctgtgtctgccccgtctctgagaagcctggcggcttcttagtgtggctcagtgtcttccacaaagaagacttccccgtccatcagggagaaacctcgtggcggtccgcgtcatgattgtttccctctccacacctctttctggatgattgggcagctgtggtgatcctggagctctgggcttccatacctgtgtgggacagggaagctctctnggtctccatggcccaagtgatggctgcncgctcggtccaggaagaggnggaggcaagcccaccgttccccacattggccttctaggaaaggcngtgttgcatcccacctgcacttcctctctgattcttgagggccaaccgcttcctcccgctcctg

SEQ ID NO: 652040 - DNA, 1214 bp, Homo sapiens
ccatgcttcttgctatctatgtcaggaactccttccgtcaaatggccaaaggggaacacaggagtggacataccttaccttaaacagatggctatgtctagcttttatatgcttcggcaaagcatctacttatagggtccaagcatatagcagggccccaataaatgctaggtgggatatgtatcagtcccctatctcagctgacatgtggctattcagccaggcatggtggctcatgcctttaacctcattactttggcaggctgacgttggcagatcgcttaagctgaggagttcgagaccagcctgagcaacatggtaaaaacccatctctatcagcacaaacaaaacaaataccaaacattaagccgccatcatgggggtgtgcactctcgccactctcaagttcccttgcaacggccctgagcggccaatgcatgaaagccattgaaaccccagaacgcactcggctccccctgtcaattccaggtcctgggatgaccaacaccttgaaacccctgtaccacaccaatctaatgacatcacatcgccactaattcatcagccgctcccactctatcgcgcgccgtacacctcccctagctaatagggcgactaacctcctctccttctctcattcgacgctacgcacatatagcgcgcaagaatacacacacgttcaaccgggaacgcacaccctcataacggtagtactcacaccatgagctggctgactacagcatgcaacaattactttctaaccaacatccaaaaaacctgctctaccccacactacacccaattatcattattcaaccacaaatcacatctccataccacatccatatcttacaaaactcaatattaaccaataaactacacgattttacacaacatctatccacctctcacaaccacaccttacatctttacatcccaaacaacaatttataactccataaaaaccatatgggaacagcgggggcacggagccgctctgaatcactcgtctgtctacgttaggtgctacaaaaacacgcgtgtgtgcaacacccacgtaggtccgacgattagacactatcccccctatcaggcatgcagctcactaacgggcagggcaacacagacccgcgactgtagactattctgttgcccgtccgcgggtgtgcacgagcacgatggctcggtatcgaggtcggtttcgcagcccaatc

SEQ ID NO: 652041 - DNA, 157 bp, Homo sapiens
cgtgcggggggggtcccatctgctccagcagtttgaagcttctcattgcttgtccgttatccatggccaggaatacttgcagcaccctgtgtgatagacttcatggagtgaaccccatgacgcactttccagtaggacgactgactgccgtgggcca

SEQ ID NO: 652042 - DNA, 519 bp, Homo sapiens
tatccgtgtcgggttggtgggttcttggtctcactgacctcaagaatgaagccgcggaccctcgcggtgagtgttacagctgttaaggtggcgcgtctggagttgttccttctgatgttcagatgatgtgttcagagtttcttccttgtggcgggttcgtggtctcactggctcaggagtgaagctgcagaccttcgcagtgagtgttacagctcttaaggcagcatgtctggagttgttccttcctcccggtgggctcatggtctcgctgggctcaggagtgaagctgcagatcttcgcagtgagtgttacagctcataaaagcagcgtggacctaaagagtgagcagtagcaagatttattgcaaagaccaaaagaacaaaccttccacagtgtggaaggggacccgagcgggttgccactgctggctggggcagcctgcttttattctcttatctggccccagccacatcctgctgattggtagagccaagtggcctgttttaacagggcgctgat

SEQ ID NO: 652043 - DNA, 1180 bp, Homo sapiens
  misc_feature (758)..(758): n is a, c, g, or t
caccgtgggggcgctcccaaagagccccttttggggaacatgaagtgtcggaaattccaagcagttagctgcggtctaggtaacaaaggcgtctctttttctcacgtccagaccggggattcccggcgttggccactggggtgaaaactcataatgtcgaggctccccctttctgggccatggctatgatatccctgagcacaagtaagagttgggcccgattggactgacattcttgggcccttctgtgaataccacattaccctcactttgtctgttgctctctaggaacacctttctagttcacccaggaaacaatactagaccctctgtgtttgcggctaaaccggggcccaacaggatatggctttcctcccggggctccatgtttccaacccattattggaacagtctcgcctcactcgtcgcgtgcatacatccttgcaagcttttctagtgcccggggcacgggcacttgggacacggtttctccttatactccaaggatgcgtctcgcatagccgcttggtctctttgaactcggcgccccatgctgaatgcctgctttctcccaggataccccttggatctatatagaatcgtgcccgagtgcgttctcccgaaagagagttgtgccaactgtgcttttcagggggcgtatcgggggccctaagagactctgccctggcgacacacaagagaacacctccggtcacagcgcacagagatctctctcggttgtctttcattatctggcngtggtcaaaaggcccacaaagatgcgttctgtcacaggttctgtcacaccacacatgagcacatgtgaatgtgtccggcgacatgatagtatatcatggcgaatatgaaagaagcttgcgagtcacgccttgagaaggaacctcaagactcacaatgagcctcgtgaggaatatgtttgccttcactcctatgctgactggggaaacggggaagaagtggttcacagggaagggctatatggcttgctttgctgaacagtgttctcggggtacccatacgagttcccactaggggctgctccctccaaaagggaggggacagatggggagcttttcttacctaatgaacggataatacgtgcctttgtttcttaaatgctgttcacagttacttgaaaaaaaaaaacaatgccgccaaagca

SEQ ID NO: 652044 - DNA, 538 bp, Homo sapiens
cggtattccgccattatggccccggccaaattttgaccaattcccttttcccacattttccccacccaacaacacacaaagagcgggacctctgtaaaacttttaaaacccccccctaccccccaaaaactagccaaataatttctcaaaaaaaaaattttattttgaccaaactccctaaacccccaaaaaaacccccccaattcctttccatccttctgaacagaactatccggagaccaaaaccccaccaccccttcatcactaccaagcccaaaaccaacttaaaaaattcccctattcaccccccacaaaaaattcaattccagattaacacactttgaaccctactatacccgaaattttgccctcttcccaaaaaaacagaaaaccccccttttttttttataaaaaaaaacccaacccttccatttcaaatttacccacatctctatttctaaaataaaactgccccctctctaaaaaaaaacaaaacacctccccataaacaaaacactctcccccgcctctaccccaa

SEQ ID NO: 652045 - DNA, 723 bp, Homo sapiens
tcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttctttttttttttttttttttacacaagacggtggttaagaaacgtgttgggtgaactgaagttcctcataggtgtcattggtattgagagaggactagtggacaagtgaatctaaagtgcccacttcgtgactataatttgtgagcagtgaaggacggcatgacgtgccgtgtttacccagaaacgggaataccagtgcttacgattagaggacaaaaaatttgggttaatctggggggaacacgtggtaaataacgcttataatacttaaatacatttggggtggttcctagaagagttctacatatgaacgcggctagttttccattatttaaaaccacttggacaacaatttgagcacatatttctaacaatacgaactataggtgccgggatccattcttcagcattgggcagttaatctgcgtgaaaccaaagtaagaacctgaatgacagtgcacagtggggtttcactagaaataca

SEQ ID NO: 652046 - DNA, 113 bp, Homo sapiens
agcgggaacaatcacttcgagaacatgtgaggggatctcttgagcccaggatttttgaaactagcctgggcagcatagctgagagccctgtctgtctactaacaattttttta

SEQ ID NO: 652047 - DNA, 900 bp, Homo sapiens
ggatttatgcaataacattttatgtcaaactgttgccaagtctgtggtccatggtgctttcatttctgtcacatttcatttcttggaaaaggcctccttcctccaggtgcctgctgaaccatcttagggtcactcacaccctactgtaattttaatgatgtatgttggtgtgcctggctgggaagaccagccccgacatgcacctcctgagaaagtcatgccaatgggcctaccctgatgccatgagtccttgagctgtcagtacccacagattgctcctatctgtatttgctctatctcagccctcgtgccagatttacatgtccatggcatgcaacaatctcaatgtgcctgtgtgtgcatcaagagtaactaatgtgtggcttgtgtgaatgtgtgtgttgtgcagttgcagaaacatgaaccatcagtggctgtggttgtgttgaccactgtgccacgctgacactgcataacacgacgtggaccctgatgtgaatgtggaactcggggaacacatggacttgtggccactactataccatcttggacgaacgaccggtggttgcttgcggaccgtgacagcctttggacgttcttgacatgccacgtggcacgccgaagcgcaacacggccttgcaagctgcaactttgcacctctctggccctcccccacgaactccaccctttgcgctccatcacaccccacaaccacccccccacttacacaccttacacatgctgacacacggccactctggcctctcgcaactcatgcaatcgatgctccggccttgcactccctcacctctggcaagcgcactcaccgattgccaattgtgcacacgctcgctgcgcctgcctccggctaccacctcgcgggttgcactcggtgctgtg

SEQ ID NO: 652048 - DNA, 354 bp, Homo sapiens
tagtactcagtgcagcatgtcgagaatcagagacatatcctagtagtgcatggagaaacaccgatgagtccacttgataggtatgtcttatacgcaccaagcacttttctttactcatttaatattcattattctgcaagatagttactagctcatttacagatgaggacacagagaacttacgtaatttgtccaaggacacaaggctacccagtactaccgtatacggacaagccaacactgtcttcatactgtcacactgggcagggggaacagctaggggacagactttgtgagggagtctccctgatgggaccggctggacgtgggtcagactcacaaacaccgtggcct

SEQ ID NO: 652049 - DNA, 298 bp, Homo sapiens
tctctctctctctctctctgtctgtgtctgtgtgtgtgtgtgtgtgtctctctgtctgttttttctacgtgcgcttaaggctaagacacaggtttggattagttttatttgcttcctttttgcgcttttcttcgcgcagagcctgatgggagagtgtccagggcagggaaaccacattttttgtaggtgatagctcagtgaaaattggtgcttatgttttacacttctctgttgtggctctcttgtggtgctatctatctgttttagggtctccgtgaaggcgcactggggaccctgg

SEQ ID NO: 652050 - DNA, 440 bp, Homo sapiens
atgaattaatgaatgggggatctttaagattttatcttctgaaattcgtttaaacaggaccctttaagatgtggagctaatatatattctccagaagtggttgccattgcataggtatagtgtgtatataggaaaagatattttttcttttcctttcctttcctcttttcttttctttttatctcttttcttttcctttcccttttaccttcctctcttcgcctgcctgcttgccttccttcctcctttccttttttctgctgcttttttctcttttttctttcttcctttccctttattatttttaaaaatataaaaagagacgaagtctcgctatgttgcccaggctagtcttaaactcctggactcaagcaatcctcttgcctcagcttcccaaaatgttgggattaggcatgaactaccacacctgaccaggaaaa

SEQ ID NO: 652051 - DNA, 261 bp, Homo sapiens
ccagaagggggctggtcctgatggggctgactggggaggtctggcttctgcccaccaggaggcctgaggagtcaccaggggaaggttgtctgggctgcgcgcgaggggctttttcagccggaaaggaaggggcgcccaccaggctcgacgcccccgaggagggcgctcttgtcccctctggcatccaggcgccactcaggctgtctagaggtctgccgccgcccacgcccccggacggtggtgaagcgggtgtatgaggcc

SEQ ID NO: 652052 - DNA, 758 bp, Homo sapiens
ccgaggacttttggaattgcccccttaaattgggccttttcttgcaataaaattacaccccagaaatgttgttttttaagccaaaaaaaggaatttaacaaagaaaaaaaactcattgtgattatccctggattccaccctttactaaagtacagtgctcaaattgataagatgcagccaaatttctaccctctttgtgttgtgtagaccctgctagtttcctgtgcctattctaaaagctgtggtaaaaatatggccattaaaaaggaaagggccgggtttcccttctggaaccatcatcttcccccagatgggcatatggcatgttagttgcccccaaatctcccctgcttcaagagtcctccccctccacctccaacaaagagtaccttctttgagcatctctggagcttcttcttcaatctgattccatctgtttttccctgctaggattcctcccagtttatgggccatgggaaaattcctagtctagtctctgaaaacatacatgtgtatatatatgtatgaacatgtgtgggcatatatggatatgtatgtatgcccacgtatgtgtgtgtttctatcatttctaatgacctggaacaggggaacactgtgtgtgcttagtcccccctcttgtaactctcaaagcttagtttcaaataatgacataaaggagctgcgccaatggaaagcaaattaaaggcctattattacagccagtgtattttttccacttaataaaaaatggaaagaat

SEQ ID NO: 652053 - DNA, 245 bp, Homo sapiens
ctccatctgccacataatccaatcagcccctttcagaggctgggcagctatggtctacactgagcggggcttctctaaagcagcccaagttgtttttgtctggtccggacaaaacgggttggcttaaaacgggacgaaagaaattccgggtcaagtgaggaccccaattaggttccaagagagggtttacattatcttggtatcagatacctagccgggtgcactgggcagattgtcggtgcccc

SEQ ID NO: 652054 - DNA, 402 bp, Homo sapiens
acaatttttaatacatatctcctagatatgtctttattgatgtttgaaagtagccatccagtttaggctcttaatattttaaaatcagcatcttgcaaatatgacacgtcatagaaatttaaaggaaatccttacatttttcagtgagtcctcttactatttatttcatggtgtcacaggtggggacctatattccttgtgttttataacggcgttatataactagaaagaaatcacaaaatattaatgaaaaatgttttcattatacaaatatattttgataatttttagtatattgaagtaacaatcatgaaagactactgttataacccagaaaagttaataaaatatctaaatctgagaaattgagacagtagaatgtactatctcattattaaaagt

SEQ ID NO: 652055 - DNA, 571 bp, Homo sapiens
acatctccgccttaccgcacccccaaattaccacaaaaccaccagatatcaagagatcttaacatagagcatttaacatattatccagtgcattcatgaggaaagacaaaataatacaaaacacaatgtcatcctatctgagaggaaaatgtctgcagaaataaacgtgatttacacatcatcgcaaagtggaagacaaaaacatcatcaacacaccctcaaatctgggatggggtatacatccaacacaagggctgtatactattatggcatcccatctctggcttttccagttttcacacttgcgaatccaattctttacttcagggtcaggaaattccaaaaacgaagtagaccatatcaaacaacttcacttgggatacccgcctccttatgctgctcttacggtagaacctgcacatattccattgctttgcctataaatttatatatacaaagctaaataagcgaacagtgatacactgacatatactattaaccccagcatgaggatccctcttctgcaaagatgtggcaaatcatatataaacgcaaggtaaacttaagcctc

SEQ ID NO: 652056 - DNA, 468 bp, Homo sapiens
  misc_feature (232)..(232): n is a, c, g, or t
  misc_feature (326)..(326): n is a, c, g, or t
  misc_feature (468)..(468): n is a, c, g, or t
ggacgagttaggtccgtggtctgcgtggaggtcgaggactccgtcgcagacctagcggatcgcgtggtactgggtcgttcaggcctgccaaagaccgccgtccggaagtactagccggacatcatgagtggcgtgtctgggtattcgatcggcgtagagtcaaattgagcgggcctagggtagacaggcacagtcggagaagattggcttcattagggtggatactggactnggtatgaaggaggatcaattgggatcgttggaacaagcagggcctctccgtgcttatgggtcgtgcacatttgttgtgcagggggggactgccngagatgtgggcacttggggagtatgcatagcctgtcgtatctggagcatgtgcattcgtgggagaaaagagaccatgcgttgactagatggatagatgcggtgcacccgatgaggatatctatgcttggaggtgcgtcgggn

SEQ ID NO: 652057 - DNA, 253 bp, Homo sapiens
  misc_feature (112)..(112): n is a, c, g, or t
  misc_feature (120)..(120): n is a, c, g, or t
gttttttgggggatccggggcccccttcttcacttggggtgttttggaagccccagcgggctcggccggtttggggggttgggatatttattgacctggtcctccgattggntgacaggntacaggacccccaacaaccccaatccaggttttggatgcattgagaccccgacattcctcggtatttattgtttgtccccacctaggacccccacccccgaccctcgggaataaaaggccctccatttgccca

SEQ ID NO: 652058 - DNA, 232 bp, Homo sapiens
  misc_feature (75)..(75): n is a, c, g, or t
gtcgctgcgtcgtctaacgtttcgtgtgtgcggcatgatatgtcttagtgtgtgtcagcaaatgtcggcatgttngccttgcttatccctgctggcatggagggggaagcacgcatcggtgcatatttgtgtgtgtgtgtgtgtgtgtgtctgaaaaggtattcgtggccgggtgcagtggctcatgcctgtgatcccagcacttagggaggccgaggtcggtggatcacga

SEQ ID NO: 652059 - DNA, 852 bp, Homo sapiens
ggaagatgccccgggaggagaagggtgcgccgggccgcgcccgcgatgtcaatggcagtgcgcgcattctggaagaagtattgttgcagatctggagtgagtactgaggatgacggacagggatggacattccctgggacctttcttcatccgttggctcaggcaagagaaggagaaggggcaacctacccaaggagtctgtgcagattcttcggtggatggcttgtatgagcaccgttactaggcctatgccttcaggagcaaagaaaaagcgttgctgtcccagctaacatcacgctgtctacgcgtgacgaggtctgtaactggttacctcataaactccgctcgaaggctcctccgcttgacatgctgagaaaggatggcaatagatccaaatcagtgtcatgattacccggcgtggggccgaagatttctgaaacgagctctgtggagtccgtgatgggcatcaaaaacttcatgccagactctggaggagaccccatttcattcctgtacatgtgggccaaatgccaagctagggagtgccagatggcgtccataagccgtcatcgcccgggaatcaagtttgggcctcgtcaaatcggtggattctggccataaacaattgtgatctggcacttggcaaagatgttgcctgacttctctctgccagttcggccgggggtgggacgaaacaccggatatacgcggattgcgggcaaagactttcagaactttcctatgtccaggggccttgaattggggcatgtggaatcaaccgggggtttaaactgctcccctaacagggcgacaggatcgataggcacagatggcgccgggggcagtgattga

SEQ ID NO: 652060 - DNA, 1484 bp, Homo sapiens
cgggacacgacgccgtctctgacagcccgcgggtaactgggccgtagccgccgtccgagctcggcccccgcggagagatcgagctgaaggactgcgcggctggctctcctctagatatggccaatgaagaggatgacccagttgtacaggagatcgatgtgtacttggaccaagagatctggcggaagaagcatgacatcgtacgtatcagatacccgtgatgcggtccagccgtcgaagtgaccatacagagagaccattcacgcaccatcgtcagaccacagactcaaagcccaagacagacagcaaaggctcagcagcattagcagcataggcccaatcaggcaccacacctgcaaccaccaacacatcattagccagcccggccaagcagggggcagaccagcataagcaagcgtagcaacagatgggacaagggggcccatggacggccgcggaaacagggcggaaagacaaggacgaacagaataaataacaccatcagaaagacgacctggacagtgcgacaacaaaggaccgaagaacacacaatatccatgacgctccatataccagccaagaaacccaacacaagggtacaagcacagcagaattcaacaccggagagatgacaatggacccaggacagtggacaaacctccagtaaaacaaagcagacacagacgggggaatggacaaggaccaatccccaaagccaccttaggaaaacactaagcacagtacgtaacacagcacgaagtggggacacgaagattccccaatgggcgacaggacacatgggacaccgtaggaaaaccaccaaacagtagaccagtattaatcaattaccgcagattgaaaaccacccgttggatgcagacaatttactacgcggggaccgatgggaaccacgttaactgacaaaagaagggacaacaccagcaggagggcggaaaacggacacaacgcgcgagcaacagcaggaacgaggtatcacaccaacaaagacagcggcaccatgtgacaccaaaccagcagggggtgacattggcaaacagaccacataccccagatatgactacagaacgacccatcagaggcagggcacacagtatgagacaacacgggagggacacgggacgagacaaaacaaggaaacacagacggtgaaacaattggggtcttgacatacaacaagtcgagcccacaacgggaaacaagtctagcacaagaccgcgcagcgaaaactgggcaccaaggagagcagtctaacatcaacaaaccacaccaccacaggagaggacaacccagggcaggacaacggagaacacaaacagcgacaaaacgaccaaagcgagggagcaacacccagaggacaaccacgagagaaacgagcaccacacgggaagatgataggtgcacgaacggcaatcaccaccacgatcaaaattgacacaacagaagattacaccccgaacagggac

SEQ ID NO: 652061 - DNA, 314 bp, Homo sapiens
  misc_feature (124)..(124): n is a, c, g, or t
  misc_feature (227)..(227): n is a, c, g, or t
  misc_feature (237)..(237): n is a, c, g, or t
ccatgtaaccacgcgcggtcatctgtttttccagcacttcttgcagcaggaaacgcagatcgcgggaggcggtcagggtaacgatttgattatcgcgggtgacttttgccagcgcctgatcggnacgctgatcggcaccattaatgcttacggtgacgcccatcaggcttggatcctgctgtggcagtgtaaatcgtcgggggaaactttcaatagttgtttgggcngttttgcggnatccttgcaagcattaaacaggggcaacttaacggggaaggaggatttttttttgaacatgtttcggggcttttcaa

SEQ ID NO: 652062 - DNA, 310 bp, Homo sapiens
tcgaagagatgcgcctgacaccatgcccatggatgtggtaggtcgcatggagtctgaaaaacagaccctttcacaagtatcccagatcactctgaggcactgctacatgggatgggcatgggaaagcgatggcaagtgtgctgcctttcagggtaacaatgctctgggttattgggccatagcagacattagccagaatacttattttgtcaaaggggcacagcaacttgtcagagcagcacttatgtttcctggctcatggatcaatctaaacaaataaaactggatcacttactgatgccaaaagtcc

SEQ ID NO: 652063 - DNA, 334 bp, Homo sapiens
cagcattcgggcccagatgtctcgctgcgtgtgccttagcgtgtgctcagcgcttacatctgatacaaaaaaagaccgagaggagaaaatacaagccgtacctccaaagaataaaaaggtttacataacggcaatcccgcaagagaaatggggaaagatcaaaattttccccaaattgcgtattgttgttcttgggggttcaataccaccctccccccacacaaagggtgagctctctcgagagtgtgagagagagattaaaaaaggtgagagatcagagattctgttttgtaaggaacaagggcttgggtttctatattcttcgtcgtcacca

SEQ ID NO: 652064 - DNA, 357 bp, Homo sapiens
gagagagagagagagagagagagagagagagagagagagagagagagagagagagagagagagacagagagagagatagacatctccatagagtcttaataacgtttattcgaacattctctcgctcacctctcgcgatcccaatgacctgaggcccattcaatccatatttctttccctttctcctccttctgtacgtttacgacctgtttctttattactctcccctctattctcatatccttcacgatgccccccacccacacccatatacctttaatgtgctctcactattctcttctcttatcctcctccacaatacttactccactccttctacctcccagactatttctt

SEQ ID NO: 652065 - DNA, 580 bp, Homo sapiens
  misc_feature (336)..(336): n is a, c, g, or t
  misc_feature (354)..(354): n is a, c, g, or t
  misc_feature (358)..(359): n is a, c, g, or t
  misc_feature (361)..(361): n is a, c, g, or t
  misc_feature (377)..(377): n is a, c, g, or t
  misc_feature (379)..(380): n is a, c, g, or t
  misc_feature (384)..(384): n is a, c, g, or t
  misc_feature (403)..(403): n is a, c, g, or t
  misc_feature (441)..(441): n is a, c, g, or t
  misc_feature (459)..(459): n is a, c, g, or t
  misc_feature (466)..(466): n is a, c, g, or t
  misc_feature (468)..(468): n is a, c, g, or t
  misc_feature (470)..(470): n is a, c, g, or t
  misc_feature (491)..(491): n is a, c, g, or t
  misc_feature (495)..(495): n is a, c, g, or t
  misc_feature (524)..(524): n is a, c, g, or t
  misc_feature (571)..(571): n is a, c, g, or t
  misc_feature (573)..(573): n is a, c, g, or t
ggcagcccaaaactccaggtgccaggggccccccccagctttgcctgtcaccccacttcccgcccaggggcaggggccaggcctccccccctgcccgtgcatgagacattgccccagaaagccctctttggggcactgctccctaccccagggccctggccaaccgggaggttggctctcctctggttaaagtgggaaaagggggttggccatggggcccccccagaacctcagcatttccttccagcccctccaaaccctgaggcagccttggggaacccccagctggggggttggcagccccctgcccccccccagggttttggggtcctgggntggggcccccctccctgntggnngnactcccccccccccangnntttnttcctttgtcctaaaccgncccccccttcccccccccccagcccaggggggttttgngccgggcctcttgtttgnggggcanancngggcccccgccgttgcccttngacncccgttgggttagccccttggggtttggntttttcagggtcctttttgggccgaaaaaaaaaaagtaaaactttgntnattttta

SEQ ID NO: 652066 - DNA, 115 bp, Homo sapiens
gtttctgggcagcccccggtcccctcaggcccgccggccttccgggccaagcttcgcttcttcaggcagcttccggcgctcctaggccttccagccgttctttagtaggcgggtt

SEQ ID NO: 652067 - DNA, 882 bp, Homo sapiens
  misc_feature (882)..(882): n is a, c, g, or t
cgcagtggctcacgcctgtaatcccaacactctgagaggccgaggcaggcagatcatgaggtcaggagatcaagaccatcctggccaacacagtgaaaccccatctctactaaaaatacaaaaaaattagccggcgtggtggcaggcacctgtagtcccaaccactcaggaagctgaggcagaagaatggcgtgaacccgggggcgtaggttgcagtgagccgagatcccgccactgcactccagcctgggcgacagagcgagactccgtctcaaaaaaaaaaaaaaaaaaatttttttaaaaattattcggggtttgtgtcctaccccctttttgggcctaataggctgggtttaaatttcccccaggttggtctggcttcagaaccttttccatttcctcagagaacctgggatgggcttatatgaggttcccagactttcatggtggggttggggttggtcgggggcactggtgggtacccttcgctattttgtttacaccttattatggtgcgccattcgggtggtgtattggaccctgtttgctttttggaattgggtgccacggtgagtgctcctgtgtgcggtagaaaattaacccggggactacttatgttaccaatctgggggaaattaatctagttaacaggtaggggtggggggtcgggaatatcttgggttcaataggcccggtaaaatacttccctggtcccggccaaggggggcggatagtatgttggtgacaagcttgtgaagatcctgaaagcgttgatgtatgggcttgataagaaaaatccgggtaggaatacataggacaccggttttgggaatcaagacaccggggggatattgaagagagtggtccctgggtcggagtggn

SEQ ID NO: 652068 - DNA, 600 bp, Homo sapiens
cacgaactattgaccacgcttctctaatatttgctcccttgggatctgtgacaccacttctctgtgtatctcctatttcttccctggttagtctttcacacttcccatataacctaggcagcattccttggtactctgtccctcgctagtctctctctctccctccctctctctctctctcctgacaacctcatactctctcaaaacttcagttacattcaacatgataattagcatcttttatgcttatatgctgctttaaaatttacaaagcattttttcatatattgtctcacttaattgtcataacaaccctgcaagtgagtagagcaggcattcactaatatgacccttgtcttacagatgaggaatcaagatcagagagttcagaagttcaaggtctcataactagaaagtgccagaaccagaataagggccgggcatggtggctcatcctagcactttagagaggccgaggcgggcagactgcctgatctcaagagttcgagaccaatctgagcaacataggaagaccttgtctctacagaatattaaaaaattagccgagactgtgtgactgcacggagtgagactctgtca

SEQ ID NO: 652069 - DNA, 147 bp, Homo sapiens
  misc_feature (15)..(15): n is a, c, g, or t
tcctgctcgctctgntctagctgttgatcgatgcgctgttgctgctgatgcctgaatctgcttatgctgctgcggctgatgctcctcctgctgcttaagcggcttctgctcttcggccgcgtgcctgatcggggctgctccggcttc

SEQ ID NO: 652070 - DNA, 466 bp, Homo sapiens
  misc_feature (6)..(6): n is a, c, g, or t
  misc_feature (27)..(27): n is a, c, g, or t
  misc_feature (32)..(32): n is a, c, g, or t
  misc_feature (166)..(166): n is a, c, g, or t
ataganccagggtttcaatatgtcaancgggntgatcttgacctcctgaggcaggagaatggcgtgaacccaggaggcaaagcttgcagtgagccgagatcgcgccactgcactccagcctgggcaacagagtgagactccgtctcaaaaaataaaaataaaaaancaataataaagaagattttgggtcgggcgcggtggctcacacctataatcctagcagtttgggaggccgaggtggtggatcacaaggtcaggagattgagaccatcctggctaacatggtgaaaccccgtctccactaaaaatacaaaaaattagccaggcgttgtggcgggcgcctatagtcccagctgctcgggtggctgaggcaagagaatgtcatgaacccgggaggcggagcttgcagtgagtcgagatcacgccactgcactccagactgggtgacagagcgagactccgtctc

SEQ ID NO: 652071 - DNA, 400 bp, Homo sapiens
  misc_feature (209)..(209): n is a, c, g, or t
gcataaacgataaagttattaaggctccttttataatacagttgactcgaacaatgcaggggttaggtgtgctgatcccctgcgcagtcaaaaatccacgtgtaacttttgactccccaaaacctccctactagtaaatagcctactattgcccagaagccttgccaataacataaacagttaacacatattctgtatatatattgtancctgtattctttaataaagtaagctaaagaaaatgttattgaaatcataaggaagaggaaatgtatttataaccctgtattgtatttgtactgtacgtgtacatggtctgtttacaaaatgaatcgtctgactgaaatgactgctgctgcccactccaaactatggtatatatcaaagcaattcccctttt

SEQ ID NO: 652072 - DNA, 218 bp, Homo sapiens
tttcgctaataataataataataataataatacccccttattgaatgtggccagctccctaaatgaggaaaaaggaaggcattttttgcatttttgcctagttttccttataagcccccctaagttaaaagctctgtctttttggggtttgccctatgtaaagcttttaaaactttttaattgggcttttttatgtattaaatgtttttccttttgca

SEQ ID NO: 652073 - DNA, 457 bp, Homo sapiens
caccatcccacaattagtttaatctgaaaaaaaagggtttttaaagttaaaagctccagcaccttttttttgggctcataaaaggcataatctgtttttttttgtttcaacaaaagtaaaatgttcaagtttggattttggtgtaaaaccaacaataaatttgtccctttgactccaatgcaggggctcgggggatggctcacaggggaataataaaacggccttctttttaataaatgggagggatcattcccactggggaactgaccatgtgcccagtgtttttgccaaacatttggaccttataggggatgagctgttccaaaaaccctttgttggttcggttgagggcccggcataatttgttccacgtgtgggcgtccaccagggacatgggggggtctttaatgaggtaggcgaggccacggggcatttatcggttaaccaccaatacaca

SEQ ID NO: 652074 - DNA, 310 bp, Homo sapiens
  misc_feature (42)..(42): n is a, c, g, or t
gcgcgtgtggtacacgcccacgccgagcgattgtagcacggncttggctgacccgacgccgtactacatgaacctgctgggcatgatcttcagcatgtgcgagctcatgcttcagcttacgtggtgtgcttgggtcgctgtctactgctccttggtcagctttgccgactctcggagctcggaggacacgaagcaacttatgcgtagcttcctgctgtccatctctgccgtggtgactgtcctatctgcagaatcctcagcccatgacgcccacatggtgctacgagactagaagggtcacataatggac

SEQ ID NO: 652075 - DNA, 187 bp, Homo sapiens
tggcatttaaatagaatcttctactgtataaatcaagtcttaaaaatctgctgagaggccaggcacggtggctcacgcctgtaatcccagcactttgggaggccaaggcgggcggatcacgaggtcaagagatcgagaccatcctggctaacacgatgaaaccctctctctactaaaaatacaaaaa

SEQ ID NO: 652076 - DNA, 766 bp, Homo sapiens
gcaaagtcaccggctgagtgccaagtccccagatgaaggaatgaagcaaaatctccatgctgaggtcaagtccccgtgagaaaggccaagtctccaagctgaacggaggaagcaaatgtcccctgagaaggccaagtcccctgagaaggccaagtccccagagaaggcagaggccaagtcccctgagaaggccaagtccccagtgaaggcagaagcaaagtcccctgagaaggccaagtccccagtgaaggcagaagcaaagtcccctgagaaggccaagtccccagtgaaggacagaagcaaagtcccctgagaaggccaagtccccagtgaaggaagaagcaaagtcccctgcagaacggccaagtcccacagctgacaggaccgaagcaaagacccccgagaaggccaagtccccagtgacaggacgaaggccaaggcccctgacaaggagatcccaaaaaaggacagaggtgaaggtccccagtgaaggcaggacggaccacagcccacaggaggtgcacagtcacaagcagcccccgaaagaagggcacagcgacgagaaagccactgacacaaccaaacacagcaacacaagacagaccaacaagcacgcacgcaggcccccaagcaacggacaccagacccaaaggcccaaggaggaaggccacacgacagcaacctggcggacagcaacacgcccaaagaaatccagagtacaaaacaacgaagcgaacaagactaaagaataacgacaaaagatcca

SEQ ID NO: 652077 - DNA, 187 bp, Homo sapiens
gaaggacgaacaggtcatctagcctcggacctcatgtggcgtgaaggagagaaggtattggggtctggccatatctttgcatcctgcaatgacactttagtccatgtcactgatcatttctgggcaagtgcaaccatctgccgttgcgactggctagggcatgaagattgagggatgcctctgagag

SEQ ID NO: 652078 - DNA, 145 bp, Homo sapiens
ctagaggatcttacacgtacgccttctaagaccccatccttatcccaagtctccacaagagctaccttcctcaaaacagtaacagaaacacatctaagcttggcgtcactgacaattgaagttctgaattccgccctcaccaaag

SEQ ID NO: 652079 - DNA, 135 bp, Homo sapiens
ctgggaccaatcttcaaggtcgccagcatgcgtgcggtgatttctttggacacccgctccacccaatcaaacggcgtatcgagcggcaaatcatccaaaatctctcgttggcaattggtatacatattagtctgt

SEQ ID NO: 652080 - DNA, 225 bp, Homo sapiens
ccattcccatccagatggttttggagacactgtgaccactacaggaaatgggactcggccccacccaagctacctcaatgcagagtgcacctcccacctggtacctgggcaggcctacatcacgtggctccgatattactaacaatgtacgacgtcctcagactgagaggggctcccccgacccgatccagcatcccccgcacagccaccagaacacaccgacgg

SEQ ID NO: 652081 - DNA, 100 bp, Homo sapiens
tgagatagacccaaaacgacaggatattctcggaattcaaagactgaacttacagaaccccacagggcttcatctgtagtctttcactaggagaccctga

SEQ ID NO: 652082 - DNA, 228 bp, Homo sapiens
gtcattcctcctgtgtgagtcccagtaatttcgcactcagtaggtacttcacttgggtcagttaagacggaccatctatttttcatcgtcatcagtaacactggatagcattctcttcttagcagagtaatctaagacaaaataatttcacatatctaggaagcatggcactccagtggcatggcaatttagtgtatttatgcatcccaatcacatgttcagcagcat

SEQ ID NO: 652083 - DNA, 334 bp, Homo sapiens
  misc_feature (182)..(183): n is a, c, g, or t
gctactggagccggtctcagagagtgtgttggacgggcattcctcacacgcgccttatgcgacaacgaaataagtcggcatggatgggttcactgcctggcgcctcaaggttcgtggcggtctgtaagacctatcatagaacagctttgccctaactctcggggcggcacttggcgtacacnngaggtcattgcatggggaagatacccagcgctacgtgacgagcgcgacctctgtgaggcagagagtaggactaagagataagctcatagatccaactactcggagagaaggaaacatgctcgatgtaggctactggaaatcaggcacgaga

SEQ ID NO: 652084 - DNA, 110 bp, Homo sapiens
  misc_feature (110)..(110): n is a, c, g, or t
ggttacaagacctataaccaatgtgcaactcacaattggctacaatgcgttacacccagtcaaactacttttacaggtattacacaaagccacccaatgcgatatttggn

SEQ ID NO: 652085 - DNA, 209 bp, Homo sapiens
caaggaggcgtcctggtcctccatggggtccttgatactatcctcgtcacagagccactcctcgcagcatgcccggtagctttgactagccgagggttgggacagcccaagttaggagagagatagttcttagggatcgacagagtaatgcagcccactggcgtcatcatgtacatgtgcactgactgttttacggaatgggttgtaaa

SEQ ID NO: 652086 - DNA, 594 bp, Homo sapiens
gaattgctgtgctgtctgtgtaacactcagtaaagagattgtaagctgacttactagaattactggagcgagcaattgacacggtggagacatacagactatgtctttcagcgaatgactggtctttctatctcttgtactaaactgaattcaccccactgaaaaagatgagtatgcctgccgtgtgaaccatgtgactttgtcacagcccaagatagttcagctgggatcgagacatgtaagcagcatcatgtacgtcagaagatgccgcatttggattggatgaattccaaattctgctcttgctttttacatattgatatgcttatacacttacactttatgcacacaatgtagggttataataatgttaacatggacatgatcttctttataattctactttgagtgctgtctccatgtttgatgtatctgagcaggttgctccacaggtagctctaggagggctggcgacttagaggtggggagcagagaattctcttatccaacatcaacatctaggtcagatttgaactcttcaatctcttgcactcaaagcttgttaagatagtgcgcgcgccacacccaggtaat

SEQ ID NO: 652087 - DNA, 1151 bp, Homo sapiens
gcctgctgatgtggattcgcttgcagggtgttgtggaccatgtgggggtgtaacaggtgggatgtgtttgcacatgccgtgaatgtttgtcatcgagaggatatgtgggaagttataaagcccttctgtgaggaggtcattggatagtattttcgcgcagatgttttcttgaaaaaacgttggatttagtatgaggcaattcgggtggagagtgtagccacgcgtgtgtgtttggggcctccacttggcggctgctatgttgccatgttgactagccaaggggtcccattgggtcggggtctgttgtatgcctccgtttgagtgtcacggtaatggggttcctctcggagttttttggatgaggcgtttttgggggcgaaggggtaagcgctggtcgccggtcggccaggagggttgtgagtgttcaaggcgctgtgcacgagggtagccagtgggaacagtgagtttctgtggccactgtgttaggaacattccctgtgtgagcccagaggtgggagttcccgtgccctgccacgttgtgggtgcttgtgtcgccgtgtagcttcaggagatttccaggaaactgctaacaggcactttttttaagcttggtcgctgagaggcacaggaagcactgtcagctgccgttcgagtgccacagtgtccacgccttcgcccagggctggaggaaactggaggacccgttgagccgttcacgctgagacaccttccccagctgctgttttcaaggctgaagctggcccctttgtccccacgctgaggattggaccacgagtcgttgtcacggtaccttgaatgtctcttgcccactgccaccacgcttgggctcacggggcacagtgcactggtcctgtctgcccttctctggccacgaagggcaccacggacactgtttgttttaaatgaaacctgcctgcctcacgattgctgttccccgcgggacgttaaatgcactcgagcacccacctgctggggaatttgagcttaataagaaattggaaatttctgagaatcccactggacggttacgattgggagggaaagcttaaaagaatgtcccttttgtgagaagggaatggaattgttttctttcattcgtaaagttagtgagtaaagattttataaatcca

SEQ ID NO: 652088 - DNA, 1103 bp, Homo sapiens
gaaacaacccatttttagttttaaccagttgtagtcaaaatgctacaataaacacaaaaaagagacagcaaaatgaagagcatttgactcccgcacttaaaatgaagtacacataaagtttaaactggttatgacaaaagcctatagttgtgtttcttgaactataaagaaaacaaattttgggcagtctttaagtatatatagcttaaaatataatttttagcattgggcaccatatgtatgccattatattggatttggcattactgtttcacaatgaacgctttctttaaggcttggattcttatgatctatgacacgaactaaggcacaaccacagtttatctttcttaaatttcatcactgttgatgtggtcctttggtgttacaaaacacagtgcaactatcaaaactaaaaaattatagagtactatggccgttctgctgaatcaaaatatacaatacatcatacatacttttacaagcaacgctcaactgggcagatacaagttgacatcatagaagatgcaaatgacctttcaaaatcaacacaatgtggttctgaaactttcgtgacctaatacccatgcatctgtggctccaatgaacctactgtggctctcgaactcgggtgtcgacccataagtactactacattgagcgtcacactttctgccttggtcataaattcttaacagcggtgacgtcatatctgcttgtactacgcccttcacttccaattcttaacacggctttgttgcccatttgaaaacaacaagttgctactcaatcacggaacaagtctcttaaaggagttcaccctgttagaccatgacggacgtgggctaaccctataaacttgtgggatagtagccccgttgtcgactatttctaaacgcccccagaatattattacctgggatataaaaacacacgggggtaaatcagcacgcacaaacatagtgcgggacagcccgacttgaactagtgctgagaccacacaacaaatagcgcgctcgaagtaatcaatctgctggaggagcaacagacgatcttcataatcgagtattacctgctgttgtcttgtctattagcaaagatga

SEQ ID NO: 652089 - DNA, 188 bp, Homo sapiens
tctggcaccgatggaggatgccactagattggttgctggcggaagggatcagacatggttccatcaatgcttgactgtctattgccagctatggatactgtactacaatgtcatgatcttcatcaatgccacgaacagtgccagtagtagttaaagtctcaaactattccatgagtccatcctccatg

SEQ ID NO: 652090 - DNA, 1418 bp, Homo sapiens
agttgaaagaatatgggagtattgggggaaggatgttatattgtgtttaagtgtataggtagaaaaggtgagtgatggtaatggatgaaagaatagtatgaggtggaaggtagaacgaagagtagaaggtaaggaagatgaagaatatactagaagagagaaagtggtagggagatgatggtagtgtattattataaggaggtgaagtagaatagagaagaacgaggatgagagagaggtagagtatagaaaagatatgggagtagagtaaggaggagttaatgtatataaacagttagtgtgtataggagtagaaaattcgtgttgagcgtgtgtgggtgtggtagttggtagttagttgagctgtcgtggagttgtgtggtgcggcgggggggcggggggcgcttgggtgttggttagtgtgcaccagccgcccgctcgtagtgtttgtttccgcgcctctctctcgtgtgtagataatttaaaaccctcccttcttttggttggttgttactttatactcttcttcgttgcgtttttttggggcgacgctctccctttattggggactctcgtctagtgtgggttcgctctccccacacgtggggtggcggccacacatatcgacactccgcgcgcgtgttggtagtatatacaccacgcgcgcgccccccctgcgcgctgtttttaaacgacgcggctcgctctcttctaagaggggagggcgagagggcagcgcgcgcgcgaggggagagaattatatttcctgcgcaccgcgcgagtgagacatactctctctctcgcgcgagagagagatatttctctctttagagatgaaattatctcacacagagagacacacacacacacactctctcgtgtggagaggatatacacacacattgataagacacacacatcacacaccacactcttcgcgcgcggggtgttatatatatatgtgttctcggatagactcttctctctcgcgcgggttgtgttgtggccaccacacacacgcgcgcgggtgttctcactcccgcgcctcctcgcgaagaaagatgatcaaggaggcccctctctctctcaggagagagaaaaagagggacgccaacacacctccgcggggtgtgttgttttgggtgtgttgtgtatataaacacacacccttttgtttatgggccccactctgttttttaaacccacgagaaaaaaaggtgtttgttggaagacacactctcttagtcgcggggggggggggggaccccgaggggttgttgaaaaatatataatgggaaatataggtgggttttttgagagagaaaaaaaaaaatatattgggtttcccccctggggggggagcgcacccccccccacccccacacacaaaagagagagagagaaaaagaagtgtgaga

SEQ ID NO: 652091 - DNA, 256 bp, Homo sapiens
ctatcaagctgtgggacgtgcggaatccatgtgccgacagaccttcatcgtgcgtgaatccgacatcaatgcaggtggtttcttccccaatggctacgccttcaccaccgggtctgacgacgccacgtgccgcctcttcgacctgcgggccgatcaggagctcctcatgtactcccatgacaacatcatctgtggcatcacctctgttgccttctcgcgcagcggacggctgctgttcgttggcctacagcacatg

SEQ ID NO: 652092 - DNA, 916 bp, Homo sapiens
gcatgacataatatggcggctctctgatgtctgagtgtctgcgggtgtgccttatgcactcctccctgtgttgaggctaactgcgcagtgcgattggagctttgtacgtgtctcagtgactttgttcaggacctgggcctttttgcgagagagtgggtgtggcgagtagcagggctattgcacgtgtgtcaacccgagccacgacgcaattcatggcctctcgagaggcttgctactctcgtcactactaggacgtagcggagaggggtttagtccaggatggtttgagcgtccttgggttctgcgtctcccgtcctgtctgtattctcgagatcctgtgccctgacgaatggacctattcgcatggtctgtgggacccatccaactgctgtcagggggtcactgggggcctgtgccaccacatgttcgattcacgtggagcgtatgtggccagtggtgggatgaccatgtgcctaaggatacgctgtacaattgattggccttgtatggtggacttaagcaggactttaaaacctttgatgggggtcttcgactatacacagaagatattcgacggatgttgccgcggccctctggtggcagtgcttgttgtgcatttgcgttgggcggaaagctccctgacccatttttatgacttcggttactttggcatgactctgggagggtagtagccgtcttgtgcgctctggccttgtgtcttttgccatttagttcctcacttagtatgggcctgattgtggtcagatatgtccttgtgggtgcggtaggcctttctgtcttttttgttccccgtggttatttcccggtagtgtactctttggggcccccaggttcgggaggcatttaattcttgccccgcgaggactggggcccatttggcggcccccaagggggg

SEQ ID NO: 652093 - DNA, 351 bp, Homo sapiens
aggacgacggacatctgaagccgagcgtaggcaacgggacagagcgtgccaaatgaccgcgtggacacagaacgcatgtcggagctgtgaccgtggcggtccctttctgtgtgaagttccggctgagagggcaggacatggtggtgtgacatccagcggcggcaccgtccgggtggggctcaagtggagcagccagcgatcattgatggggagctctacaatgacagtgcaggtggcagcagcagctcgtggatcaattgaggcagcgcaggtggtgactgtgcatctggagcacagcatcaataagcatggagtggtggcaccgcttggtgtccagtgcacctgaaagct

SEQ ID NO: 652094 - DNA, 416 bp, Homo sapiens
tttccccctacccccaaccatgccctttagggtagcagggcagcagcataccaaaaaaatgtgctgcaggactccggaggcggcctgggtgggttaaccatggggcagtttacctgggtttttaaaaagtcgggagtgaccagctcaaaaagcatgaactgatgctggcatgaaggattcccggaagatcatggagacctgggtgggagctgtaacaaaaatggtggagtccaaggaaacagcccgtttttggggaatggggctttttttgggggacccttggccccagcttttagagcccttcccctgtgtcctgcccccatgtggggcaaatggactttttgtcccatgaggagaggggtagttcatgtgttttccctttttgtgagcatcctaataaatttggtcccttttta

SEQ ID NO: 652095 - DNA, 717 bp, Homo sapiens
  misc_feature (327)..(327): n is a, c, g, or t
caagggcgggtcccttattcgtttcctcccgcagttccccgggtttttaccgagtaattgggtgtagtctccggcgctgcaaaacacctgttgggtcaatcgcgcgccacccccttcctggccccaaaaataattggggcaccaccactgccatccacccaagctgggcaccaaaagttaaacagaactcccctctggtagcatccacgtcctttttttgcgcccccccggtttttgtataaaaaacgttacttccaatgcatcagcaaaatctaccccctagtattttttctccctcggactccacatttatacactaataggtgncagaaaatacccatacttataattcttcggggaaaagtgagtttcctccctatcgccacaatccacgccgttttatatgccttctacaacccccatccccgcaccttttttgttattgcggatctgcacatttgcctccaaaactaattctacaccacacgggtggtccataccgcaccccgggagtggagcaacaaccacagcgatgtgggttcttttatttataatgtcccaccacgccttaatatctttgaccgagtatagtttattcacccaacgcacaaactataaataatattttttctgttgtaaaagacgagacaccattttttaaaaaaaaaggaccttttttaaccaagggaaaaaaaaaggccttttcccccaaaaaaa

SEQ ID NO: 652096 - DNA, 1245 bp, Homo sapiens
  misc_feature (334)..(334): n is a, c, g, or t
  misc_feature (472)..(472): n is a, c, g, or t
tgggaaagggggtctcccttctgtgttcgcccgaggcttggaagtgcaagtgggggggaatctgggcctcacgtgcaacctcgtgcctccgtggttcggagcagttttccgtgcctcggcctcccgagtgtggcacggggattgcaggtgcgtgccaccacgccttggctaagtttggggtattaaggtggaagaacggggttcccaccttggttgggctcaggcgtggctctggaagcctcctgtgaacctcgtgtgaatctgtgcccgccttgcggaattccccagagggtgctgtggggaattgcaggcattgagccaacgcgggcctggnggcaacaatagagaataactttctcgaaagaataatttgggggttctcattattaaactggggagttaggataatttaaaatatttttaaaagcttcattacaaacttaggagtgttattcctcctctcgagtttagnccattagtataagcggggggtacatctcccgagaaaaattcgtggagaatcgcggagttatactgtggaataccagagattttcatacttttattattccataaccatttaggtatattttaaaggaggaggggtaaacacactctgggtctctataattttcgcgcgtatataaaaatttctttattgggggtgtaacatctacgaaatctaagagaaaacaagggttattaacataaaagggttctcctatacaatcccttcaatggtgaaacccttatatttactggtgaaatttcaaatgtgtgttctgtacggcaaccacaaaggtctggagcaattaggcgggagtttacaggagaaactattttaacagtgtcaccagagaagaatatattttctaattgtgaggggggggaccctctcaaaagttgggagaccaaaaaagagattaggacttagaggagttgacacagattttctctaattcttttaaaaaaaaaaggtctgggcgaaagtctcttatgcgatgcgtagttggggcgatgtcccccacagcacagccaaatgtaaaccatcttaaggggagggagacaagaggaaaacggcggggttgttttttccccgttagaaaactagtgggttttttgcagcagaactatagttggggatacccagtcgggatgtttttaatcaaaaactgttctttggagtttggcgagaaagaaggaagagaaaggcaagagatggtaagagagaaggacaagcctgtg

SEQ ID NO: 652097 - DNA, 316 bp, Homo sapiens
cgagctcgtttccctgtcggtgtctctaatgcctgtaatcccagcactttggtaggccaaagaggattgtctgagcccaggagttcaagaccagcctgggtaacatattgggaccccatctctataaaaaaaaaaaaaaaacctggggctggggggaccacacctgtaatctcagctcccgggggggctggggggggaggatctacctgtcagctatcggggaggctggggggggaggattacttgagcccaggaaatcagggctgcagggaactgggattgtgccactggcctccagccggggcaacagagggaa

SEQ ID NO: 652098 - DNA, 160 bp, Homo sapiens
tcgccatcttcagcaaatcctgatgaaggctacaacagtaagcgcagtacccacgttaagacgttagttcagcgtgtaacccagtgaggtggcgagaaatgtgctacattttctaccccagaaaactacgatagcccttatgaaacttaagggtcgaagg

SEQ ID NO: 652099 - DNA, 472 bp, Homo sapiens
gctgagctttgtgcccgttactatagtacacttgagactcatgcccaggattgccatctcttctcatcgaggctataatttgtgagaacctgccttctttgttttatcttgtacggatcagatttggagctgttctgacctctcttttgttttccgtcaatccctgaatgtcagcggtgagttagttgatctcacttgtccccatcactacctctctcctagttgcgctgtgtcacccctcaattcctctaatgtgacttatgatgctcctttcagcagcacccaatgaactggggattcattatgagaaaactgtgcctcttaaggaaccacaagatccatagtagccccctgctgttaacatacatgccactgcctggtgttcaagggcccctttggttacccttgtttcctagtactcaccactcccaaatattttactctagtcaaacaattctttctttttccccct

SEQ ID NO: 652100 - DNA, 372 bp, Homo sapiens
gttatccattctgtttaatcagttccctgggttcaaggaagtacgtttgggtccagggaggcattacattgcttttgtttaattttaaaatgatgggcaggctggagctgccagggatgctttacagggaattaagatcacaccgttccctgctattgagatcccctttgccagagaataacctttggggaagtgggtctttaaaagactgggggttttttccagggtttgtttttataacctttgggtggggcctttttatagttaaagattggggggggttaaagttaaatttttgtgaagggctttaattatccagtgtttttttagccttggtggacttttaaattcgaaggccttaattttggacca

SEQ ID NO: 652101 - DNA, 890 bp, Homo sapiens
tctcatggtgttatatttttattttcaaaaaaacagagttcatttgaatacaattctcactagttaagtcacaattcacccggccgggcgaccgtgtccggcggccattgggaaaatttccccacggttactgggtccacgtggcgggctgtgctgtggtggacctccctgaagagtcagtagcgtcgagggtcgcccgaaagtctggaagtggagtcttcccgggttaatccatgccgggttgcaggctgttgactctgttcggtgcccaggtgctgggtcgacatcgagggacgggcctgggtgctgccctggtgcccgggtgaacagaaacacacatctggcttgtggttagaggtcttcatggaaagagtggtccttggggggatgagcatctttctgaagaaattgtcccatgtcattaagcagttggtctctgatgaagataaagcccaattagcaagtacagtgtgtcctctgaaagatgaaccgatggcctatacatccttgtgaaaccaggtcccttatagaagttggtctatattgcctgaacgctgggcatgatagcctttattggaccaaggatggtcacaagcatgtgggtcacaattacttccaggtacaagaccagtcagtggcttaagaataatcgcgtccaggggaaaaactggtatgggaaaaagtgggcaccctgttctgtggagaacaacactgtcttcaacgtctgcggaaaggctctctccattatgggatgttgccggaatggattggcgcccaaacaggcgtgactcttggtattacagcaatgcgtgcaaagcaggggccccttaaggggcacactttgtccgaagtttgttgtccgccccacaatggaggtcggggttcaaatg

SEQ ID NO: 652102 - DNA, 135 bp, Homo sapiens
ggtaccgtggcggacacgtactacgttgtagctcacttccactattctatcaataggagctgtatttgccatcataggaggcttcattcactgatttctgctacatctcaggtactcctattacgtgtccggcca

SEQ ID NO: 652103 - DNA, 1186 bp, Homo sapiens
  misc_feature (351)..(351): n is a, c, g, or t
  misc_feature (360)..(360): n is a, c, g, or t
  misc_feature (366)..(366): n is a, c, g, or t
  misc_feature (368)..(368): n is a, c, g, or t
  misc_feature (371)..(371): n is a, c, g, or t
  misc_feature (374)..(374): n is a, c, g, or t
  misc_feature (382)..(382): n is a, c, g, or t
  misc_feature (394)..(394): n is a, c, g, or t
  misc_feature (751)..(751): n is a, c, g, or t
  misc_feature (787)..(787): n is a, c, g, or t
  misc_feature (800)..(800): n is a, c, g, or t
  misc_feature (802)..(802): n is a, c, g, or t
  misc_feature (812)..(812): n is a, c, g, or t
  misc_feature (818)..(818): n is a, c, g, or t
  misc_feature (823)..(823): n is a, c, g, or t
  misc_feature (830)..(830): n is a, c, g, or t
  misc_feature (836)..(836): n is a, c, g, or t
  misc_feature (840)..(840): n is a, c, g, or t
  misc_feature (855)..(855): n is a, c, g, or t
acgagagagatcgagccacacctagtgtggacacgcgcttgtgacacagcggcgacgccagagtggggaacaagtcgtgaaaggcaccctgcataagagacaaagggcccggggataccccggggcacacccggggcaggggactacttcagactccaaaatagagccgcgaccagtacgcggggtgtccacactggggacatcaaggcaccacatcaacggggctctgagaaaccaggcatgattaagcaaattcgggctgcggatgcttactgaagaacgaggatttctggtggggcgaacgagtgacatggcggacatcacaggtgtgtgccactctgttgtggctcnataagcagntcagancntcnttncgcaggcnttccaatacaancgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtaccttatgtgttggatgaatttaagcgcaagtactccaatgaggacacactctctgtggcacntgccatatttctgggagcacatttgataaggacggnctggtcccctgtngnatactcagangtatcngcttnccctganagaacntcancatcagaccttcatngagctgcaatctcatcactggaatgttccagcgactggacaagctgaggaagacatgccttcgccagtgtcatccttttaggaaccaacaatagcagctccatttctggagtactgggtcttccgaggccaggagcttgcctttccgctgagatccagattggcaaggtggactacgagtcatacacatggcggaaactggatcctggcagcgaggagacccagacgctggttaagagagtacttctccgctgggagggggccttccagcatgtgggcaaagccttcaatacagggcaagatcttcaagtgaacaataatctgccgatacc

SEQ ID NO: 652104 - DNA, 276 bp, Homo sapiens
tatgtcacttcgcctgggcctgtttccctggcagcggcagaggtgctggcctacgcgtaagcaccaccacatgctcctgtcacactcgctaattttatccttccatcttaatgttttgtttgtttgttttgcgctggcgtctcgctctgtcctccaggctggagtgcagtggcgcgatttctgctcactgcaagccccgcctcccgggttcacgccattctcctgcctcagcctcccaagtaagctgggactacaggcacccaccaccacgcctgg

SEQ ID NO: 652105 - DNA, 552 bp, Homo sapiens
tactaaagtcgcgtactactactaaattagctgctggggaggatgaggcaggagaatggcgtgaacccaggagatggagcttgtggtgagctgagatcacaccactgcactccagcctgggcgacagaatgagactctgtctttaaaaaaaaaaaaaaaaaacaggctgggcgccgtggctcacgcctgtaatcccagcactttgggagggcaaggcgggcagatcacaaggtcaggagattgagaccatcctggtctaacttggtgaaaccccgtctctactaaaaatacaaaaaattagccgggcgtggtggcaggcgcctgtggtcccagctacttgggaggctgaggcagaagaatgccgtgaacccggaaggcggagcttgcagtgagcccagattgcgccactgcactccagcctgggtgacagggcaagaatctgtttcaaaaaaaacaatcgggaattgaaaagtaaaaggcgggtgggggggcttacacctgtaatcctaaccctgggggaagggccagggggtggattccatgggcatgaga

SEQ ID NO: 652106 - DNA, 455 bp, Homo sapiens
gatatacagccggtccggtgttatcgatgcacagtgactccatcttgagtagggcgggtaaaataaggcagagacctactaggaggctgcattcccggaaggttagttgtgtttagtcatagggcgagatagggagatcagcaggatacatgtcacaaagaccttgctgataaaacagcatgcggtaaagatgccagccaaatcccaccaaaaccaagatggcaacaaaggtgacctctagtcatcctcactgctcaattatatgctaattgtattgcattagcatgctaaaagacacttccaccaatgccatgacagtttacagatgccatggcaatgccaagacgttatcttatatggcctaaaaaggggaagaatcctcagttccaggaattgcccacccatttcctggaaaactcatgaataatccaggaaatgggtggcatcgataaaca

SEQ ID NO: 652107 - DNA, 661 bp, Homo sapiens
tagcgggatgcaggagcagtgtcagaggctgtgcaggcagtggagccctgggcctgtcccacaaaaccattcttcccttctaggactctgggcctataataggaggggctgctgtgaaggtctctgaaatgccttcaagggcttctcccattgtcttgtctattagcacttggctcctttttacttatgcacacttcttcagcctgcttgaatttttccctggtaaaaatgggccttcttttctaccacatgagcaggctgcaaatggttccaaacatttacgctttgcttcccttttaaatacaagttccaactataggccatttctttgttcatgtatatgtgataggttgttagaagcagccaggccacatcttgaacattttgctgcttagaaatttcttctgccagataccctaaatcatcactctcatgttcaaagttccacagatccctagggcaggagcacaaggcagccaagttctttgctaaggcatagcaaaagtgatctttgctccaattcccaataagttcctcatttccatctgagatctcctcagcctggacttcactgtccatatcactatcagtattttggtcacaaccatttaaccagtctgtaggaagttcacactttctctcatcttcctatcttcttctg

SEQ ID NO: 652108 - DNA, 1205 bp, Homo sapiens
ccttttccccgcagttttgtcatcccggtggtctgttcctctacatatgtgaggtctcgctattggataatgggtgcgttgggaagggactactcggggtgttaacgggtgtctggctccttcgcgcctaaatagtggttgacaacaccccgtgggatgtgtgtctatatggtggattattgcgtcggtaagtgcgatactacgtgtcgcgctttggcccccccgggtttgcggatgcgctagggtgtgacttaacggcgaatccttccgtgtctccataggtgacagcgtatacgtctccaggggtaatagggccatctcaatccgttggcacgaccacggttgcgcgcttgcgtcagcgagcacagtggtcgtcatgtagcagtgggggactgctcattctatggtggtcgtcgactggtatgccctaatggtgctatcgcccgttgggaatacgtgcggatctgtggctggagtgctcaggacccttgcgggttccgcgtgccaacgcgggcgagttaaccctttggtgtctctggggacacgggtactcccaacgtgttgccactgattgtagagttgcggcgcacttggctgcgtaacaccaatgtggggggaaggagagtgcaaaggcatgccacgctgtgcatcgctttggtgaggagtgtaccgtcggtgtcaggtttcacgtgtgtaatctcgtgggaacgcaatgggactctcccggtgatgccattcatgggatctctttggggacaggtcgtgtgcgacactgcgttcgatgccatttggagcttgcactaagtagcctttatcccatgcgtgagggcctgtgaaagcagcgagtggacaacgggtgtaggactctgagagcgagagcctagctatgcacagaagaaagtaccacagcgagaactagacacgtctatcgtgcatatggagcatgcatcctgggcgctagcaaggctgcccttcctgcaatagggaacgttatgaaggtaggcacacgactggtgaaggccccgtgctacgtgcatccaagttccctcttcacctaggtactgcccaatcagatcaaagatacctgcgacatttaaaatctgatagtggatggagtaatatgggaatgagggtgggggtgggggatgaagggaagtaatgcatctgtgctttgttcggcctggagtgtcaaggatggttggtgg

SEQ ID NO: 652109 - DNA, 837 bp, Homo sapiens
  misc_feature (31)..(31): n is a, c, g, or t
agcggagatctccccagacgccgaggatggncgtcatggcgccccgaaccctcgtctgctactctcgggggccctggccctgacccagacctgggcgggctcccactccatgaggtatttctacacctccgtgtcccggcccggcgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgttggggcctggacgggcgcttcctccgcgggtaccagcaggacgcttacgacggcaaggattacatcgccctgaacgaggacctgcgctcttggaccgcggcggacatggcggcccagatcacccagcgcaagtgggagacggcccatgaggcggagcagtggagagcctacctggagggcgggtgcgtggagtggctccgcagatacatggagaacgggaaggagacgcttgcagcgcacggacgcccccaagacgcatatgactcaccacgctgtctctgaccatgaggccacccttgagagtgcttgggcccttgagcttctaccactgcggaagaatcacacttgaccctggcagcgggatggggaggaccaagacccaggaccccggagctcgttggagaccaggcctgcaggagattgggaccttcca

SEQ ID NO: 652110 - DNA, 993 bp, Homo sapiens
cgtctttgcgaaagaaagacaaggaaagagagagaaagtagtaaatccagcactccgttgatcagctctttcacaattctctctctgcatgtagcttctctgtgaggtgacttgttgtggccacagcgtttattcgcctagaagtctgtatgccggtgttctgacgttcgttcccctgcgcgctgtcatcgtgctctcgcccttcggctccctaaatttctgcgcagcttgttccgttgttgatatctatgccgaatgattcctccggtgcaacaatcttcatgttacctcccggcgtgaacttcgtcccccttcttgggacccccgctactttcttgcgggcaacattctgcgcccccactatttgcttcgggaatcacccccggtgtggtgaaaacgtcttcggtggtccgtcaaaacttggagaggtctttacctggggcgcaagtgtgtggcgccctcctcccccggctggtgagttgctcggttgctccgcccgctccaagatacattgctgggccactcccccacggggtcgcacatttgttcggcacaagaccagacggccttattgcttaagaggactaggaaaggtgctttcataaaactacatcgcgcgccccgccattttgtgagagcacatataagtggtgtagaagatgtttcacgccccggtgtcgaggactcaccaacagggggcacaaaccaacgtagacaatccacccgcttcgtttcttgtccttcactgcagcaagatgacattgtctgacgcttgcgtgtgcgaggtttgtcccccccccgaattaagccgcccaccgtcgtctcctcggcgagtgctgattactcacgtaatgtgtcactcacacagcggttgcgccaaggggttgatgagcgccttaaaacgcactcatgtagcttgttgttcacatacggtgaaaagccgtaatttttattgccgccctaaacttctttgccttaacaccaaacatgaca

SEQ ID NO: 652111 - DNA, 151 bp, Homo sapiens
tgagagaccgtgtggcaatgatggtgttacaatactccagcctgggtatggtacttttaaattaaaaacatttaaaaataagtgttctggccaggcaccgaatagctcatgccctgtaatttccagcacctttgacgaggacaagggcaga

SEQ ID NO: 652112 - DNA, 449 bp, Homo sapiens
taatcaggcctgtgtctgcctccttcttgaatagcccagtgaattcatctaaacagccttcctacagcaacttcccactacaggtggtcagacggtagagccagaacagtgttgtcctattgggacattcacacagcagacaaggttattggctgatggggcaggcgcagttggtgtgtctggttcaaggctggtcataggcaatagtgcccgatcgtctgtatatcggatcagccaggcataagttttcgaccagtaagccaatctctttatcatttccgagccgcagccgtcttcgttcaagcgtgaattgggggtcatgcagtcagtcttccctttttccatcattggaggagtagcgtcgggtctatggttcgcagcaatcgtaatcctaaccactctgtgctgccggggtgggaaacgaaataccctaatgggcctagaataaa

SEQ ID NO: 652113 - DNA, 1235 bp, Homo sapiens
ggtggcgaccgtgatatagtccagacccggacgtgcctcccaattcgttggattggctgtatcctctcccttctcctacatggtacggatttctcctagtcactcgatcggactaactacaaactcatggattcttccaagcgaccatttctcgctatgcctactcttctgctccaaccgcattcattaggagctaggaagcactggtcaattacccatctcgtatcactcacgtgtttccccatagtgagtagtagcccacctacttgtgttcctgccgtcaacgttagtgggggtaacgcgcaaagagcgaacgcacaacgtcagcgtcattatcgagcctataacagattgtgtcagagtgcaataccgtattcgccatgcattgtataccaaagaatacagtgtagtctccttctgttggtaagcatgtgaagcgtggcgagagatgagggcatagagcaagctcccagtaggttcgcttagttgatctagaaggacccccaacagagtccatacggtaggtcgacaccgggtagtgctgagagcgatgctggaaggattcctaacaactactattccacatatcattctatttatggatgtgctcatgaaggcaatgcacatagtgtagcctacgagtggttgcacaaagtgcctaactgttccctgtcgcttgtacgcagatgttcccgcaatcatggcctattcgtggactaacttacgtggggggtttgtgaatagcgggtcactcgttgttgcctttgggtgcctgaaacttttattcgtcaccctgtatgtaattccttatcttggtcctgaacgcatgggtcttggaattggcggtatgtcttaatggcccggagacctggcgaaggaaggggttttgaccataagactgatcttctcacgtactcacactccttctgcttctccgagctctaggttctgcgaattccaggaatatgctaaaggacgaaatttatctttgggtccatggcctcataacttactgatgataacttaacttgcgaggctcttccaaacttcactccgttgctccactaatggactggggctactatgtggggaacaaaagtccccacaggggggtgccttcaaggagacaggcctctgataacccgtctgttaaatgttaggaacttgtaggaccctctctggggaaccttgagcggctccggcactctcgtatcagattgtgtctcttgtgtccc

SEQ ID NO: 652114 - DNA, 598 bp, Homo sapiens
  misc_feature (536)..(536): n is a, c, g, or t
  misc_feature (567)..(567): n is a, c, g, or t
  misc_feature (569)..(570): n is a, c, g, or t
cagtacggatgtggctgggagtgcggcggacacacatgctgtgtggccatgtccgggcgcatccaggcacggagggctgggttagcaggggcaggaggcacagcgacgggacagagacagagcctgtggcaggagaaggcctggagggttggcacacgtagcccactaggcgtgcattgcatcagggaaggagagaactggggagtcgtcggtagaggggaacagtacttgggaagggctggggagagctctgctctggctctcattcaggcggcgacatctacagagtgtgttagacagacacacgcactcgcaaatacacctgcagacccagtgcatggatgtaccgtcacccaaatgtggcaacacaggtgctggtccacaggcacacacatacatgtgcacacggtacacactacccacacacgcacagacacacagctccaatctccaatacaccatgcaaatgcagatacagacacagccaaccacatacgcatcctcacttgcccgcccagcctgtgtacaggtgcatncaaagaatacacactctgcatcccacctatntnngaagagggagcaagcagggggatcctct

SEQ ID NO: 652115 - DNA, 265 bp, Homo sapiens
ttaccggcttatgtatacaccttcacatttcagaggtaagaaagcactactccatgagaattcacgtgtggctggtatagcctgatacacccttacagcacaggcctttgacgtgcgctctcatctgagacactcttctttggcctctttacccctgcaacttctactcttcttagagactctcagctcgagatcttttcctcaaggaacgtacgcttacgacttgtgcagacttctgctttctccacactcttcacacgcttcg

SEQ ID NO: 652116 - DNA, 164 bp, Homo sapiens
cgtgacgtctcgctctccctctccctcctctccctctccctcctctcggtctccctctccctcgccccacagtctccctctccccagggtctccctctccctctctttccagggtctcccccggatgcggagccaaagcgggacggtacggcggccatctcggc

SEQ ID NO: 652117 - DNA, 403 bp, Homo sapiens
ttaataaaggggataacgagaatcaggttcagagtgggagaatccctgttctgtgatacaggatagaggaatatcaactgccttgttcgtctggtccatcttgcttagctgtctgtcttactactgaaatagattcatttaagtctatctcattatttacttctgtgaccaagatattgggctggcttatggcaagaggcagagagtcaactgaattgctgttggtcacagtgacttctgtatggctactcattggatgagaggcaggcttattaggaaaaattttctgcaaagtgactgtgggattctgccagttgggactctgaggattccttctatcatcagaaatctgggaaaaggcagttttgaatgaggatgctagagtctgagcaattccaaatga

SEQ ID NO: 652118 - DNA, 309 bp, Homo sapiens
taccactatgatgggaacatttcattctcaaaaaaaaaaaaaaaaaaaatttctcttctccctgtttatgggtattcctgaccttgaaatatttttttcccatggggttcaaagggtccctaattttataatggcaattggaaaaatagggaacaaaattcaggtatgggcatttttcccatttccatttggtgttaatttttaagtgataaattgcggagacttaaagctatattgcagtgtaaatttgtccagtgaccagtttccagcgttccacttttatattatttataattaaccctttgaatt

SEQ ID NO: 652119 - DNA, 101 bp, Homo sapiens
aggctccagcttaacgatatagggaggtcagcacggagctcacgtgtcgacggaactcgtacagggaggcatgccccgcagtggtgaatacacgtcgacca

SEQ ID NO: 652120 - DNA, 474 bp, Homo sapiens
tggcgctttcacacgagagaaacagctcataacgcatctcctgcgttgagaaaaccacttggaggtgtcttctataaactacataaaataatttgttcatctgaagatggaatcccttattagaatatggatataaaaacactgatcattacattgaagagtcaatgactgaggttttcttacctactgctcatctcttagacaataacttctagaataatttctacatcagtgtctgtacaagcttttaaaaaacagaataaattacaaagccccatacaccaaacaaaccacctcccaatctattatgttatgtacaccttattcacagtatagacagtaagaagagatttaagcgtgtagctaggcaactagctcctgaagcataacgtatatccttcaacatcccagcccattcttttatatcatctacatacttccatatatcattgacttcagtgggtgcaaattcta

SEQ ID NO: 652121 - DNA, 217 bp, Homo sapiens
tttttttttttaaataagatgtttgcgtacgtgttaatggccagaagctccctggacttaggggtacaatatctccacaaacctgtaaaccattagcagcagaccaatgtgctctgctaggtctgagtacaggaaaagcctgatcttcttgttcaagtttatttctagaacacattgttggttgaaaggacatgaggcagatactttaattttagtc

SEQ ID NO: 652122 - DNA, 160 bp, Homo sapiens
tgccatgaagtggccaaggagccgggctggtcatctgttgcaccccagtcgcctctgcgatgttggcacaggtcggccgggccccagcagctctcttcggcccccatctggatccagaggaaatcgtttaggaggcagtagggcatcttccaaggacacg

SEQ ID NO: 652123 - DNA, 140 bp, Homo sapiens
  misc_feature (51)..(51): n is a, c, g, or t
  misc_feature (81)..(81): n is a, c, g, or t
  misc_feature (83)..(83): n is a, c, g, or t
ccgcgcggcatctgtatttatttaatcatttcagtaacttcgaaaaatgtnttgagggggggagattcttcacacgctgcncngttcccaaaaaggagctgggttcacttgatggatttaacagggaattctctccaact

SEQ ID NO: 652124 - DNA, 125 bp, Homo sapiens
agatcaaggaacgaagatctgagagataaactgttcaagtcttagcaagatactgcacttctctttgacaggttctgggcttagttagaggccctactggttccaaaccatattccactgacttt

SEQ ID NO: 652125 - DNA, 614 bp, Homo sapiens
gcgtgagacggccgcccgcagggctgctctggccgggagccgctggccgggatgacgcgaatcctgccggatccaccgcgacggggactacggcggccatgagctcgcggaagctgagcgggccgaaaggcaggagggctcagcatacacgtcgtgacttggaacgtgggttcggcagtgccccctctagatctcacgtgaccatgcttcagcgtgaagcaacacggaaccgtcaagtcttgacatagtatgttatatgggtctccctatgtccgtatgcaggggatccttcgttactggtctttgccaagtatcaggcatttgccctatatccagattcgtgtctactaaatccagcgccgcactggaccttgtagtgggtactggagggaacaaaggtggagtcaatcatctgcctgaagctttatggctactatgtcatgtatcatcgatctgccaccatgccttccccacatttccaacaggttaccagcggctggagcactttgaccggatcctggagatgcagaattgtgaggggcgagacatcccaaacatcctggacacgacctcattatctggtttggagacatgaactttcggatcgaggactt

SEQ ID NO: 652126 - DNA, 452 bp, Homo sapiens
  misc_feature (337)..(337): n is a, c, g, or t
gtggaagctttgttcttttgttctttgcaataaatcttgctattgctcactctttgggtccacactgcttttatgagctgtcacactcacagggaaggtctgcagcttcactcctgaagccagcgagaccacgagcccaccaggaggaacgaacaactccagacgcgccgccttaagagctgtaacactcaccgtgaaggtctgcagcttcactcctgagccagcgagaccaccaaacccaccagaatgaagaaactccgaacacatccgaacatcagaagggacagactccagatgcgccaccttaagagctgtaacactcactgcgagggtccgnggcttcattcttgaagtcagaccaagaacccaccaattccggacacggaagggactttaatattaaagagtgctatggttaaaatcagttcaattaaaagtggatattcaagctc

SEQ ID NO: 652127 - DNA, 587 bp, Homo sapiens
gctctcttgaacccttcttctggggccgggacaccctcatatggtgtattcagagcaggggggtcacccagggccagagggtcccctgccccgccctctgtcatcggcggccaccccagcggggagatcccccctccccgcggcctttattgcccaagggcggctcacttcatgggcgcacgcaaacataaggggcaagcgagtccgtgtcacaaggccgagcaacaagattgcgcccaataggagaccacaccgtggggggccccgtagccgacgcacccgcacaggtggcgcctcccccgcaactagggcatacagggtaccacaaacggccattattttgcagcctgcacccacacgctgtccagacatgaaccgcggcagatgaaacgagcgagtactcggccaaacatccgcggaagggagtctcccccgggcgtaaatgagacatcaagacggggggccccgacgcactatggcgcccggacgagggcgaccctcccaacaaacacccaccgggggtagcccccccccccgtcgcggctccatgacggaaccctcccctttgggggcaccccccccacaag

SEQ ID NO: 652128 - DNA, 233 bp, Homo sapiens
cattactaaaaacacaaaaattagccaggtgtggcggcgagcacctgtggtcccggctactcgggaggctgagacgggagaatctcttgaatccgggagcggagggtgtggtgagccaagatgacacaactgcactccagcttgggcaacagggcgagaccttgtttaaaaaaaaagttcaatattggggtcggaacatttcagttgccattgacagaacacccaattcaaat

SEQ ID NO: 652129 - DNA, 151 bp, Homo sapiens
cttaacaggtaatggcattttgaattaccacctgttcaatcgacaccaactaaggacacaccgtcatttaacagaagacagacgaatgaggtttattattttcgacgatccttcaaatctaaaactttatccgtcaaattacgaaactccc

SEQ ID NO: 652130 - DNA, 307 bp, Homo sapiens
gcgttgattggccgacgaggaaggatagggagcacggcaagggggaccgagtacctgcctcatgcatacattgtcagctgcaatcacttaaccaagtcaaaggtcacgaatccatccagatctgtgtcccgagttttgaaaaatcggaacatggtctctagccgcaccaggcagcaaacgaaactttgtcaaagtcgaccgccatgttgggctccgagtagcgggtgatgattagctcgtacagcttcttgttgagcttgtagcctggcgagtccatgggtcatccgcatctcgtaagcactcatgc

SEQ ID NO: 652131 - DNA, 229 bp, Homo sapiens
gtgcttacaaggggcttctagtagctcaggcagctaagttggggaggggaagaagctgttgtctgatataggcaacagccctccacacccctaaccctgcaggctgcactagtccctatcgaaacccctaactgtgagcatagtgaaggggccagagaacatctagtggcccataaaccatggcaggatcagaggagacatacctagtgtcaggggtaacacctaggga

SEQ ID NO: 652132 - DNA, 444 bp, Homo sapiens
atgatgattctgaatcatcataagaaggcttactcttgttttaaatcttgatttaagcgatcaggattgagtgtggtatatttttagatagatgtccatctaagtttcaccaaagttttgacatttaagatgcacgttctaattaatgggtaaatcaatttacatatacattttatttcttgatgctgaatgaatattattgagttatatgtacatatggattaaatatagcacacttctctgcctagcttgagaaaataaagccaaggcaaatacaaaattgatttctattaagtataaacacaagtgatgcttttccttatttaggcaccagtgacagagaaaaaaaaagtgatgcctttgaattttttgaagacagctttagaaattttcataaactctagaaatgactattgtaggaaatccagaaatacagagaagtac

SEQ ID NO: 652133 - DNA, 395 bp, Homo sapiens
  misc_feature (12)..(13): n is a, c, g, or t
  misc_feature (375)..(375): n is a, c, g, or t
tgagatggagtnntagctttgccacccaggctggagtgcagtggcacgatctcagctcactgcaacctctgcctcctgggttcaagtgattctcctgcctcagcctcctgagtaaatgggattacaggtgtggaccaccacgcctggataatttttgtatttttagtagagacagggtttcaccatgttggccaggttggtctcgaactcctgacatcaagtgacccacctgccttggcctcccaaagtgctgggattataggcatgagccaccatgcctggccccaagactgaagtaatttaatgtcttttctcacgtgagatttgccatgtcacttggcccccttctctgtatccctcattctcattttgtgnacttaggataacacaggcct

SEQ ID NO: 652134 - DNA, 1436 bp, Homo sapiens
ttgaatacaacccacagacgttgttgtgtgtttacatcccacccataaacagatagtaatcagcccgcaggcgcggtgtgtggttgtctatctacccgccggtggtctttccccccgcgcgcggaagattttttctttcccctccccccggggggagattaattattcgttgcttgctgtgtaaggaacacaccatcaaacagcgtgggggggttgtagtgcctcgctccacacaaacagtgttcctgccctcccccctcgtcgtttgtggtttgctcctccacgggggccgccacgccccctggttgtggccccctctcttacccccctgtgtgtttttcccccccccctaagttttaacacattttttaaaggccccgcaaatttaaggagagaatgtgggagaacaccccctggggcgccccacacatttaaaggaaggattaatgttgtccccccccccaaagagggggaaaaaagaaagtggtgtgaaagaaagttttgagtttagtccgctcatagtccccatttaatttaattagctgccacaagggggccttttttaacccccccccgttgtatgtgacccctgttctgtgccgaaataaaaatggggggagtgtgagaacctttaaggggaaattaaaacactgttgtggccaaaaaggggagagagcgccccctaaggcggttttaggacctccccccggtggtattaccccaaggacccgaggctttacaccttatagggacactaggcttttaataggagcccaccccccccgggtctgtataggttgtagacccagaaaatatagatggggaagaaatatttaatatagagttagaagagcggcacacaacacactcttccgcgagaccctcgggttgaataaacactcgcgtttgtcccccaagaatatagaaattcttagtgtcacaactctgtaaaattttggcccacccacgagaaccctctctaaaaattcccgctctgtgaaaattttaacactcgtgtaagtgtccacaaagagagggacacacggcttctcttgggagcacactaagggagaaaaaccctctcgtaagaagagagaggtataaaaaatttaacaccccactaagtaaggcctataaaagcacgccaccccacttataagaaaagcgttcaaagctctacaacacacccacctatccttataaaattccccacaacactataactgaactcctcaacacaccccattggagccacatctatcacccctatagagagaactaaatgttagtaataagtaaacactggaaacacattttcctccgcaataaagcctgcgtcaagagattaaaaacacctggactgaccatttacagccccatatttaccatcaacccacaagtcattattaccctcactgtcaaccccacacaggcca

SEQ ID NO: 652135 - DNA, 469 bp, Homo sapiens
ccccaaaaaaggggggggggttgttttccggcccccgtttaagggggggggaattagccctgttttttttttaagcaaatgattgggagccctttgaagccattttttttaatggggaaaaaacaagttttcatgggggggggtaaaaaaagaccggttccattttggaagggggggctttttgggcccccttccggattagggttttggaaaaacccttgtttttgggtaaaaaggtaaaaagccctttaaaaaggaaaagggggccctttctttttttttgggggggggcctgggttttttggcccgggcccccccaaagattttaaaaaaaaggtttaaggggccccccaaaggggggggggttttccttttggccaattgaaaaaaaatttgcaaaggattgaaaggtgcccccccggtttttgggttttccaaaaaaatttttaaggggttttttgccccccta

SEQ ID NO: 652136 - DNA, 260 bp, Homo sapiens
  misc_feature (57)..(57): n is a, c, g, or t
  misc_feature (94)..(94): n is a, c, g, or t
  misc_feature (161)..(161): n is a, c, g, or t
  misc_feature (203)..(203): n is a, c, g, or t
  misc_feature (223)..(223): n is a, c, g, or t
ctccgaccaggcccgcccaggagccagatccaggctcctggaagaaccatgtccggnagctactggtcatgccaggcacacactgctgcccaanaggagctgctgtttgatttatctgtaaatgttgggaagaggaatgccagagctgccggctgaaaatnacccaaccaagagaaatctgcaggatggactttttggtcctnttcttgttctacctggcttnggtgctgatgggtcttgttcttatctgcgtctgttcg

SEQ ID NO: 652137 - DNA, 245 bp, Homo sapiens
aaatcgagctcggtacctcttcaactctttccataagtcctgcttctcatcctaaattatatactaaagaaattgtaatcctcttactataactgtccatgaccttaattcaacacaacagtatcatggcatgtcatgaagattaagattttatatcccagagatttaagtgttaatgtctactgtttaccactccaacaaaaaaactagatctcataagagcccacccaaagccgaatcaggga

SEQ ID NO: 652138 - DNA, 356 bp, Homo sapiens
tgagccccctgtataagaggacttatgagtgctactgctagctgcgcttcgtctttggagttcgctaggcagactagtaatgaggatgtacgtccgtgggcgattatgagaatgactattctgcctagccaaactcaaactacgcaacgcggctctcaatgctgtgagtcctccattgtccttagctcatgcattgctctgtcctggaatgccatttccacccttctatctcatagtcagtcttatacttcatctgtgccccaatctcataattctactttttccatgaagcatttcttgatcatctcagaccagagtgaatctctccctcttcccatactgatggtcctttatta

SEQ ID NO: 652139 - DNA, 586 bp, Homo sapiens
ttgccttaaccctactaaagcatgatgcttttcaaggtcctggtgatcactgtcttctgtggtctgactgtggctttccccctgtcagaattagtttcaatcaataaagaactacagaattcaatcattgacctactaaactcagtctttgaccaactgggatcatacagagggacaaaagctcctctagaggattatacagatgatgatttaagcactgactctgagcagatcatggacttcacgccagccgcaaacaaacagaattctgagttctctactgatgttgagacagtctcctccggctttctggaagaattcactgagaacacagacatcacagtgaaaattccattagctgggaatccagtctcccctacttcctgagaagactccaactttgaaataaacctgcgactgccattcaggatattgtctttgtagaaaatgatataaatctaagatgctcccagcaaagaagaaagaacgaggaagtgatcctggatgagaaatgctgtgccaggcatctctaagctctgcccttactctgtgtgggtttaagaaataaacgttcatttgaattgca

SEQ ID NO: 652140 - DNA, 406 bp, Homo sapiens
ggcgagatacacttagacttctatcccattggctggctcacgctgactggcaaccacgggatgtcggtcgcgaagctgagagtggactctgtgtggagccatgcatcttgtctcgtcgtagcctctgctttacatatggtgtactttcgggcgtggtggcagtcacacaatgcacacacgtgattgcagcttgtccgcagcagctgcaaagagcacaagtagcacaggcatgtgcattgtttcttgtcagatcatcttgcatgtatctgtgtcattccaaattcaaacagcagcatggtttgtccatttgtccactgagcaattagcaaatagggacaagggggaggcaacgtctgaaataagtttatgcagcagtgtgtctcggctgtgcttgtccaggagccca

SEQ ID NO: 652141 - DNA, 300 bp, Homo sapiens
aaaacctcctgaaggcaaaattacccctccctcccctgattgtaaggccccccaaaagggttccccccgtgacctcctttttcccccctctttggtccttccctgcccgaattcacccccaaggaagccaaaggccacaggaaccgtgtggcagagaagagtcacctaaagcgacagcaacaccttcatggctacaaggttgaaaaggggaagctgagggaagcagaaagtgctggggagattgcagggagggaggaagtgcttgggaaagtaaacccatgaagctgtgtatgagcttct

SEQ ID NO: 652142 - DNA, 628 bp, Homo sapiens
  misc_feature (596)..(596): n is a, c, g, or t
ttgccttaaccctactaaagcatgatgcttttcaaggtcctggtgatcactgtcttctgtggtctgactgtggctttccccctgtcagaattagtttcaatcaataaagaactacagaattcaatcattgacctactaaactcagtctttgaccaactgggatcatacagagggacaaaagctcctctagaggattatacagatgatgatttaagcactgactctgagcagatcatggacttcacgccagccgcaaacaaacagaattctgagttctctactgatgttgagacagtctcctccggctttctggaagaattcactgagaacacagacatcacagtgaaaattccattagctgggaatccagtctcccctacttcctgagaagactccaactttgaaataaacctgcgactgccattcaggatattgtctttgtagaaaatgatataaatctaagatgctcccagcaaagaagaaagaacgaggaagtgatcctggatgagaaatgctgtgccaggcatctctaagctctgcccttactctgtgtgggtttaagaaataaacgttcatttgaattgcaaaaaaaaacngcacgaggggggcccgtaccattgcctatgtg

SEQ ID NO: 652143 - DNA, 111 bp, Homo sapiens
aaaagaaaaaaagaaagtagataaatataagggccacattaatttttcacaggcccttctccctcagttaacctttttttttgggtatcgggaacacggtgacacttttta

SEQ ID NO: 652144 - DNA, 141 bp, Homo sapiens
tgctcgaccagaggatcccttcttgaaaggagtatgctgttctctatcagcctctatttataagcgatttgaaattattaatgcaattatgaacctcggaagaagaggatgcaggaactggtttcaagaagcaggaactgg

SEQ ID NO: 652145 - DNA, 1970 bp, Homo sapiens
  misc_feature (289)..(289): n is a, c, g, or t
  misc_feature (748)..(748): n is a, c, g, or t
tcctgagcatggtgtaagtgttgggtgtgttgtggtggtctgtggttgttacacactagtggtgtgattgtgtgtgtagggttgcgtcgctttgttgcttgtctgtgaggggactcagtaacacacgagctcagtctggttgggcgttgctcgtgggctggtggtggtgctgcttacttattgtcgtcactccatctagagtatgagctttggagtgagtgttcctctcttcgctccccctcctccgcagttactttgtggttggtgtggttaataaccgctgcggggnctgttagctgccccactgacgtcctattagcaattggtgatatggtcctactctttttgtacgctgccgtccgctcggttaattaatgtgtgttggcatcggtggtgcaatcgagtagccacctaccatccaacgttctcattcggtggggtagcgtcgcttgttttaaattagggggggtcgacgcccccaccccgctgtagtgtgttatgaggaagaagcccccctccccggctaatggtgatgaatatgattcgttcgccatactttcattgaatcgcttcgtgtttttcgtggctgccccccacttcgtatgaacgaacatcgtcctggcagagacgaggccgtcccttcttgggttggtagttaatatgataccgcgtgtatacttatcggcgcgctccctcaccaacagtagtgatgtgaacgcattagtaaatagatgtgatgaccctcctnggggggggtgtcttccttccatcaaccagggtggttcattatgccgcgcaactaagaggcaccacctatcctgtcagcgggtgttagtagctcgcaggcatatgtttgctctccttcgcggtctccaacaaacagtatattatgctggtgttgaataatccgtctagcatgttgctgttgtaatcatacatctttattaactctcctgccgcacgacagtgcttccacctagctggtatattttgattgtatttagcgtcctgacctcacaccctgggtgcgcccgccatcctttgtccgcgccccccacccatggggggttagcggctccccgctgcctgctggtgtgattgagtcctcgcttcatccgtgtctgccgtcagtccgaaggaagccttctttgtttcttcccaacccccgcctgccttcattccagaaggaagagggaacaacattatatttgtgagcaacaatagtattatgcccccagtctgatgtatgattcatgaagtatgcattgcgtgcggccgcattctgtaatcaacagcgggtggaattataccagctgctgcctgcgccgcagagtagttatgatcacctgcagaggacttctctgtctactcggactcaccaccgcggcatctgcgcggccgcatccacatgccccacaagaagagctgggaggatctccatcgccgtagagaacatcatcaacacgctcatctgcgcacggcacacagcccacagcagcacatcatcacagtagtacacagcatcacagcagggagtagagaaagagagagagtgacacacgcgtcacaagtcacagccgtctctctctcgcgcactttttcgtttgtaccacaacaccactctcttgagacacctctttcgtcctccatggtgacctctctgtgagagtccactactgtctctcacccacacactctgtcaccgcttttctcttcctcaataagagcctgcacacacagtgacccacccacccgcacttcgcacttaccctcttcacccctcgaatatctacacaccggttccctctttccccctttcctttcccctctcacaggtgaacctctcttctctccaccctcagggccactacccgcggggtgaagcggggttatcccccatccccacgttttttaactcctatggggccacacccaccaaagtaattcacaagtagctttgtaaattccat

SEQ ID NO: 652146 - DNA, 1948 bp, Homo sapiens
  misc_feature (1633)..(1633): n is a, c, g, or t
gggtaagctagcgaccgaccaccgaacccgagtacatagtatccagcgatactatactacagcgctactacctaaagcgagcatacccatactgccgtccactcctaatactatacatctaggtctatacatccgtatactatcctatactactactatactgtatatgctatgagtctgatcgaagactattacctaagtcgcctaatagcactagtttcgtacctacctgtactccgctctagccggagtgcagccctgctaacgtatcctagagagtagcgctccgtctctatagccttacccgcttatagggctatatatactctatcaccgaatgtgctataactatatagcgagagactctcttatctccctttattgtgttctagaatctcctaaccggagatcttcaccctggccctcttaactcatataataatatcctccacggttgcaatttacccactgggttctaatcctctccgccgcttcgacgcatccttcatcatgtccttctcctatcccgctgcgtctaactcctgcatcctattccatataagtatcctcgagttttcctcccgctcctataacactacgttctatcagtctgctcttatatagttccgatgcactctttgtgccagattaggattctttagagtagtttttcgttaggttgctatggtgtgctatcttctttgctgtcttcgttcttgcctcgttcgtcctgcaagctgcgtgcctcctatctcttcgagttctctatcgctcattagctctgtcgatagacggtcctcctctcgattttccgctgcttctcctatttagcagtctgctctctctctgattattactgctctcactcggtttctcctttagtgctccgcttcttcttgttcttctcgttgccgctcgctcggagctctttcgctctcgtcgtagcttcgtgctcgttgctactttttgctgcgatctcttacttgcctattgatccgctcggcttgttccgcgcgttctaggtcttttctttatattatctattcaatcgatgcgatctctcgtattgtccgttatcgctatgatcacatatttagtctctagagttgagtgctctagcgtgcttagtctctctacttatcgtctatctcgtttcgtttatcatccagttgctgtgcgatcgtatttctcgctctatttgagtctgttatttgtgctcgtcttctatctcttgttagcttgtatctctttgctgttctctgatatcgtgctcgttgtgctatctgtctgcagtttatccttgcatcgctctgtctgtttctatcggcttctcctgcttgagcttcttgctcttctctctttgtgttctgtcttgtcttctctgcgtctctcgcgtcttctggtctctctagtcgtagttagtggtagctaattcgctgtttcttattttcgttgtattttgcctcttctacttgtatctattctctgttgtgcgtttactcttcctgcgactgactctatgttcgttctgtttgttgcttactatttcgattgtggtgttctttttttagttttttctgtctcttggtttgtgttcttgaagttctctatctcgacgtgtcgagttattgtntgtctcgatcctttctctcttggttgtggggtgttcttcttgactgtttttagtcgttattactgtcttttctgtttcgtttcatcttctcgttcgtcgctggtcagtcgcgttggtctagttgatctggttccgtctgctcgtttttctgtttcgttctttgctttggtgttgtgttggtcttgtttgttgctttttcttggtgttcgtagctgtctgttctctttgtgcatgtcgctctttttggctgttgtgctctttctcggtcgttctatcttctttcttcttctgtttgttgttcgtgtttctcttgcg

SEQ ID NO: 652147 - DNA, 1108 bp, Homo sapiens
gaggtctctgacttcgggctatgtatcgctggtggctgtctggatcgccgagccggactggtcaggatgatacacggacgtgcagctcgccatcttcgccaacatgctgagacgtgtacgactcttctatgctatgttaagtactacaatacacatacgttggcaccgtacacacaaatactcaccacagaaggcacgcgcaacacttgaaaacaagcttgtgcgccttcttcattccagtaccacacaagcggatctaccatggtaccattaaaatcctgtacggccacaatgaatgcgacgggataaatgcaagtggtgaacatactcaataaacctcacagaaggatcgaccgagtccgccgaaggtatctcgataatccacccaattccgaacggagcactcgaaattaacacaaataaaggccaagccccacagcatcaccggtgggggacagtctggtatctccccaagaagagaaacgccctgtacgaacattgacgacgaaccaaatgagggtatcacatcgccgacgtcaagttacacatacgtggggaaaccgaacggataggagcgtgcgacagccagtgaaacagtaacgggagtatccaaggtaaagaaagggagggacattaaggccatcatgagtctaaacatcacgcaatccatacgacagcaaagactacgtcaatgcccatctaacatcgaaaacgatgcaactaagcactacgagcacaaagcccgacgaggcacgaagaacacagaaaagaaagaacagaccaagaagagaacggcagaacagaacgaacagaagcagcgccggacacgcgctagaggggaacaaaacggaagaaaaaagaagcgaagctgatcacccgaaagaaaaaaaaggagaacgaggtaagaggcgacagcaagaggggccgcaggcatgcaagctaatggctgaaaatcactaagacacaggagaccacgataccaaactcaggatgggagaaaggaagtacgtggtcggaaggaggcagcgaaggaccttagaaacacatcgaacagaagagagggaagcgagacgaaaaaggaagagaaaacagagcacacaggcagagg

SEQ ID NO: 652148 - DNA, 251 bp, Homo sapiens
  misc_feature (154)..(154): n is a, c, g, or t
gcacgaggcaaactgtatatatcatgcaatggaatattattcatcaaaagaaatgaagtgatacatgctataacatgaatgaaccttgaaaacatgtagagtgaaagaagccagtcacaaagaaccatatattctatgattccatttatagganaatgcctagcataggtagacctatagagacagaaagtagattagtggttgccttgggctggatgcagacagtgcctactaaggggtatgtccctact

SEQ ID NO: 652149 - DNA, 510 bp, Homo sapiens
  misc_feature (113)..(113): n is a, c, g, or t
  misc_feature (270)..(270): n is a, c, g, or t
gcctatctagaacctagtggatctccccgggcttgcagcgtacaagtgtaaatactcggggtatagaaaatgcgtatttggaaagtatataattggtacttaagagcccatanctgattatcttttgtactttgttttttaaaggcattaggtattatattttgcgcactcaaaatccttccaaatttgaaaacctcaatataaaataacacttttattaaattctagttagtgggtagcactcaatgctgaagtaaacatgaatcgtanggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaagtttttacctttaagcaaatttatgtcattattgagacttaagggatgattagacttggcaatctgtgcaggt

SEQ ID NO: 652150 - DNA, 380 bp, Homo sapiens
ccctagcaccttccttactttagattgaacctgaatgcgttagtatgaattttttggatgtcagtggctctctacgaattgtcattttatttctgctacaaaatttaccagaataaggtactgcaacaatcttgtataaagcatatctttaacgaaagaacatggtatagactttctaaaatttttcatactttatcacaataactacaaagaaaaattcaatttctatcatcataaccaatctgcagtttctgaggttagttagagaccgatgacagaatagtttgaaacaaaaccccttaaggaaatattccacttgttctaaatatgttccaattaatcgaattatctatcacatgcggttcaggacggttgttggg

SEQ ID NO: 652151 - DNA, 289 bp, Homo sapiens
ctgtaacattcttccaatggaatgtaatggaatggaatggaatgtaatggtaatggtaaaggaactggatattaacccgcaagagaatggaatggaatggaatggaaaggaatggaagggagacaaccagaatggattggaatataatgaagtgtaacggaattgaatcgaatcaatctgaatgttatgaaatgaaatggatacggaatggaatggaatgtaatggaatggaatggaatgcaatggaatggaatcaacccgagtacaatcgaatggacaccaatgttca

SEQ ID NO: 652152 - DNA, 115 bp, Homo sapiens
gtcttatattgtgatagctatgtctttcattgcagatttattggatgttatgacagattttactgcagctagtgatttttatgaacatatatattagatgcatgatttacctatg

SEQ ID NO: 652153 - DNA, 762 bp, Homo sapiens
cggttatataaagcaagcttttttgaaccacacgtactctgggaggacaaccccacccggtggtgcccgccacaaaaaaaacgagcgggggatacaccaccgccgtcgttaattcattaccgcgccgggggagaaacgatttcttccccggcacaacgctgttctacagtgtgctccttctttggggcgcaccagatataacaacgcttgtgtttgccaacaaaaaacacgcgcggggggttgtgcgtccgccgcaaacattcgggcgcggtgataatatgtgaagacgccgcgttgtcgatttgtgtccccaaacacacgaggtgtgggtcggaggtcttctttgtttggtagtaaaaaaaaaaaaaaaactcctgtaaataacggggggtggtatgatctcaacccaacaagcagggtggtggcaaatatcttgtcggggggtgtgatagggggctctttctccgaaaacaacgtgttgttctctcctgtgcaacgacttttttgtttgaagttttccacgaccacgcgctccccctgtgtggaaggacaacgcttctctaaaagaatctttccctacagtggtgatggtgctggcccccccccccctcatgggggggtactcccaaaccctcgtgggttttttttttggtcggacatttctctttttgcgcctttttttttttttttttttttcgaaaaaaaaaattcccctttttcgaaggaagttgtgggtacaaaaaaaaaaaggggggccccaca

SEQ ID NO: 652154 - DNA, 255 bp, Homo sapiens
ttacgtatcatactacccttatcgtactcatctcccttaccgtctcatctacctataccgtctcatactcccttaccgtctcatactcccttacacgtcctacatctcccttaccgtcctcatctcccttaccgtcctacatctcccttaccgtacctcatactacccttaccgtcctgaacatgagcactatatctagccaccattcacctatacctctacacaggtaccattcctatacccctactgtccggc

SEQ ID NO: 652155 - DNA, 793 bp, Homo sapiens
  misc_feature (595)..(595): n is a, c, g, or t
  misc_feature (649)..(649): n is a, c, g, or t
agcggtaagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaangaaatgtgactttcaatacctttaccatttgtatttctttaggggaacatcatnttaactaatgacttgtcacaaataacacgaaatatgcgttgcagaccacatagaaagaacattcaagcatgcacactttgaacacgttgtaagtccacagtcgcaatttcccctctaataactagccttctactaggttactgc

SEQ ID NO: 652156 - DNA, 331 bp, Homo sapiens
gtagtgaacgcattgcggtgccttgactcttctatcatgagctaggagacaggggtgtgtcatacattcctaaacctcctcgagaagcaagctgttccaagatcatagtgactagaacttgtttggtggcatatcttcaggtggcccaaaccggaatctagggacaccagcaacctgcggtgacatagactttgcttccgcaaatccatcagtacgatgtggcaccacaagagttggaagtacttggaacagtgctgtctccatcatcaaaaaaatgctagtagcatgccacctattcctggagtcaacttaaggccacgtcctaccagac

SEQ ID NO: 652157 - DNA, 400 bp, Homo sapiens
gcggggggctcacgcctgtaatcccagcactttgggaggcagaggcaggcggatcacgaggtcaggagatcgagaccatcctggctaacacggtgaaaccctgtctctactaaaaatacaaaaaattagccaggcgtgctggcaggcgcctgtagtcccagctacttgggagggtgaggcaggagaatggtgtcaacctgggaggcggaggttgcggtgagccaagatagcaccactgcactacaggctgggtgacggaacgagactccatctcaaaaaaaaaaaaaaattttacatttcaggggttttaagattaaatatgtggggcaaccattcaccaatagtctcataattttaagaacattttcaatcaatccccttcaaaaaacccttttatcca

SEQ ID NO: 652158 - DNA, 222 bp, Homo sapiens
  misc_feature (10)..(10): n is a, c, g, or t
  misc_feature (37)..(37): n is a, c, g, or t
  misc_feature (46)..(46): n is a, c, g, or t
  misc_feature (58)..(58): n is a, c, g, or t
  misc_feature (138)..(138): n is a, c, g, or t
  misc_feature (204)..(204): n is a, c, g, or t
atcttcccgnctgagagtggtggggaggagccttgtncttcttagnctgttcacctgnccgaggctttctgggccactcaggccagtgcacccctgggcagagccctttaaagctgctgtcactagatgcccatggtncagggcctggttgggcgtgagaaggatagggtggcaggggcagaaaactgggcagcccttaatttnataagcagcaagggggga

SEQ ID NO: 652159 - DNA, 174 bp, Homo sapiens
agcagagcacgagtgctggcattacaggcgtgatcgaatgcgcctggcacattttatagccaacctggcttcttgtgtaacatgagttggggcttcttgggccccagagtccagcactcagtgtagaaatatgaccgccatggccagacagcagccctcgctgggcccctcttc

SEQ ID NO: 652160 - DNA, 168 bp, Homo sapiens
gcggaaccctaagtagctttgtggcttcgtgtccaaccctcttgcctttcgcctgtgtgccttgagccagtcccaccaagctcgcgtatcctcctgtagtgctcacaggtcccagcaccgatagaattccacttgcccatagatctgagcggaatcacgttatgagac

SEQ ID NO: 652161 - DNA, 265 bp, Homo sapiens
tagagaatcactccggtgacatcgccctatgtatgtgattactggtgtggaaggccttcggcctgtgtgctgagcttgtccgccagcagagaattcagactgcagaaaagccttctgttagtcaggaatgcgggacatccttcacccagagctcatgctgaacaaggtagtctctctgggtgaagagtctgtctcacttactacatttgaagggattctctccagcgtgaattaactgatgtgtctgagaagtgcgcctgggttg

SEQ ID NO: 652162 - DNA, 203 bp, Homo sapiens
tagactgtggaagacgcgattggctaaactcccatagtatttatggtggccgccggcgtgggccgcagcccagcttgcaggccagctctagctctcttcctaccccattcccggcttccatacgcctgacctgcagactagctaggagcatacctgccctgacgagagaggcaagctaaggccgtgcgggacagatgggagac

SEQ ID NO: 652163 - DNA, 623 bp, Homo sapiens
  misc_feature (409)..(409): n is a, c, g, or t
  misc_feature (416)..(416): n is a, c, g, or t
  misc_feature (419)..(419): n is a, c, g, or t
  misc_feature (569)..(569): n is a, c, g, or t
  misc_feature (600)..(600): n is a, c, g, or t
ctgattctcgttggatggaagtcttgtggaccctatagagatttggccataggagtaacacttaaccatctgctgtggtggaaagaacactcactgtagggtcactctagcctggattctaatctcagttctttatttatcaggtgagtgcctatagataagttactttgactctcagagcctgagattctgtatctatacaatgggggaagtaatgcctgccataatggcttacataagataatcaggaagttcctggtttaaggacgaagctgaatgtatgtcattccccctaaatttgcgcccatttgctctggttcaagcttactatccaagagtgaatatgttctctcgcttttccaaatgatagccgctctattaagtacaaccatactgtcacccattatgnattactncanacacaatggaccaggttccttcaaatgtcaagtatacggcgtaattcatgatcctttggtgatgacatcattgaaggcgaatatggactcacaaggcaatagtgaagtgagcctgacaggcttcatctggatttctttaaggagaaacanggctttaaggaatggattggctctctcatgncacattcatgggggggtgccctt

SEQ ID NO: 652164 - DNA, 201 bp, Homo sapiens
ggggggggtttttttgggaacccttttttttttgattttgtgggccccgggggttgggggccccccctcgccccctccctccggggcgggggggggccccccccccctgcctccccccaggggccccccccccccccggcggggggtccggggggggcctttttttttttcctttttgttttttttaacggccccgcccca

SEQ ID NO: 652165 - DNA, 412 bp, Homo sapiens
cagcaggcccccatggcctggtgtttggtctgatcaccccaacatttctggcacccaacgtggggctatgaagaccccagtgaaggaacactagagcatgcggaactggaggacgcattgtcagaggacacccgaggatgactgaaagaagctcggtgggaaagctgagcactcggaagaaacagggtaacaacaggacagaatgaaagttccactggcagacagcagagaagaggagaagcatctggacatcagagagtacagttggatgttggagagaagcagcttgacttcacagagacggcttgatggcattgctccaggggaagatcaccttcctgctccatcccctttccagctccccttcccactgagtgccactttcatcaacaataaaatcccctgcattcac

SEQ ID NO: 652166 - DNA, 341 bp, Homo sapiens
tggacttactgcatcagctagaatgaatggatacataatcatccatataccgaaaataccaaggttatggcacacagcgtggtgccagcgagtgaacggaggaagtaatagcttgaagcgtcggatgtgccgaacgaatcttgcttgtccatcacagagctgcacacaggtaatgaaatactagtattatgaggttcaaccagaaatctcttgtacgggtaagcttagacgcagtcatgtgcttgaatgaaatgttagcctactcatggaactgccttccagaaatacttacttcacagtgtgaatcagaggtatggtagtaaacaacacttcgtgggcag

SEQ ID NO: 652167 - DNA, 441 bp, Homo sapiens
ggtggagaatgcacgccgtctgtgcgtctcacagtgctttctgatgcccatttacagaaggcttgtgctgtttctgattcccttgaaagtatgtggtaagtgatgttatgaacgctctagtgcgccttcagaagttcttctcgaactgcacgaggtgaattttcggaccagcacacaatgttcttacactagccattaagcaatttgtcggataatacaatatagaactttcccagtgtatttaaccttccaaagtcgccgtgtaaatcacatctagtgtttccctagctgttctcgaaaatcacagagctgagcatagctcaagacccagatggtcccgaccatttccttctgatccttggtcttagttttttcctttttttaaaagagtaaagtttccaaaaaatcgaaggctatagaagccgacaacagaggacacca

SEQ ID NO: 652168 - DNA, 477 bp, Homo sapiens
  misc_feature (10)..(10): n is a, c, g, or t
  misc_feature (18)..(18): n is a, c, g, or t
  misc_feature (29)..(29): n is a, c, g, or t
  misc_feature (33)..(33): n is a, c, g, or t
  misc_feature (39)..(39): n is a, c, g, or t
  misc_feature (41)..(41): n is a, c, g, or t
  misc_feature (64)..(64): n is a, c, g, or t
  misc_feature (68)..(68): n is a, c, g, or t
  misc_feature (102)..(102): n is a, c, g, or t
  misc_feature (114)..(114): n is a, c, g, or t
  misc_feature (117)..(118): n is a, c, g, or t
  misc_feature (122)..(123): n is a, c, g, or t
  misc_feature (126)..(127): n is a, c, g, or t
  misc_feature (135)..(135): n is a, c, g, or t
  misc_feature (142)..(143): n is a, c, g, or t
  misc_feature (153)..(153): n is a, c, g, or t
  misc_feature (177)..(177): n is a, c, g, or t
  misc_feature (180)..(180): n is a, c, g, or t
  misc_feature (197)..(197): n is a, c, g, or t
  misc_feature (199)..(199): n is a, c, g, or t
  misc_feature (206)..(206): n is a, c, g, or t
  misc_feature (218)..(218): n is a, c, g, or t
  misc_feature (232)..(232): n is a, c, g, or t
  misc_feature (240)..(240): n is a, c, g, or t
  misc_feature (242)..(242): n is a, c, g, or t
  misc_feature (247)..(247): n is a, c, g, or t
  misc_feature (277)..(277): n is a, c, g, or t
  misc_feature (295)..(295): n is a, c, g, or t
  misc_feature (297)..(298): n is a, c, g, or t
  misc_feature (303)..(303): n is a, c, g, or t
  misc_feature (306)..(306): n is a, c, g, or t
  misc_feature (346)..(346): n is a, c, g, or t
  misc_feature (357)..(357): n is a, c, g, or t
  misc_feature (366)..(366): n is a, c, g, or t
  misc_feature (398)..(398): n is a, c, g, or t
  misc_feature (409)..(409): n is a, c, g, or t
  misc_feature (471)..(471): n is a, c, g, or t
tctggaaggntctcaggnctttatttgcncccncaactncnaggaattgacttatttaattaanccancaacgcttcaaagcaaaaatttgagaacacaaanttaaattcaggntcnnaacnncannagggaagnaagaagnngcagcccagngcaccaagaatttgagaaagaganggngaaaaccagccccaccncnctggaanaggaaagaggancggggggggaacanagggcagngnggggncagggggcacgggggacacgggggggggcngtctctccacccccccanannatgcnaanaggaacgcagaaacattcaggggcctttgcagaaagagangccagaggcgncttgaagtnacaaaggagaggggtgaagaaatcctgcatcncagtcccacanaggcagcggtttcaggctttacaagtgatgagagaatcaacagagccctgggcactgttgcngcccgc

SEQ ID NO: 652169 - DNA, 419 bp, Homo sapiens
  misc_feature (32)..(32): n is a, c, g, or t
  misc_feature (127)..(127): n is a, c, g, or t
ctggaaaaaatcccctaagccttagcccatancgttagcccatgatattgttagcacaatgcattacctcatgcggtgatgcctagtgtaaatgcctgcccttacccagtcatataaatgtatagcncaaggggcccaggtggggtgccttatgccctgtaatctcagcactttgggaagctgaggggggaagattgcttgagcacaggaatacaagtctagccctggttaatgtagggagggcacgtttctacaaaaactaaataaaattagcctggcatggtggcatgcacctgtagtcccagctactctggaggctgagacggaaggattgcttgagccctggaggttgagctgcagtgagccatgatcatgccactgcactccagtctgggcgacagagcaatccccatctcaaa

SEQ ID NO: 652170 - DNA, 586 bp, Homo sapiens
  misc_feature (15)..(16): n is a, c, g, or t
  misc_feature (22)..(22): n is a, c, g, or t
  misc_feature (36)..(36): n is a, c, g, or t
  misc_feature (38)..(38): n is a, c, g, or t
  misc_feature (42)..(42): n is a, c, g, or t
  misc_feature (52)..(52): n is a, c, g, or t
  misc_feature (63)..(64): n is a, c, g, or t
  misc_feature (78)..(78): n is a, c, g, or t
  misc_feature (83)..(83): n is a, c, g, or t
  misc_feature (92)..(92): n is a, c, g, or t
  misc_feature (158)..(158): n is a, c, g, or t
  misc_feature (349)..(349): n is a, c, g, or t
  misc_feature (453)..(453): n is a, c, g, or t
  misc_feature (484)..(484): n is a, c, g, or t
  misc_feature (488)..(488): n is a, c, g, or t
  misc_feature (507)..(507): n is a, c, g, or t
  misc_feature (510)..(510): n is a, c, g, or t
  misc_feature (512)..(513): n is a, c, g, or t
cggtggttcaaaagnngacttnaccctttttgactncntganctggtacaanctacatgaaannccgttgcgcctttnctagnctgtaaaancatcatgaaatgtgcactaataacgtggagactatgcagatgaaatgaaaccagctgcatagagcncagagctcagagcctggcctttagaagccctcagtaagggttcatgatgccatggtgtctgtcgtcatcctctttatcctcatcatcaccttcataatctttttgttgttcttagggaatagtttagagggactgattccctgctatcatgggtgagatgtctatgaaaaggacaaccagtgggggagganagcaaaattttgaataagatttctgagacccccagcacaaccaagaacagaaactgcacagtctgctgagcggacagtttgcacattggtctcctcccatctgnccaccacactctcctgtttgtcctgaggagnaggnaaccaaacaaggctcccgnccntnnctcagcactcacttgaaggggtggcctgcccctccacagctgtgggtatgtctagtcgggtgggatgagagac

SEQ ID NO: 652171 - DNA, 442 bp, Homo sapiens
aaaaaaaaagaaaaaagccaaaatttctggagtcaactgggtgatactagggttgcccagtgatatctctatagctctttcacatagtctgtggtaagctggtgggtgacctggcatctgatctacaatggcctcatagcacatgtctggcattcacaggctgttggccgagtgcttcatttctacatgtagccttctatcctccagcagactatctcactgtcatgcacatagtagtccatggttccaagtgctgcaagagagattaagcctcaatacacacatgtttttctaggtctctgcttggatcccctttgctgctataacaagcctatattcaaggatagagacatagactgagttctaatgggaggagccacaaaattgcatcacaaagagacaggcagaatttgtggcccttgttggagtgcatcacattgtc

SEQ ID NO: 652172 - DNA, 428 bp, Homo sapiens
  misc_feature (309)..(309): n is a, c, g, or t
  misc_feature (318)..(318): n is a, c, g, or t
  misc_feature (358)..(358): n is a, c, g, or t
  misc_feature (361)..(361): n is a, c, g, or t
  misc_feature (374)..(374): n is a, c, g, or t
  misc_feature (414)..(415): n is a, c, g, or t
ttcgtatcctcctgggaatacaaagacatttttttccccattagtgacaccgggacacggcaccttcaatacaactcccccacccaccaagggctggaagtttacatcggaaaggcccaggcaagtctttgtttccagagccaaacaaagccaatgacaagttccagagataaatgtacttccagcccacgcgctgcaggtggggcgatcccccgggagccgagagccaggggtaccgggcaaaacctcaggggtgtcggccgccccgagcttccccgagggcgtacctttgaggaagaagaccttgcngccgcctcnggcagaccgccgccgccagggccagggtgcctgttcgctnttnccgtccagggctnctgcgctcgtccagctaactacacggcgtggtaggctgcnncagcaggcggtcc

SEQ ID NO: 652173 - DNA, 195 bp, Homo sapiens
tcgagctggtacctgttgctaggaggagtgagtggcacaatctcggtcatgcaacctacctccaaatccctggttcaggcgattctcctgcctcagcctcccaagtagctgggattacaggtgtgcaccaccatgcccagctaattttgtatttttagtcaagacagggtttcaccatgttggccaggatggtct

SEQ ID NO: 652174 - DNA, 326 bp, Homo sapiens
ttacaccatcccctggtatccagcctcccaaagccttttagcttacacctggacagatcctgatactcacacatccgcacagctaacatggactatattcccacaggggggctggaatagcccctgacttatttggacaggccctcaccagggacctggctaaacttccccttgctcctagcaccctcctccaatacatcaataacacccttctctgtagcccctcccttaacctatctatccatccaacacatcatacagcttctaaactttctccattctaggggatattaggtctcactcacaaaggctcaagtaacccaaac

SEQ ID NO: 652175 - DNA, 328 bp, Homo sapiens
tcttgagaggacagttttaaaggacaagactaggaaactgagtaagagtgaggcaaattgtcctttcccaccctacttgggatagtggtaagagcttgagccctagagccataacacatggttcaaactccatttctgccacttaacatgtgtgtcacctgttggacaggttacttagtcttttgagacctcagtttctttatctatataatttggttattagtagcacctaattgataagtttgttgaaggggatcaaatgtgatgaccttctaaaatggttagcataataattagcttggcaatgtgccaaataatattatttatc

SEQ ID NO: 652176 - DNA, 286 bp, Homo sapiens
agaatttgcgaaggcaggaacagagccttggcccaggttaagtataggtttattccttagtccaagttgacccaacccaacccaatttcttagccaacacggaattagttaaggaaaatgcccaaagtgggaattgttaacctcatcaaaggagatgggacctgcaacacaagcacctttgggtcagtgtgttaattagggctgagagctgggtgaaaggcaagaagaggggcaaaagaggctgaggtggtaattcctcttgtcagtgtcatgggagaaaagaacc

SEQ ID NO: 652177 - DNA, 450 bp, Homo sapiens
tcccccggtaatgtaataactgtattgctgaggctggctcaaactcctggcctcaggtgatcctcctaccatgacctccaaaagtgcaggcattgtaggtgtgagcactgcacccagccttatgtatttatctacataaaagacagcacaggattatcttccagagttaaaagtggtcaataaagacagaaacacagttcgctccaccgagataatttggatctccgggacgacatttgttctgccaggtcataggatcacccgacgaggagtcggataattttagagcaaaagaccaaccgtcaggagtcatggacgcaacagtgtgataagcgcaggtccacaggcttcaggaacttgaggccatggtggacacacatcaccaaaggattcagcagtgtatcacctttctctttatctaatggtggaaggatgatgttgtcacggcag

SEQ ID NO: 652178 - DNA, 293 bp, Homo sapiens
tagagcgacgttacctggtatccccacccctggtctctctctctctcctctcctattccctgagacacagtattgaaattaggccaatgaataaccctgtggtaacctctgagtattcaagtgaaagacagagttggacattctcactttaagatcaaagctagaaatgattaagcttagtgaggaaggtcaagatagaagccaagatagactgaaagctaggcctcttagaccaaacagccaagttgtgaatacagaggaaactttgtttttaaagagacagagtctcactt

SEQ ID NO: 652179 - DNA, 192 bp, Homo sapiens
tcgacctctaagaggatccccttaagggggtgctttttctctattgatttgtatgagctccttgtagattctggatatagtcctttgttggatgcagaatttgcagatattttctcccattctataggttgtctgtttactctgttgatagtttcttttgctatgctgaagctctttagtttaagtcggtcc

SEQ ID NO: 652180 - DNA, 174 bp, Homo sapiens
  misc_feature (27)..(27): n is a, c, g, or t
  misc_feature (101)..(101): n is a, c, g, or t
  misc_feature (103)..(103): n is a, c, g, or t
taccaagccatcataccattgtggctnagggggcatgaggatgaggagaaagcaccaatgtgagggcatcctcggtgtccacaggagagcatattgcttgngngggaagctttctacacatctggatggcgacaccctgtagcagttccagggaagggtgctcccgggcagctc

SEQ ID NO: 652181 - DNA, 991 bp, Homo sapiens
gagtggaaccagtgccgcgaacccaggccgggagtggggttcggcctgaggcgggaaggtgactgacatgttctcgaagaccccttttatgtactccgaggcgatatgcgagaaggcggttgaacacgagccgccgggttgtacctagcgtctaggtgcagtaacgctcatgcaggaaagcgcggggtcggacgcgaggagctggactgacgaccaatgagctgcggaatgggcctgcgcagcatcgagtgggacctcgaggacctggaagagaccatcggtatagtggaagccaacccaggcaagttcaagctcccagccgggacctgcaggagagaaaggtgtcgtggagcggatgcgagaggcagtccaggaaatgaaggaccatatggtcagcccaacagccgtagcatttttggagaggaataacagagagatactcgcaggcagccagctgcccagaagtccacccagcgacctgctggatgccagcgcagtctcggccacatctcgctacatcgaggagcaagcaggccacacagcagctgatcatggattaaacaggatcaaccagctggaggatggtgtctgggaagcatccaggttctgaagcatatgttcgggcgcgttggagaagagctggacgagcaggcatcatgctggatgccttcgccagaagattggacacacccagtcccgcatggaccggggtcctcagggaagttggccaaagtattccacatgacggagttgttgagtccctcaggggaggggtcagtccttggtgggggcaggttgtaggtggtacctcttcccgtgaccctgaccttttgttccagacgcgacgtgtgtccactcgcgtggtgagtgggaggtcttcctcgtctcaatctatatttctttgaccggcctctggggtggtcctaactggggcccacactttggtggctcccaaggaaggggccccgttggaaagaggcccgggggccgc

SEQ ID NO: 652182 - DNA, 133 bp, Homo sapiens
taaactaggagtgataaggctcttaaatataaaaagacatatggaagttgcagtttacactttatctcaaccatccactttcctgatggtccgtcagctttccaaggaaattgctggatgttatatttgagta

SEQ ID NO: 652183 - DNA, 441 bp, Homo sapiens
tgacgtcgggagcgaagcgctccaggacgggcccccacacggcgtcgaagaggagccgatactccccgtcatgggtgcgaggggggagcggcacgttgatagtggtatgaccccctagggcggtgcccgcgtcctccagccgcccgccccggtggggataggcgtaggccgtgtccatgtgcagggacagggtgagcacgtcaggatcgtcggcgaaggcctcctccaccccgtcgccatggtgggcgtccaggtccaaatacagcacccgccatccttccgccttaagccgcaggatcgccagcaccggatcgttgaagtagcagaagccccgggcatggtcgggccgagcgtggtgcatgcctcctgcgggattgaaggcgacccgtccggcgagcaccgcctccgccgcctggaggctcccgccggcggcggcggccg

SEQ ID NO: 652184 - DNA, 207 bp, Homo sapiens
cagtggcagctgttggagaacaacgaacgggttttgaccacaagcaggtcactacgggggctacttccgagaccagaaggacggctacggcaaaaacgagggctacatcgccgcggtggctaccgccagcagcagtctccagacggcctactgagctctccactctgtttcccgcctggggcatccaagcattaaagtcctaaacca

SEQ ID NO: 652185 - DNA, 343 bp, Homo sapiens
cgtactggttaaaagctggaagatggccctaaattcttgaagactggctatgctggcaatgatgatatggttcctggcaagcccatgtatgttgacagcttcttagactatccaactttgggtcgctttgctgattgtgatatgacacaaacagatggggagggtttcatcaaaacattggacaataaggctggtggatctggcaaggtcaccaactctgcccagaaagctcagaaggctaaatgaatattatgcctaatacctgccaccccactcttaatcaatggtggaagaacggtcttagaactgtttgttctaactggccatttaagtttactaacta

SEQ ID NO: 652186 - DNA, 225 bp, Homo sapiens
  misc_feature (225)..(225): n is a, c, g, or t
gagatcctggtgtcgccatgggccgccgccccgcccgttgttacggtattgtaagacaagccgtacccaaagtctcgcttctgccgaggggttccctgatgccaagattcgcatttttagaccttgggcggaaaaaggcaaaagtggataagtttccgctttgtggccacatagtgtcagatgagtattagcagctgtactctcgaggcgctcgaggctgtccgn

SEQ ID NO: 652187 - DNA, 229 bp, Homo sapiens
agaccgggctcgtagcagagaaggacaataccatatgatatcacttctatgtggaatctaaaatatgatgcaaatgaacttatctgcgaaacagagacagagagaacagacttatggttgccaaggaagagtggggagatgggaggaatggagtgaaaggttgggtttaactaatgcgactgttatatataggatgtgtaattataccaacgacagggtcagaccgctc

SEQ ID NO: 652188 - DNA, 194 bp, Homo sapiens
tttcactaaacttccacatataactccaactttattattagacacacttttgtggtaaatctaagcgtgacattatagggcaggaataattagcttgcaggactgtcagattgttaccaaaaaacacatctttttttttttgggacggagtcctacttcgtcgcccaggctgtagtgcagtggctcaatctcag

SEQ ID NO: 652189 - DNA, 131 bp, Homo sapiens
ggatcccttacttgatggccaagggagatctatgatattgtggtacagattatagatgttttacgaaggtcataagtgaagcctgccaggaaagacatagatttacaaccttacattgcctagttccacat

SEQ ID NO: 652190 - DNA, 191 bp, Homo sapiens
  misc_feature (127)..(127): n is a, c, g, or t
  misc_feature (137)..(137): n is a, c, g, or t
  misc_feature (155)..(155): n is a, c, g, or t
  misc_feature (179)..(179): n is a, c, g, or t
cacacattcctaaacagaaggaatgtgccaagctagaccaaataccaagattcaaaaagatcactctctctggttcctttggttctcactataatgtgtatttttttactaccagccatagccacangagctgacanggtaatagcgcggtatanatggggagacggggctgggaaacntgctatgcatgg

SEQ ID NO: 652191 - DNA, 295 bp, Homo sapiens
acacggaattgagagtgcaccgttatgctttcagcaaacaggagggcatcactccagacacagcaacatgcaccaatgccccacaggcctcctgtcaattcagctccagtgtggtcatgtgtgcagcacaaagtgaaatgcaggctggggcaagcttggccacagggcaaacagtcaatgcaacacaggcatcattcaaggcacatttcatcattttcaccattgccacagcccaatgcaacaggcccattgccaaacagtttctcacacagcaaacacatccagcaccaacatc

SEQ ID NO: 652192 - DNA, 964 bp, Homo sapiens
ggcgctcaccagctttttacctgcgcctactcagctatctcaggaccaaggacttggaggactgaagaaagaggcacctgatcccagagatcatggtagagcctcaagctggtctcctcccgtaagtagacacctccccccgttatcggcaataccgggtaaagcgctgagtatactctcggttattagaagtgatttttaggagatggtggtgctttgtccagcaggatccttgtgagccccagaatcccacgtgggatcatggcgacgaaacgagcataaaatgtacgcacaatcgccgctgtccattcaggtgtgattctgaaggtataatattgatatatgaattgcaattggctcgacgccggacagtcagatggacaaggtcatttatagctaaaattacactgacctggttccgcaaaggcaggttatgaatgcagatgatccagacctgcaaaggcccgatgaagaagctattaatcgagataacagaaaagacaagagtagtcctttaggaagtaatctgtatcacagacagggtcgccggcacgtccatgccagttcgagcagctgacagattggctcctgctcagtatatccgtatacacatccatctcagtctaggagtggtacttcaactctggagctaaccagagggttatccggatggtagaacatgccgagagatcctatggagcctccaggtccacgattaattacgaagaattcgcctggggaccaccttctcctcctgagcctgtcatgcctttctcctagccgaaagatgattgttgaggcacatggagagtgggaaattcctccttgatttgtaagtggaaaatgcgagggttatcactccattaaccacgttgctgctgtggacaggctacgccgtctaatgcatttcgccatggtgaaccctcatggtgtggaagcgcgactggagggtccggaggaaggc

SEQ ID NO: 652193 - DNA, 871 bp, Homo sapiens
gccacccgccagttcgtcggggtacagttggcggccggcgatgttggcgagctcttctcaccgggaagctgacgggatgtgctaagagacggagtccccggttgtcatgcatcaccatggccggtcatttcattcacatcaccatcacagcgggctctattctggtgggtcacgacttcagaaaacgtttctcccttcagcctcctagaactgctctccaggttggccacccttctgggtcgacttactgtggactccctgggacgaggggaccatctcccgacaactgtggctctggtatacgaactcctggatgaagtgctggactatggctatgtacagagcacatccacggagatgctgaggaattgtcatccagtacggaagctgtggtcagcaagcccttcagcctctttgacctcaggcaggcgttggcttgtaggggctgagacagcgaacagagcaaagtggcccccagtcagatgcaggccagccgacccgtcctgtccagtcgctactgaccagagccaaaagacatgacagtgctccggatgctggtctgagagattgtctgtacggatagcatctaatggatccctgctgacacgtggatgtgctgggagagattcggctcaagagcttccttcctagcggctctgaagatgcgcgttggcttgacggaatagtttgtagtggggaaggtcagacgcttgagacggttactggggcctaggaatcctgggtcgatgaagtctcgttgcaacagcttctgtgaatcttggacgactttggcgtctcatcgaatcctcccggttgcaacacctcagggcgaagtgactgtgatgcggcaccaaatctaccgtgagctccc

SEQ ID NO: 652194 - DNA, 160 bp, Homo sapiens
aacgacccctttgccctgtgaggcccactgctgtcctcaaaggcctgcacggggatgtcttggcctttcgtgtggatgctgcggagctgggggtgctgtggagcttatgtcctgtagggccttcagcggcctgtcacgtgcgtaacaatggcacgtgcgg

SEQ ID NO: 652195 - DNA, 339 bp, Homo sapiens
  misc_feature (7)..(7): n is a, c, g, or t
acccgtnaaggagttattcgtaggcgttatttaaaggcgttgttttggattctgccgcataaatatccgtcagaaaccgtttggaccggcattgcttgcctccttttaagcaggccagccttttccggattttagataaattcggtatcgttttacggaattaacccccgtgggtagtagcggcacgcagtgctcccgaacatctcgcgctgttcgcgggccgcctcacaaattcctcagctaattaaaaacctccagcccaacaactccgcttgcttcctcaacctcgcagcctacgaataactcctccgggatccgtgcacgttaacgattactagg

SEQ ID NO: 652196 - DNA, 199 bp, Homo sapiens
cacatgcttccagaacgcgcgagccgcatgcagatccaagcccggcctcaacgcagcgggtaccagctgccgaggaaagggcaaaagatcatctgggaatgaccagggaccacagtgtggacagaggccatgcaagacgactgcgacaggaagaggcccccaacggcagaaaccccgtggcaccactcgccacaccact

SEQ ID NO: 652197 - DNA, 809 bp, Homo sapiens
tggaaagagggattcccttaggtgttaggtcttctacttagaaaaagctattgctaagttagatttatcttgtagatagtgtcatctttgtatttctgaatataaggttggacttagattgattcacactgaggggaaccgattcttttataatccgaactgtgaattcatcatatgactataatccacagttattcagttgtggagttgcttgagacatatgtaagagactctatttgtctcttgtcttacagtctcttaaatagtgtaacttatattccccaccttctgcttgctattctttactccctccgcctccacatgataataggaaatatcgatagagtttttctgctagtgcattcaagttctaattctagaataagactaagtataggcgttgtacctgatattgctactttttctaccgagatgttttcagattctaagagtcgctagtgttgtaaaactcattttcaatcggattaggccttctgttacttagcgttattatgagagtaactcagtggataggcagtcagatgaatgctcaattctatgggagtgcagttatctagaataccagatttctgaaatcatatataacgtgtcattcagagttctaagacctttgctgtagcacaagcagagcagaggatgtcatctgttcacctaaaatgagaaaaaagctatttatgctgatggagcatgctttttaacgttcctttataagagcgctcgccttatacagctttgtggaccaaataaaagcccaaaatagacccttggtagtccattgaatcctcgaa

SEQ ID NO: 652198 - DNA, 216 bp, Homo sapiens
tcagcctccatagttgcatgggattacaggcatagccactgagcccggctgtttttttgtgttttttttgttgttagtttgtttgtttgtttggtgagacagagtcttgctctgtcgcccaggctggagtgccagtggcgcgatttcagctcactcaggagtgagccaccacacctggcctgtgattggctctattttgagtgattacgtgtaaat

SEQ ID NO: 652199 - DNA, 150 bp, Homo sapiens
agacagtgcggcggtgaacagatatggactcgaacccagaatctagtggcacagcaatgcaatgccttagaccactgcaccactcaggaggcctcaggcagatatatatatttttttcaaatccttatatctacatatatttatatgcct

SEQ ID NO: 652200 - DNA, 203 bp, Homo sapiens
tcgagacaaagtttcgttcttttatgcccaggctggagtgcagcaaaggtagtgatgtcggctcactgcgacctccacctcctgggttcaagcaattctcctgcctcagcctcccaagtagctaggattataggtacatgccaccatgccggctaattttttctatttttagtagagacgagatctgactatactgcccaggt

SEQ ID NO: 652201 - DNA, 387 bp, Homo sapiens
  misc_feature (328)..(328): n is a, c, g, or t
ttcttttaaattttttctctcggctttcattcttagcaaaatcctcgcccagtctgtttggggaatctgaagaggtcaaatgcccaggttattccctccagggaggaaagttttctctccctgttcataatatttctgaaataaatcagggagggtgagtttctctcccaaatgatctgttcttcaaccactgtctcatggtcaatatcttttttttcatctgaggaccacatggtgaccgagaactcgccctccagggtcttgatctgcacctgcttctgctcccacttcttgttgtcccgggtgcgcacggccgcccgccgcccgncccgccgctgaggtaactcttcttgccgctcttcttccccgcccttcttgacgcggtcc

SEQ ID NO: 652202 - DNA, 137 bp, Homo sapiens
cctgggacgtcaaggctgcagagagccatgatcatgccactgcactgcagcctgggtaagaaagcaagacctgtactgaaaaaaaacaacgtatttggaaggatgattgcggagactaagcagataataggtaacaa

SEQ ID NO: 652203 - DNA, 139 bp, Homo sapiens
  misc_feature (111)..(111): n is a, c, g, or t
cgtcgatttggccgcctcctaccgctccaagccagcctcagcatggatgcccctggatcaggcattgctcctcgtggcatcttcacaagtactcggcaggagggtgacaanacacctgagcaagaaggagctgaaggag

SEQ ID NO: 652204 - DNA, 102 bp, Homo sapiens
aaatgccgggtcatcggctgcttctcgggctctaactcattcagctccacctccttcatatccacctcggtgtcctggctcatggtggatatgaaggaggag

SEQ ID NO: 652205 - DNA, 100 bp, Homo sapiens
tacgactcgagctagtaccgttcactgatttcccctattctcattctacaccctagaccaaacctacgccaaaatccatttcactatcatattcatctgg

SEQ ID NO: 652206 - DNA, 135 bp, Homo sapiens
tgtattaaacgatcagcactaaaccttcaaaaaatgcccagtgttcctagttaaatcttaagaggggagaaagagatatcttttaaataatgttttgctaatgaaaagagtaatatattcttgtgtaaatcggca

SEQ ID NO: 652207 - DNA, 526 bp, Homo sapiens
  misc_feature (58)..(59): n is a, c, g, or t
  misc_feature (515)..(515): n is a, c, g, or t
ggacagcagtgtaagtgtgtagcatcttgctggaaagtatggtgttggaatgcgtganncactgtgcccggccaagactgtcttatgatagtacaagccaaattagaattgctctgctctcctgacctcttctccctcttcctgcttcactcctgacagggtctgaaaccagaattactatcccagataagaggaggaagtgtggacctcaaggttggcagtgagattctaaggacctattccctctcttagaccacaaggttctcacccacagctggtcccagtgggggaaaaaatggagacaccttgcctttgaatgaacttaggactttgcttattatctgaggctggatatttgtaattagagaattgacatggagtttacaacctgaagtgaccacagaaccgatgactcgtagatctctatttccagcacagacttctcctttgaaatttcattcttacgcattccaaagcctgctggccatttccaactagctgtacaagctcctcanactcgccatgt

SEQ ID NO: 652208 - DNA, 130 bp, Homo sapiens
atacaccttctcactgtgtgctttgtgtctgcgttgtatacctttgccagacctcaatttcttcatctgtactagtgagaattatagtatctattcatgtgggttgctttgaggggtggtatacgggtac

SEQ ID NO: 652209 - DNA, 645 bp, Homo sapiens
ctctagaggaccccggtcaattgctacaccttatgcgactgacacatgcggcctggtagctggagcccgggaagtggttcaacgcaataaagaggcttctggctcccagcaaatggctcggtaagcatagtatcctctgcctgcaagtctctcctgatgatgtcagtatgcatactggggtggttgagatcatctaggtggggatgatgcaccccaaactaaagcccctctctctcgcggctcgctttgcagggtgagtgcagacatctgtagcaatggaaggtaagtgccttgtgttgcatatggacgaattactaaatgctactatgattctgtgccaggtttcgtgccttctaggatatagtaatgactgaaatcatagtgaatgggagcatccagtcaattacttagaacagatttgtagtttgtacttaaagtgtgtgtgtgtatgtgcataggtgtgtgtgggcaggcacatgtggggtaggcttataaagaaaactgaatgcacagtgtaacgcctgctactctccctggtaaacagcaatagctttttatttcaaactattcgaaatatgtaacttccttaaaatattttgacaagtgtcacagggcaagtagggctattttaaaaaagtgtgtgaa

SEQ ID NO: 652210 - DNA, 762 bp, Homo sapiens
  misc_feature (114)..(114): n is a, c, g, or t
  misc_feature (263)..(263): n is a, c, g, or t
gcagccatcttgcctggagcctgagaaagggaggagagacagaaggaaccggcgacagtggtctcagtggccgctccggggggcctcaagaaccggaggcagccccggagctgncgcgtggcggacacgccagaggaggaggccggggaatggccgcggtgttggcagcaagtcttagcagtggacgcgaggtacaacgcgtaccggacaccaacgtttccacagtttcggacgcagtatatccgccggcgcaagcagcttgntgcgggagaatgccaaggttgggcaccccccagcgctgcgttggcagtacctgaggcttcgggggcagctgctgggccagcgctacgggcccctcttccgagccaggcagtgcttcgtgcctatagcaacagcatcgtccgcagtaaccgcactaactcttgaacggattgaggactttgaggatgaattcctccgggcccttggggggccgtgggcaccgtcgttctgtcaaggagaaggtcctaacaggtgcaggcgcagattaaaccgtggcgtctatgaggacagggcccccttgcagcgtggtggccacgtcagcagcagaaggcaagtcgggccatgggcgggggacacgtctactgagcgagaactatggctttgcgggcatgtatcatgtttttgagcagcacgtggatgaggcagtcccaaggggtgcgcttcgcaatgatgaccgacacggctgggctgtggtcactcgacgggagatcttcctgtgca

SEQ ID NO: 652211 - DNA, 604 bp, Homo sapiens
atttgattcatctaacaagctgtaaagtagcaggaaaaatctgggtgatttggttgtttaataaaatatttttagaagatagtattttttgagtatttttaatcattagtataggtttaggcttagtgtattctgtatttgcacaatatgaagtgtatccagaatacagactttttttttttttttggccaatttagatattagagaaaaatgaatgaccaaaggtttgtgaaattttagattatgtggaatgtgaaaagaactaataattttatttaaattaccaaatgtttggtgtcataaaatgtggcttcttactattttttactgtttcacatggaaacttccatatttccagaccagcagataaccttcatgtacttaaatgaagaatattttttccataggtaataaatggtcttgattgatagcaaagttaacaggtactctgcctattttaaaatagaacaaattgctgataggattgatggagtctttttacattttgttatagcaaaagtaaatataaaatcttgaaaaaaaaaaaattaatgccctatttgtctgttatgtttttgtttgtactactatgaaagtggtccgg

SEQ ID NO: 652212 - DNA, 498 bp, Homo sapiens
  misc_feature (136)..(136): n is a, c, g, or t
  misc_feature (331)..(331): n is a, c, g, or t
  misc_feature (362)..(362): n is a, c, g, or t
  misc_feature (369)..(369): n is a, c, g, or t
  misc_feature (374)..(374): n is a, c, g, or t
  misc_feature (397)..(397): n is a, c, g, or t
  misc_feature (400)..(400): n is a, c, g, or t
  misc_feature (475)..(475): n is a, c, g, or t
ctgtggggagcttccccttgtcactgaggtaatgtagccaaacaaggttaaaaagcccccagtaagccgggtgcggtggctcatgcccgtaatctcagcactttgggaggccgaggcgggcagatcacctgaagtngagagtttaagaccagcctgaccaacatggagaaaccccgtctctactaaaaatacaaaattagctggatgtggtggcacatacctgtaatcccagctactcatgaggctgaggcaggagaatctcttgaacccgggaggcggaggttgctgtgagctgagatcgcaccactgcactccagcctgggcaacaagngtgaaactctgtctcaaaaaaaaaaaaaagntccctantaaanccatatcgtggggtaatgtcttnatncaataaattacctactgtagagtgtgatttaatttcccactaaaacttgtgcaaaaatcagaatagtagggtttnaccccttgacttctacttggccc

SEQ ID NO: 652213 - DNA, 715 bp, Homo sapiens
tgtccttgcaggcgcgggtcagtttcccaggcatgccggggtgggcatctcctatggctggaagctgaggctggctgcagctgtgggctggggtggggtgggtggggtcgggtggtggagacggcttaagcctgtcctggctggttgccctcccaagggtccttttcacccgtgtcccctggtggctgaagtgcccctgtgtccaaagctccccgcgtgggcgtcttcaggtctctaagcccttgggctttagcttggggtttccttgacttgtatgaccacatcctctcccggcgtcccgtaaaggggtaacgcgttagccacatgggaacgctggcccttttggggcgtacgggttgcttgtgggcgtcaccttggggggacgagggcgcccaaggacttgtactatggagcggttggcgcgcgcactgctcgttttcccgcagaagaaatccctctttctgcgcccgttggtggcccaccgggggggcaatggctggcggggaaacttcgtggcggacgtgcacacagacgatcctatatgtggggagaggcgctgggggccctccttcctggagctggcacgcccaccggtcttggcggtagagttcatttggggggacaggaaagagcccctggtggagagttttcgaccgtcccgttcttggtggcgaaaggagtccgtttaaatgaggggcgccccggggggccccac

SEQ ID NO: 652214 - DNA, 139 bp, Homo sapiens
accccccccccattttgtttcctttaggggcctcctttcctttgcccaagggagggagtgtgggcaggatttggaagttttgggattcagggtgttattaaaataataataataatttaaaactttgaagaaacctgga

SEQ ID NO: 652215 - DNA, 657 bp, Homo sapiens
  misc_feature (387)..(387): n is a, c, g, or t
cgtgatggccgattcctagaggtatccccccatgggagcgatgaaagacttagagcaaggggcttgccaatcacggaatcgagtaggaattccctgtagtcaggcaggcatgctgctcaatagggcgtcggatgatttccgcgcgtgtatcaatttggtgcgtgccgaggtttatagcaccggggaagggcactctgcgttgatggcgccgctcagtttgatgaagtttctttcatctttttctttgtaggtgttttttaggatttttcctacgggtcatcaggatttggagctcatgagattacctgcgggttctttaggctatgcggcctgtttaattccaccgcgacgttcatcatgcttcgatcaattttttgtgtatgcctngtcagcctgacctgctttatttcatcggcaaaggccaatttccaaccccgcgccaccttcagctcttcgctgcaaagcatcaagccggcctctatcgacgatgtcattgaccgcgcccatgagttgctgggtacgccctataagtggggcggcacatcggcagagcagggcttcgattgcagtagcttcctggtgtacttgttcaagacccaagccaatatccagctaccccgcaccactgccgccatgcaccgttcatcgcttccatgg

SEQ ID NO: 652216 - DNA, 257 bp, Homo sapiens
ttgtagttggttttctgtgtggccagtgtctttgtccagcaaaggagatcattcttaccagcaggtgccacatgcagtcttggttggacgttggctcttggagcatgttatgtgcttgtgcctgttgtgagatggccttgctgctgtgtgaatgtttacatttcccctggcaggtgacagtctggactccctgtgaaatgactgggaggaagtgtctggtcgacgcggccgcgaatttagtagtagtaggcggccgc

SEQ ID NO: 652217 - DNA, 788 bp, Homo sapiens
aatagctagtaagccgtgtaatcggcgaggtcttctcctcctgagctgaagaacggctcatttactacgtggatgtgcaaaagttccccttgcgctgacagacgaacgacctccttggtcaagcgagctctatcgggacccagcggaggatggggtcaccgccctcagtgtctacctcacccccaagaccagtgacagtgggaactggatcgagatcgacctatggcaccagactcaggggtgcgtgctgggtcatcgtgcagcgacccggagactgtgggctcggggcctcagcttcttccagaccttcactgtgcaccgtcagcctctgtcaccaagatcatgctgtcggagaagcacctcatctcagtctgtggcgacaacaatcacgtgcggacatggtctgtgagtcgcttccgcggcgatgatttccacccagcccgagtcgcgaccccactcgcttcctttagagatccgggtctctggagtcggcagatggtgcatggtggctgccagccgctgatcactgagcatgtggcccctacgagtgatgcgggacgaccagcaagtgttcatccagaaggtgggtgcccagtgccagccagctcttcgtgcgtctctcatctactgggcagcgggtgtgctccgtgcgctccgtggacggtcaccacgagagcttctagagtgcgtggacgtgcgagggcgtcccggcggctcggcgctcggcccgggcgagagctgctcactgtccaaggccaagcggcaggctttgtccatgtgtgcactaa

SEQ ID NO: 652218 - DNA, 116 bp, Homo sapiens
tacgtgtgtactcatgacttctgatggaatttgggttagtaccccgtttgtagactaatgtgtaggttgctgtagtgcgaagactcgtgtaacgtcagacagacatgtatttcttg

SEQ ID NO: 652219 - DNA, 122 bp, Homo sapiens
aagccctcatcagtgtctcagtagctgggactgcaggcatatcgccactgtgatcagctaatatttttattttttgtagagatgagggtctcgctatgttgcccatgctgctctcgaactct

SEQ ID NO: 652220 - DNA, 181 bp, Homo sapiens
ggcagaggttcagaataagagaagtgagagggattctaatcttagcctcttcataccccaacttaaggagtatgggccagaaggattggggcagatggtgccatcaatagctgtaaagtaagtgaagagtaaggctctttttaagatattggtgatggcagtgaaggttgaagttgagcgg

SEQ ID NO: 652221 - DNA, 572 bp, Homo sapiens
  misc_feature (72)..(72): n is a, c, g, or t
  misc_feature (285)..(285): n is a, c, g, or t
  misc_feature (433)..(433): n is a, c, g, or t
tttcccggaggggggccgggcggggaggggattagcaactcttccctagacatcggcttccgcgaacggggntagggtggaggtcactttacctaggtcctacccaagggggcgggtttggccatcaagggggggttcattcctggatttcccctattttcggggtacaccctagaccaaacctcgggcaaaatccatttcactatcaaatttatgggggggaatttaactttttttccccaacactttttggggctatccgggagggcccgggggtattggggntaccccgagggataccccccatgaaacatccttttattgggggggtcattcatttttttaacagcgggaatattaataattttcatggtttggggggccttgggtttgaaggggaaagtcctaataggagaaggaccctccataaacntgggggggttataggggggcccccccccctcccccccatttggaggaccggggtacataaaattttggcaaaaaagggggggatgggccccccccaaggggggttcaagcccccccccggggccccatggcttttttca

SEQ ID NO: 652222 - DNA, 740 bp, Homo sapiens
ggtctagctggtgtttttctaacacaatggttttcttcatagaagattaatgtattatttcagttatcacatatgaaaatcatttagtacctaaaggcgtaaacttccaggaatattatacttcttgagtgcagagtattatacttctattgtactagtattctctctcgatgccagtattttataagtggtactgtgttgataatctgattgatctgctcatacggattgtgaagcaaggtaataccttttgaaagttgcctgtttgatttatatatggctatgagattgggaagccaacatccgtttgacacaatatatgtcaaaatgtgtatcctacagacgcatacaatggaacgtgtcaagccttgttttacatttgttcagaaacgatataaacacagtctgacgtgtctcttatatgaaacatgaaaactgtggcaacatagcccccaaaaaggttcctagagtaaagtaagcagaaaatgcttcagtgacctgggcgagcaattcctattatagatgtaccaacaaaaacagtttccgttatatctactaagaaatattgtcagtgtctggagtatgggttgatttaaattgcataagcttttgaagtcctaacacagaataatgcatattatattaattctaaccaaataattttgtgcgaagactttaggggttgtaaagaatattggatatagtataacggggcattattacattggtgaaattgagtg

SEQ ID NO: 652223 - DNA, 782 bp, Homo sapiens
agcgaggcaatttaatttcaagggtatgtgccaccacacccagcaaattttttttggtattttttgcagagatggggtttgccatgtttcccaggctggtctcaaactcctgggctcaagcgatccacctgcctgggcctcccaaactgctagtattacagatgtgagccactgcacctggccgtgtctcattttaatgtctctctggacctgataattaaaaagacttgcatttctcagataaaagtgattttctttttctcaaaaggatatgaacagagagaaaagaaaatgcatatggatcttcaaagatgaaatgatgttcagtctcactcataataagtaatttcacacaaactacaatgggatataatttttcacccactagaccaacaaatacttcaaaatttgataacacattgtattactgaggatacagggaaacaaggacaatcacaaattacttgtgggagtctaaatcgtttgtaacccttacagggcacaatttgacaacatctaggaaaattttgcatgcaaataccctttgaaccaacaattctcttttaggaattcatttatatttatagatatgtgacatgatgtgtgcacaagtctcttcatggtgacactgtaacagcaagacgagataagctaaacagtagtcaacagggggattgcttaataaataacagtacagccacacaaagacatattctgtagctcctaaacatgactacagaagctctttatgaacagacatggattcatctccactgctatgg

SEQ ID NO: 652224 - DNA, 354 bp, Homo sapiens
tgcggaccacctgaggattatgtaagaaaagggtaagcggtataataggaatgtcgtcagacggtttgaaaacagttacctgagaatttgtattccgttgacccagcaatcccactttgaaaatctgtcccaaggaaaaaaattagaaatacagttaaagccgccggggcacagtggctcacgcctataatcccagcacttggggaggccgaagcgggcagtgcgggttgagtgcgggagtttgagaccagccagagcaacatagcgagaccctgtctctacacaaaatacaaatggtttgctgggcatggtggtgtgcaccagtagtcccagctatctgggaggccaaggcgg

SEQ ID NO: 652225 - DNA, 210 bp, Homo sapiens
gatattcggtagtgtcagcacggtgctcacgatgctcgacggaatcttgtacaggaaggcatgcaccgcagtggtgagagtacacgtcgaccaggctccatcttaacgatatttggaggtcagcacggtgctcacgtgtcgacggaactatgtccagggaggcatgcaccgcagtggtgaatacacgtcgacctgcagggatagcatgca

SEQ ID NO: 652226 - DNA, 1966 bp, Homo sapiens
atcaaacgtctctcttcgtctgatacgtttttaatctacagcatagtcccacatactacctatctttaggcccgctacaaaggcagaatggcaatcaataagtacatacataatcacgatctcgtctatatcctatcaaccatccatcatacaatctgatctctcttgacgcgcaggtagtgagtactcttcattgcctatacctaagaacatatagtgcgtgcattaagatctgggcgaggcgcgtgtagacggacagacatacatagcctatgagtcccctaatctatgggcatgtccggcgaaagtagagtctgaccccagttcatcggttacacactttagaggctgtaagatcccggttgaacacaacgagaggtggaccgccaagtatccggcgacttacgtgggtcacccgcacacagtggggacaccctagagaggacgccgaaaccgcaaatcatgttacacaacgtgggagcctgtgagcccgaaagagcggcgcgcgcaagagcgagagtgtgcgagagacgaggcgagcccagctgagtgcagtcaaacaccacaaggaggagccgcccaaaataagaaaaacgattcggcaacgcaacgaggcgggaacggacgaagcacaacaacaacaaccagagcgccattaacacccgagcgacgaggacgccgcgggtgacatcaccacgaagtacgcggacccactacaattacacccagcacgcgacagcgcggcgccgcccgcaccacagaagcacaccccacacacacaccacaggcaccgtcgagaacagcgcacccggcgagacaaaacacaaacgtatgagccgcagccgcagagcagccggaggccagcacgatcaacccttcgacacagcactattagggaccgtcccgcaaaggccgattcgcaccaaacgacatcggggcgatcgcagtaggacaacgacaccacccactacaccgagcgcaactatagggcagaccgaccaaactcaaggacgcccatactctccgctacacaagaccgcccgaggggacagacgggacacacgagcgccccacagtatgagaaagtcatagcgggcaccaaaccgatgcgagagcagaaagacaaacaaggaacacacacgaccagcatatccaagagcctccaaaccacgtacagagaggaagaccgcaacgagtagacggagcataacacgcggacagaaacgtacacaccggcacgcacaacacgatgacatatacaccatctataaacgcgccccgcacgcgaaaatacacagagcacacgtacccagacgagaacgtagcgcgaccaaaccacatcaagcgacgggtacgcgccagaagaatggtggaccgaaccccatacagagacgaggaacgagtacccatgagacaacgagagtcaacataggcgcggcccactgccccaaaactacaacagcgtatcgagcagcgcccaaactaccaccacgctaggaaagcaaagacgacgggagctagatgtagacaatccacacccggacaaataaagcaaaaatacgttgcaccacagacgagatccgacaaacgcaaggcgagcgcccctccatccggcaaggcgctcagacacgaaccgccccgtcagacgacgccccccagacgcaagcagaaagtaactagccagctagaacatcacagcacaacaacaatagatgagctagaacgatataccacacaatccaggagacgtaacgcgcagaccaaacaacacgagtatggaacaaaagtatagcagagacgaagcacgccgaacggcaaggacatgtgcacatcgacgagcactagacgacagacacacaaaacgaacacgggcgagaacagacatgagcagcagcgtgcggagaacgcacacatacagaggcgccaggaggatagcaacgtcgaccggcgccaacgacacatgcgg

SEQ ID NO: 652227 - DNA, 219 bp, Homo sapiens
cacgaggacgactgccatgactaattctctaataattagaagttctgacattacccactcaaactcatgaaacaaccaaacagtgccgtgtctatatatagccacaggaaggatgtttattctatgcaacacaacaaatgacctgagataagttgggattcttgtatcaccacataatcacatttacattgcaggatggtacatgccaaccaccagtta

SEQ ID NO: 652228 - DNA, 194 bp, Homo sapiens
tttatttccaatctattgctttattgcatatcaatgctcgatctattgataatctgcctgatctcatactgaattgatcattataaatttgcacttttccgtttttctcatttctgtaatatgatttaatagatgttataccgctaacattttcattcaattatcttttataacttatcatctgcgtcatatca

SEQ ID NO: 652229 - DNA, 826 bp, Homo sapiens
  misc_feature (195)..(195): n is a, c, g, or t
  misc_feature (229)..(229): n is a, c, g, or t
  misc_feature (612)..(613): n is a, c, g, or t
ctcctgctaattaaaaaaaattttttttgtttttttagagacggggttctcactatgttgcccaggctggtctcaaactcctggacttaacctatcctcccgccctggacttcaaagtgctgagagtacagagtgtgagctgccacacctgacctcttgttggttagtctttccaaagttttttccatgtgattnacaggggcaaggtccatgcttaagagtgagctgncccagatttcccatggctgtcacagttttaacactcaaagtcccatgttcagggaaactcctcagtcctgggcaaaactaagactggttatcctacttcagggaagcaccatcctacctcaggggagtggctccatgaggagagtcctggcagaattcagtgatcaacagtaaacaccataatgagttcttgagtcttaacatcaatatgaggaacatcaggggtacagcccaggatgatcttcacttctgctggccttgtttcttttttacagtttttcctctagtgtgaggagattcccgcaaggttgatggtttcaactcctgatctcttgtgatccactcttcagtctaaataaacatttccataagaacatgcagttnnaaaacaaaaaaacaaaataaacaaaaaacttattcccccaaacaacaaaatgggcgttctccctcacaaggtccttgatgtcattttgacccgggggggccgctttgccccaggcgtttttatcctcgcaaaggtttttctgccgcccgatttgggggccctctggccaattcgcctcatggggggtggtttcacattaactggcgcggggtt

SEQ ID NO: 652230 - DNA, 849 bp, Homo sapiens
  misc_feature (195)..(195): n is a, c, g, or t
  misc_feature (229)..(229): n is a, c, g, or t
  misc_feature (797)..(797): n is a, c, g, or t
ctcctgctaattaaaaaaaattttttttgtttttttagagacggggttctcactatgttgcccaggctggtctcaaactcctggacttaacctatcctcccgccctggacttcaaagtgctgagagtacagagtgtgagctgccacacctgacctcttgttggttagtctttccaaagttttttccatgtgattnacaggggcaaggtccatgcttaagagtgagctgncccagatttcccatggctgtcacagttttaacactcaaagtcccatgttcagggaaactcctcagtcctgggcaaaactaagactggttatcctacttcagggaagcaccatcctacctcaggggagtggctccatgaggagagtcctggcagaattcagtgatcaacagtaaacaccataatgagttcttgagtcttaacatcaatatgaggaacatcaggggtacagcccaggatgatcttcacttctgctggccttgtttcttttttacagtttttcctctagtgtgaggagattcccgcaaggttgatggtttcaactcctgatctcttgtgatccactcttcagtctaaataaacatttccataagaacatgcagtagtttgctgtcaaactgaagcttaaatccatatatatacatacatatttgaaaagaacagttctctaaaggaaatttatctgtaaaggtgcaactctgcccatagaataagccaccctttccatggtctcacaaagcagtctagactcagcgttgcaaatattttcattttcagatgatggattttngataaatctttgccgaacttttcaggtgttttactcaaaagtctccaggctt

SEQ ID NO: 652231 - DNA, 273 bp, Homo sapiens
ctaccagtatcccttattgtatagtctaacaaggatttactgctaactgaacactctgccacatcaattacatgtgtaagatttctttccggcatgaaatcactgatgacgtacaagatatgacttgtcgcgaaagagtttagacacatacattacatatgaaatgtcactctccagtgtggatcgcatgatgattagtgaggcttgaacgcatactaccagctttgccccattcattacatttgaaagatttactactctattcttacttcc

SEQ ID NO: 652232 - DNA, 417 bp, Homo sapiens
ccactgcactccagcctgggcgacagagcgagactctgtctcaaaaaaaaacattccacataatttccttttaacaattttaacaactagttgcgcttttcaacgatctatggtattttatagttggtggtggtggttggtttggttttggccaagagtgggggtgcttgccatgtggcccaggctgttcttgaactcctgacctctcttggtatatgtctatttatttttaagtaactttggggaatccttggctttggtcggggaaatttaagttagtatgaactacggttattattggcaaaatagataacaaagtaagccgaatattaaaaggagaggtcacctttagtgatgtgaccgtattggaggtagctgcaatagaatggaaccctcaatagagagcacatttcagaa

SEQ ID NO: 652233 - DNA, 351 bp, Homo sapiens
tccccgttgggttttataacaccttaatcttaaggggtagaaaagccccttttacaagaacactaatcccatttatgaggaccttgcccatacgacctaatcacctcctaaaggccccgcctcctcatgccttggggtgttagggtttcaatacgggagctttcgcgggtcgcaaacattcagaccacagcggtctatcgtggggatactgctgaggaggtaactgctttgagcgtcttgctcggcgagagctgcaggtagttctggatgtggtgggtctgcctagaaggagctttttgtgtggtttgttggtaactttctaatgaatggaattaacattattggtttatt

SEQ ID NO: 652234 - DNA, 161 bp, Homo sapiens
  misc_feature (66)..(67): n is a, c, g, or t
gagattttcacatgggaaaatcatggagagattgtttacataaatccacagttcaaggcagaaagnngattggaaagaggagttagaattgaattcttgcttacgttttataagtgtttcaattaattggcctcactttgccctttagatggactcctgct

SEQ ID NO: 652235 - DNA, 126 bp, Homo sapiens
gaatcatcagactgacggggctgtaacagggctctcagggtgggagagacctcagcagcttcccacctagtgctggggtcacgccttagcccacccaggaactccaccctgacccacacagcaggc

SEQ ID NO: 652236 - DNA, 447 bp, Homo sapiens
gtaagttacataagaaagtagctcaagttcccataggccccacccctgtcactctgctttccttctcccagcccacacccatggcctcgtggggagttccctatgagcagttgacagaggaagagacctggtttacaggtggttctgcattcggtatggaggtgtgatgattaatactgagtgtcaacttgattggattgaagggggcaaaatattgttcctgggtgtgtctgtgagggtgttgtcaaaggagattaacatttgagtgattggattgggagaggtagattcaccctcaatctgggtgggtaccatcctagctagcacagctaggaaaaaagcaggtagaggaacgtggaaagactagactggcctgagtcttctggcctccatctttctcccatgctgggtgtttcctgcccataaacatcagactccaagttgttc

SEQ ID NO: 652237 - DNA, 409 bp, Homo sapiens
tcgggaggatcccgagagcatcgcctaaccagagctccccgttagagaacagcagtccggccacattgatggtgggagtataaatgggttacgttataccccagggtcacctgtagtgggcctcgggtactggacaagggttactggctgtgactggcccggaggcaggcgggccatcctttagctaccaaattcagctcctggcttaggtaacctacaggttgctggggctggacctggggcctgagtgggaactcccggggccattcctttcctttctgatacataaagatggaatgtcttccctatgggaagactaagggctggtgcctcaagcaaggctggtttcagtgggtcaaaggtccttttagcctcgggttcccaaattagggagtgagtcttagtggcc

SEQ ID NO: 652238 - DNA, 559 bp, Homo sapiens
  misc_feature (11)..(11): n is a, c, g, or t
ggaaggccccntaatttcaaaacccacttaggaattattggaagaacagtagagacgggtgacatattttgtggaatcggaaacccaccttcccacgggtttactttgcttgggaaagttgtggctgaagacaggcaaacagctttttttttcctggttcaaacaagagggagtacccgaaattttcccctatggactgcgtacgtgcctgaagcactggaaataggtgctatcgtgcggtcattatcagggaggggaagtggtttaataaagtagagaaaaaggacatttgagcttgaggtgggttcagagagtagtcaatcccgggacgcgatttttgttggtgggaaactggtagtgcttagagagcgaaatgggcctgctagcaaaaagccttatttgtcattgggagagcctgaaggttgcaaccaagagcgtctggcaagccaagggcccgggaaaaggccgcttttccggaaaaacaagaccccgggataaagcccattttgctacgggccttgacccgtagatataaatgtgtctaacaccaaagacagcg

SEQ ID NO: 652239 - DNA, 688 bp, Homo sapiens
ttactgcacgagctgagttttccctttctgttatcaaaacaggagcataccagagatgcctatgagaagattaagcaatgggtggaaattggtaggtaatatcggtcggattcgtgtgtcgggatttagaggtgttactaaagacccgtggtaacagggcaagtttgtctacgatcccttgtaagagcccgttagaacgatgggtatctaatgttctttgagatgacagtctaatgcacctacagatggcccccaacagttcgtcattccatttgcttctagtcaacattaatgggccgggtacagaaactagttcgtgtcttagtatactatttccttgtgatgtcctataagtcggaaaagaaaggggcacagagaacctattatttgccagtttttaagcagagctcaatctatgccacctctctggcatctgcggttcctgactgataccagcagcttgaacgaagagagtgcatggccaccctggtgtgtaacgacacaatcagcacaaactagtgagaggcagtaaagaacctagggaaggtagtttgatttttcattgaattctacaagctaagctgttccacgtatgtagtccctagaccgatagctgtaactatcagctgcaatacgcatgggaccagctgtacaaaagatttgttttaccccatggacatactgaact

SEQ ID NO: 652240 - DNA, 116 bp, Homo sapiens
tctgcaggatccccttatcttccgtccccttggctcctcagccccgccattctcactctgtcctgatcctgcggttcctctcgttcactcgagccgtgattaccagttcgcccacc

SEQ ID NO: 652241 - DNA, 486 bp, Homo sapiens
  misc_feature (241)..(241): n is a, c, g, or t
tgtaggcacagcagtcagaagaacagactgtctcagtgtactctatctgtggcgctcttgttgcattaatcggccagtcttgcatgctctcgggtcgatactgctcagtgaggttctgtgtgctgtcttggatgcggtgacggtggagaaggtggtgatacaaactctcgcgtccatcggcagttggtctgagcgcgcaacggcaaagcacatggagaactcccaagttgcttctaacatntatttgtttgtgtattttttttacctcctggatttcctccacaaaggattgaaggtggagttttcaaataaacccgtgtcagtctaagcccatctagagaggcatcagccgctagccaggctgttcagcacgtgaacggagccccccttgtatgaagagacccctgctaggagttacgggaagtgacacaagaaggcagcggggcttggaggaactgtcacgctaattgagggcaagggaaaagc

SEQ ID NO: 652242 - DNA, 135 bp, Homo sapiens
tcgatgttcacagaaagttatctgttctcagacataggtcccttgggttcctgcgttgcaaggcagagcaaggcattagtgggaaggtcgaagaggtttctctaaggattgaccagtccaaagaaggtccacatt

SEQ ID NO: 652243 - DNA, 190 bp, Homo sapiens
  misc_feature (40)..(40): n is a, c, g, or t
  misc_feature (60)..(60): n is a, c, g, or t
  misc_feature (82)..(82): n is a, c, g, or t
  misc_feature (150)..(150): n is a, c, g, or t
  misc_feature (156)..(156): n is a, c, g, or t
attctgtggctgtgctgcttcgtgtctcactcgagagttncttctggtttcacacttttnaacccctctgtgctttagcagncgtgaccttgccttcattgcttcatccagtgcaggacctgggttattgaagacaccaaagtgtttctnttccanattgaaaaccaggcaggtttacacgtgggtttca

SEQ ID NO: 652244 - DNA, 916 bp, Homo sapiens
gtggaaagctccctcgtgtgtgcacgtagtcagagtatggtgggtgcagctcagggtgggccacactaggcgttgtcgcaccacaaaggaaccgggggcggagagcgacaggtgggtgccgtacaccaatttgcctgcgtgccagttgcccgccgggcccgctccatggcttttttttgcgggggtgtttcaccacccgggcctctatggggtgaaacgcgcccgcaccgcctgcaaagggggtcagaaggggtttgacccactctaactgcggggaaccatgtaatgaattgcttcggacaaaccctccccgttttatacccggcgccaattgctgtcaagactcactgcttaaaaacagatccaagctggaataattgtgcaaaaccccagccccaatgggcgactgtggtccccccccccgcactctgttagcctcgaacccccctctctccccctgtgttgcaattgcccccccaccaacagagacgttgtggcccccccctctttcaggatacatctctgctgtgaacgcatcttcgcctttatgtgcacaggccgtccatcctcaagagctatcttcatctccccaacaagctcaatttgggcggaaaagacacagccacatcttacgaacagatctttttgattgataattcccctgcaacaattattaaaaaagtaaggatgcttctacttaagatcactgtcgcacctgccaggcaactcttgggagacaagcccagcagccccaccaccactgtcctgctctcatatacccccctcgcttcatgtgggaagcccccctcctgtaatgggcggagaatgcaaaagcacgcagctattgaaactatttcttcaacgccctctcttgaaaaaaaaaattgaaaaaccccccaaaaacaaaacacaaaac

SEQ ID NO: 652245 - DNA, 248 bp, Homo sapiens
tgagagacgtgtagcatggagagatacaaaggcatctaggcccccttccccttagcttacaagtcaccatgaccaaagtacaaagaggttacaaaacaggaaaagcaaatataaccagacaggatagacgtggctctcctttgtacatgcggctttacagaggcatctggaagctctcattcacacagcgctcagagcatcctctttcacaagcgcaatttcatcttactataacaatcagttttaca

SEQ ID NO: 652246 - DNA, 926 bp, Homo sapiens
  misc_feature (4)..(4): n is a, c, g, or t
  misc_feature (101)..(101): n is a, c, g, or t
  misc_feature (298)..(298): n is a, c, g, or t
  misc_feature (353)..(353): n is a, c, g, or t
  misc_feature (493)..(493): n is a, c, g, or t
  misc_feature (862)..(862): n is a, c, g, or t
  misc_feature (926)..(926): n is a, c, g, or t
tatnaaatgtgcattttaattatacggctaacacaacttaaaaacctaattttatttttgctcttccttattcctcctcttcttcctcctcacctaaatcntcctcctcttcttctgtttcatccttttacttcttatactcatatacgatgtctttcatttttctctcagcctcggtgaactccatctcgtccattccctcgcctttttaccattttatgaagtccttcctgcggaacattgcatttaacttctcctatattctctttaagatctcctttatttcttttctatttcnaattaattttacttccatctttatgccactattttggatttcacatactgctttntttacatttttttgtatccattccacaaattatcttcttttctttttcttcactttaatcatcttctcatctacctccttcattgacatcctaccacggaagacatcagccacggtgaggtatcggccgttgcggggttnacaggcatccatcattttcttttcatctaagaccttctggtttatttccgtcacttttatatctcgatacttcttgcttccactgctgtttatatgggcaaagccagtcataaataaattgagacgtgggaaggggaccatgttgactgccaacttgcggaggtcagcattgagctggccagggaaacggaggcaggtggtgacaccactcatggtggctgagacaaggtggttcagatccccgtagtttggtgtggtcagcttcagagtgcggaacagatatcatagagggcctcgttgtcaatgcaataggtctcatcagtattctctaccaactgatggacggagagggtggcattgtagggctcnaccacggtgtcagacactttgggtgaaggcacacactgaaggtattatgatgcgatcaggtatn

SEQ ID NO: 652247 - DNA, 502 bp, Homo sapiens
  misc_feature (152)..(152): n is a, c, g, or t
  misc_feature (306)..(306): n is a, c, g, or t
  misc_feature (352)..(352): n is a, c, g, or t
  misc_feature (364)..(364): n is a, c, g, or t
  misc_feature (401)..(401): n is a, c, g, or t
  misc_feature (455)..(455): n is a, c, g, or t
  misc_feature (466)..(466): n is a, c, g, or t
  misc_feature (487)..(487): n is a, c, g, or t
  misc_feature (501)..(501): n is a, c, g, or t
aagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaanatggtctcagaacgggagcggctccaggcagaactggaccacttacgaaagtgccttgcttgcctgcaatgcactgcctaggggctacctgaagggatatcccaggtgacggtttccttgcctaggccgacctatagtatagaaatattatctnatttaataccttggatattaatattttcacttgggaggtttgaacntaccaaaatganaatgtgccatgcatgaagcaaaggatttcaggctcanaatgaatgacttaccttgccgtcaatgcaattgaataaccgttggcaattcagngagcaacctgnagggattggccccggttttcnttttggggggtttng

SEQ ID NO: 652248 - DNA, 1089 bp, Homo sapiens
cgtgctctgcgttcttcattttcttggtgtgggaggccgcgttttcctcgtttgatattgtgcctgagatgtctgccttctctaggttgtcctcctttctggtcatctaagcagtctcgcgtgttttcgactcttttttctcccctcctctcctctcaggcccaatggggcccagaacccccgggtttatattttagggccccctcctcgtctctctccttctcccccgcccgtgtttgccatggggggccgctcatgtccttggggcgccccgattgtttcccccccccccttcccaaatgccagaattttctggaggatcctgatgctttgggaatatgttaatttcagggcacctgatgcgtatcatactgctattatatggtttccgaccaaatcctaaagaaaggaaggggctcaccattcccttaattaaggagaaattctggcatagacccgcccttaatgcccccccttaagaacgatccagcaccagatctggaatgtgaagccttatagaagataactggcctcactttcttccaaatatcccagtgttgggaaagaaaaaaggaaatggaatgggtaactctctttcttgatttaaagcttatgtaataaccccaatgcccatgtgaaatattttacctggacctttatttttgaaaacacccatctctgtaaaagacctggggtgggggtgggaggcccacgccccggtggtgaggcgccacgttgagaaaaatttgaaatttggaattatgaattttgaatgaaatttggataaattattggtaattttatgagcctgtgagaagggtgtttgttaggtttattataaagacctgttctttaaattgtgccaataccttatacgccaatttatggaaatgaaagtgttttaggagttgtctctttaaaattagttctccaaatggtgttacaccaaatagtatagtgaggcgtatagtggccaaaatagttcaccagaatctaactggtggacctaggctgttccattgtgactgttttttttcttatcttctatatgtttaaaagtatataattaaaatatttaattttttttta

SEQ ID NO: 652249 - DNA, 139 bp, Homo sapiens
tgtgttgggtagaagtgagggtataatgacttgtaggttgattgtagatatgggctgtatagtcagtcagtgtttaatctgagcaggttatgcggaggagactgtttcatgtaacttatactaagattagttctactat

SEQ ID NO: 652250 - DNA, 459 bp, Homo sapiens
ctgtggtttaggtatcagaataataatggcttcataaaatgagttgggtagagtaccttctacttctatcttgtgaaaaggtttgtgcagaactggaattaggtcttctttgaaggtctgatagaactctgcactaaacctgtctggtcctgggctttttttggctgggagactattaataactgctactatttctttaggggatatgggactgtttagaaggtcaacttgatcctgattcaactttggtacctggtatctgtccagaaatttgtccattcgtccatgttttcaagttttgttgagtatagccttttgtagaaggatctgatggtgctttggatttcttcaggatctgttgttatgtctcccttttcatttctgattttgttaattaggattttgtccctgtgccctctagtgagtctagctaagggtttatctatctcgtgtcgacgc

SEQ ID NO: 652251 - DNA, 318 bp, Homo sapiens
gtgcctagcggtcccggcgctgcgtgtcctatgcgtgcctttggcggcggctctggccgtctcgttggcggtcagcgcgcggcatcacagtgcttgttttctgggccagtcatcaggcgccggggcccgtggtgtcattgcgcattgcggcagcacagtggcacagtgcgctcacatcgggtggccgtgctcggctcgggcactggcccgtccattgccccctgcaggtcgggcatgtctcgtggcacaccagcaggccatccatcaggccacgcgtgcgtccgagggtcaccgcagcctcgacacattcgtcacatc

SEQ ID NO: 652252 - DNA, 149 bp, Homo sapiens
  misc_feature (29)..(29): n is a, c, g, or t
  misc_feature (64)..(64): n is a, c, g, or t
  misc_feature (123)..(123): n is a, c, g, or t
  misc_feature (139)..(139): n is a, c, g, or t
gggaagagaggatttagaggtggtcttcntgggcgactcctcggaagggttttatggaaagagntctaggagtgccgggcagctccggggtttgtttgcttaaagacagaggaatgatggtanttgtgtgatgatgggnaagagcccca

SEQ ID NO: 652253 - DNA, 731 bp, Homo sapiens
  misc_feature (507)..(507): n is a, c, g, or t
tacgcttaacagtgcatctctaccccaacagattaatggggattggagtgatataaggctgattgattgtacccttttgaccatcaggaccagtgcaagtcaagataaatgtgctctcataaacttcctcagctttttcaacacctagtagttccgtgttagtgggatttttaagccaggaggaaggccataagctggaggaaataaaaaaaacatcagccccagtatctactaggccttcaaacttttttccttgaatgtgtatggtgcaggtgggccatggtttagaaattatattaatctaataagcagccttttcaccactggagccaatcccagggtcacgtgtctcatctgctttgtttaaaatgatattaggtagtaaaagcaattaagcaactgcctcactggcccgaatggaaacaggaaccttggcacaggtgattaatttaatctcattactggaatcagaattaatgagaccagtatgaattgtgattcctttancagaggtagatgccctacctaaaaccaggcccaccaaaccttgaggtaaagggcgagtgacccctgtggggacaattaacggcaaagagttaggtagtaaacttagaagaatactactacagatatcaagcggccagcctctagcatggaggtgggcagcatgtactgggcaaagaagagtggaccatttggttggtgaagtgattgttggctgggttgctgca

SEQ ID NO: 652254 - DNA, 263 bp, Homo sapiens
  misc_feature (17)..(17): n is a, c, g, or t
  misc_feature (46)..(46): n is a, c, g, or t
  misc_feature (49)..(49): n is a, c, g, or t
  misc_feature (69)..(69): n is a, c, g, or t
  misc_feature (95)..(95): n is a, c, g, or t
  misc_feature (97)..(99): n is a, c, g, or t
  misc_feature (105)..(105): n is a, c, g, or t
  misc_feature (121)..(121): n is a, c, g, or t
  misc_feature (123)..(123): n is a, c, g, or t
  misc_feature (145)..(146): n is a, c, g, or t
  misc_feature (153)..(153): n is a, c, g, or t
  misc_feature (161)..(161): n is a, c, g, or t
  misc_feature (222)..(222): n is a, c, g, or t
  misc_feature (224)..(225): n is a, c, g, or t
  misc_feature (227)..(227): n is a, c, g, or t
  misc_feature (235)..(235): n is a, c, g, or t
  misc_feature (246)..(246): n is a, c, g, or t
aaacgcttaaagctggnccttgacattctgctttcagatgctgtcnttntattagtgagtgatgatggnttgctaataatcaataggtaataccntnnngtaatnccatcaagtggctccntntccttctgctctctcgtgactnngttaatntttaactnttgtaccttaaagccgaaatcagtaactatgcatactgtaaccaaggttttgggtttaaananntntttttttntataaagaacntttaactcttgttgaaa

SEQ ID NO: 652255 - DNA, 1511 bp, Homo sapiens
  misc_feature (403)..(403): n is a, c, g, or t
  misc_feature (427)..(427): n is a, c, g, or t
  misc_feature (746)..(746): n is a, c, g, or t
ggacaacgcaggatctgtcgggaagatcagaacgccagtcatggatgagccatgccgcgaccttatcgtccatagcaatagagcaagcatgcccatgactggtgccggcgccctggggccccgagagagccaagtgcagccggggatccctgatagcacatgcttttccatcctggtgacatctgctcctcggcatgagtcgcaggccactcatctgcacgtatcttcctggtaccaagcagcagtggctcgtgattgggacggaatcgtgacatggtcatcctcccaaatacactgcgatgtctggcagaaagccctgtgggcaattgaacgacattcacgcataagctctaccctagagtctcatagggtgtagggcaacgaattgactgtcacttggacnccaaccaccgacatgacgtcgaanttgacgaagaggcagacgtgaccacaatgtggtaagcccctgggcgccagaggagacgcacagtgccaggatagttgccacgcgagggatgatgggcaaacgatagaacaagaagcgaacctgatgctgtattggcagaccatggcatctctagacagactggctggaacccaacccctgtgagagtggtgagtacaccaggccaaacattgaacagagcggggggaggctgtgtctccagtgtgacgaacaaccgtgagagtacgacactttctcaaaatcagacgacctgagtgtgtgagtacacctattatgccancgtgggcaccagttgctcctcttggtgtacaggagctgtgcggaatttcccaccctatatttgtggcatctccaatggcctatattgggagagattgcaggcccaagggcccactgtcccattggggtcagtacgaattcacaaggcccgacacattggaaaccggctgtccacaccccggatgaatcggaagctcatccttgggaaaacgtgggaaaggaaacgcccgatactattccttgggggggcttcgtgtggttgttgtaaacccgacatggccatgggggatcctgcggtgggtcccccagggtatccccccactaattggttgaatggaagcccaaggggctaagacaagaggcgaagtccctatccagaccaatttcactttgggggccgaagttctcgcgcaaactagcgtatgccttagcaagtcttttttacagttagggctgtgcgccgttcttcaaagggaacctcccgccaaaggacgcctttcgaacacaccacagggtcataccacctagccctactatgagtgtaaaccttttagggtctcccccataaatgaaagagatgcgcgggtttgagaaaaagatcgccgttggagccttctgtttttgcaggggtataacgccccttgtgtggacactataaagcaaccaaataacgccttagggagtctgtgtgagatatcacacgagagcttaattatcccccatattgtggacacgccaaaaagcgggcccatgagtatgaggcgca

SEQ ID NO: 652256 - DNA, 148 bp, Homo sapiens
gaggtgctctagaggatctccgcctataatcctagcatttgggaggcaaggcgggccatcacctgagatggggagttcctgaccaacatggagaaactccatctccactgaaaatacaaaattagcagggcatggtggtgcatgcctg

SEQ ID NO: 652257 - DNA, 295 bp, Homo sapiens
  misc_feature (124)..(125): n is a, c, g, or t
cctccgtaacgaccataacgagccctccgtaacagcgcctccataacaccctccgtaacacgcctccgtaacacgcctccgtacaccctccgtaacacccaccaccaccaccactgacgggcgnnctcgttacccgtaacgagccccagtggtggtggtggtggtcatgctagctgataggggctcgttacggaggcgctcgttacggaggcgctgttacggaggcgctcgttacggaggcgctcgttacggagggtcttacaggaggcgctcgattacaggaggcgctcagtta

SEQ ID NO: 652258 - DNA, 154 bp, Homo sapiens
cacaaggtctactatcaaaactatttaaaattactgttagcaggactctattaccacctcagatgatctagtcatcttttaggttcttgaactcaattgtgatttatgttgtcaaagaaaattattgggcaggtctggatcagcggcgtgtgca

SEQ ID NO: 652259 - DNA, 1367 bp, Homo sapiens
ggagagaactagtctcgaggtatatctaggttattttttaaaaacgggtttcctgaaattaatattattttttaaaccataccacgaggaaggtgtaaaaaacctggtgtaataccccaataaaataagtttcccagaattccgggagggatgaagagggagatattcagaacccttacaccagattccccccaacttgatcatagtggataagggtgtgctattgtggcatgctggttagtcaatgacaccagtcttgacggatcttcctttctgcaccaaaccccatttgagtaatcgggctccccttgtgtgctgacagaaaaaccattaggcgatggagccacttggcatcaatccaagagtgaaattctatacacagcgattgaccacccgactcaggctcgaggcagctgccaacggcctttggtggcccctcaacaagatctcagcacaaaccatatcacaggtcgccgctatgacctttgccacagtgagcctgctagatataagaaaaatccactggaagacatctcaccacctacatactacctgtagcccttgtaagcctctcaatgcgccatacctgagaacctttctttagcactatgtggacacaataccgacgctccgtatgccatatcactccctatactgtccaacatcacgtatacattagaaacgccaacatcgtgagtccattatccaacacacatttcccagtgtgttgggccccatgcgcccagtgggtttgtgtaattgtgatataacggccactaacggttgcgggcgcaatatctgtgcgccccagagaacaacacacactcggcgcacttttgaacatggctgccttcccgccctttttgttgtgtcagcggggcgacaatatcccccacttctttgttgtggcgccaatctccctcagattcggatgcgctccccaagatgtgggcactgacgacccctcgaccggtgtatctattatgtggggcgcctttctcttgtcccagcaagactcttcaaatacagatcccctttttgaggtagctatcagattcttgatgttttggtgaatacacaccacagctcctctatccagggggcggtgaaaaaatcatcactactgtggcccgagaacattcaccaacttgttggtggtacatctaaggataatcctcatcatagtagaagtgcacccacttccccccgtcgccttgtttgtgtatatggtacacaaactattatgatgtaccctatgacacttaatgtatatggccatatagccccatctgctgaacaagacatatagacttccggacagatggttccccccacgtgtccgacggggcgatcaacacaataaacca

SEQ ID NO: 652260 - DNA, 521 bp, Homo sapiens
tatccctatgttatcccaacaccaacagcataggaggagatagttatgccctccagtgctaattataaatggtagtttccacttccttcttacaaggactagccaccgcaccatgtctcgatttaaggcagcaaagggcagggctggctcaggactaagttgtctcctaaaccctttttgagagtatatcaatgacatatgtcctagtttgttccccatcaggaattctaattgctggtatccaacagcattagcaatatcagtgtgtaaaggaaaaacaactggtgatgagggatgggagggagtacagcatctgggcaggaggagcattagaggagctggagccacggatgaaagaaacaagatttgcagaattgacagctccatagtagtaaatgtggagctcagtcttgagggagttaactctcatgaaggagaagtgcaggctgtagtcccagtgacagtgactagcatccactgccatcccactcaggatgagggtaatgtgttgggcgataaca

SEQ ID NO: 652261 - DNA, 1149 bp, Homo sapiens
ggatcgcaatggacagctggaccagagtggcggtgtcgaaaggagatgtagccccgaggtaaagtattaggcaagggtggtgtgagccgcgcgaactccgcagtgcataagccagcgatacccgcgcagtcgtgcagtgtcacgtcgactcatcagcagccgtgtacaacgtacgcacaaactggcaggccgggtttggactcgccactagtgcacaacataccatgatagcgtggtctggtgcaatagcatacaggaagtcattgatcatcgcgaacgggtctcatcccggtgtgtactccctgtcttgagttctcgagtctctcgttgaaacgacagagacaggggtcgtgagcaatagcagtcagtcgcataatgaagatcaaacaactactgcgattggctgcagtgtgaatccgcaatcagttgatgtcaatcgactgaggtcctcggactcaatgatccgcgatcgtcgcagccgtggcttatataaaaggatgcttccactcgaataacatgtcaccttccggaggcaactccgcacagtgaaagataccacttccaccaattgctgagcgaatcaaagcgaagactccttgagttgcgtggtgagttgaacgccggtgagggtgcgtggactcatttcgtaccgcaggatcgaaaatgtcagtcagcagtacttttaatacacgcgaaatggtcggtgtcttgcataacgtggttgccaaggcacgcgcacacagaatgatcttccgcatggattgcatcgccgtcgggcacacccgagggacaaagtgcggcccaatgtacacataaaaccgaatgctcgcccgtgtaaatttactgtagtccacatcccgaagtcctgtcaaacggaagtgcgacccgggctacccaagaacatacagcacatatggcactgcaatgccatgaatgaagggatcattgtaggacgctcgaagcaagacgagaaattctaataaaacatttttatgggcaaaagtcaaacccaaaaaaagaaggctatgacgggtaactcgaactttccgcaatgggaccaggtggaacccgctacttcagacccaagggacgggccccccgggataggtcacattgaacagggttttggggtccaccttacaagggaag

SEQ ID NO: 652262 - DNA, 138 bp, Homo sapiens
ctaaggatccgaatgacgacatgaggttttcgtgtgatgaggtatatgttgtcatgtggtggtgagtgagcccattgtgttgtggtaatatgtaagggagtataggctgtgactagtatgttgagtctgtaagtagga

SEQ ID NO: 652263 - DNA, 1035 bp, Homo sapiens
agctcttgcccttatatgactttaatgtctgtgagtcattcccagcttaaattaacaatgttagtattagtctcacacataagtgccatacattttatcctcatggatgtgatgcactgaaaagttagttgctctctttttttttttttttggtcgggcttatttaattcctgtgagttccgggtaagctaccctaaagtgatttaaaacatttagaatgcttggtgttccctattgggtaatctctcatggacttttctttaagttaaatgagtataaatagtgcatattctgtagactatagggttaacatggtgtggcttcttatacactggtatagatggagctgatgtgaaataagatttggtcccaagtattatctgatagaatacaagatgatccaaaattatatagatatttaaacgctttcactggcttgtcttttttttttaaatggcaacgggctatacggcgggggcctcttttccctacccaaaagtgattggtgttctggaccaagacaggctttgtcatttctgtacagcgttgggttttgtgattccataagatccgggtgggttacgccatcctaagttcttaccaatattgctagaagtaactctaaattcaacgcttcttaaagtgctattattcgttctggcgtgggagaaaccacaaacaacttccgatttgaacggccgttaataatttgaaaatgccccgcgattaccaacggggtggacacgttttttcaccgcgtttaaaatttatacggggggtgtgaacaccggcaccccgtaatatttaacagaggatagagagatagcttgggacattatcacggtggggtttggtaccgacaaatgtctcagcgatagacagttccttatataaaataaagttgacacctattatattgatgaccattgctaatttagatgcgacaggggcactatctggtcaagatcaaaaaagagtaaattggagaatgatcagttgcaccatatccagaataggtctgatacacgattcaga

SEQ ID NO: 652264 - DNA, 604 bp, Homo sapiens
tctgctctccagtcccacaggggctgctgtcagtcaccctacggcctctctgcctaggctttgaaactgattcattgttcttttgctgtatttttctttgtaggtttcagaattctctgtttatttatgataatttgggaaggatcctgggagagtgaaaataaatgaagtgcgcaatctgccaagtttcactggaggctccactgatccttccaccatgctcaaatgcctgcaggaaatctggggaatcatctttcctaccctaagaccctgggacttagcactggccctgaggcccctgacaggcataaactaatcagcaaatgtgcaggaaaaatgcggagctgcaagatcaaagtcagattcccactctccctaaaggcctggattcccctggaaacccacatcctcactgcctggaaggagcgatgaggacccaggggagtggctctgggcatcaacaggtccaggcaggaggcggttccccatgtcccatctttccagcaccgaagggagcctctcaggggagtcttatcaccccccgccccaccatcacagagcagcctgctcctggcctgtatccaaacacccctgggggcggccg

SEQ ID NO: 652265 - DNA, 950 bp, Homo sapiens
gtttctgcttcaagagtgcttggacggaacccggcgtctcgttccccaccccggccggacgcccatagaccagccggctccgtgcacctcttcaccgaaccctcggactgtcccaaggcccccgccggcgggtccagcgaccgacgcatccaccgcgcgccgcacgacgctcgtctccttagtctgccagcctatgacggacctgcgatccaccctctgccagtgtgcagcctagaaacataaccgacccacgtgactcaagagagctctgcctatcaagcccgcacagaatcaaagccgtaggagcctcttcaccgccctccttcacgttgactctagtccatgtcttcactgacctttgaccggcgcatgatgtgggtctatggaaaggaacttttgaccaaatgagttttcttctaacaatctcatcgagcgagagggacacatgctgagaaagctgatgaagctgcagagaccaaacgaggtggtccgaaatcttccttcagtgatatcagatgaaaccctaggaacgtgtgatgactggcgagagcgggctgaattgcgctggactgtgcacttacatttggaatgctgcattgtgactcagtcactactggaggctgctcaaaactggccactgatccaggatgacccccatttgtgtgacttcattgagaacacattacctgaatagacgcaggttgaaaagccatcagagaatttgtgtgaccatggtgacccatgtttgcgcaaagatgggagcgccccgaaatctggcttgggggaaatatccttcttttgatcgaagcccaccctggggacaggtccataattgaaggctaaacctctggggtaatttcccataagccggggggtgacttccctggtcccccaaggccgtgcatgcctttgcgggttcctttaacctttctttagttgtcccaattccc

SEQ ID NO: 652266 - DNA, 1354 bp, Homo sapiens
  misc_feature (95)..(95): n is a, c, g, or t
tgggccttcataaaaactttttttaattttttaaaaaaggcggttttttacattagaaaaatttaaaatttaaatttaaacttgtgtggtacaanattattataaaatatacttattctttaaccacccagtgtggagatgtgttaacgggattcaccaaaaaaaacaaaaaaagaaaaaaaaacaaaaaaaaaagaggagaggaggcggcgccgcacacaatagagatctctctccgcgcggagggggcgccacacacagaacatgcgcgcgcgcgcacaccacacggtgttcagtgtgtgagaacacacacgaggggcgcgcaccccatatatataggaggcgagcgcgcaatatatatataacagcacagggagcgcgagcgtggcgagcgcgcggcgataaaaaaacacagagaaggagagagaagaagagggagacaaacacacagagccttactacgagcggcgagagaaacattctcgtgtgtgaggaagagagaagacacaccctctatactctaggggggggggggggggggagacacacacaaaagggtgggggacacacacacaccacactctctccacagcgcacatatatatataaagagaagaccctctcacagaggaggggcacaaactatatatagaagaacatattcgacgcacgcagcagagtgtatatagaagagggtgtgtggcgacacacaacacagcagagacgcagcaacactactcatagtcggagacgggaggcgccgagcacgacgaagacaaaagactactggggacccaaacaacagagagcgaagcagtatcatctgcgcagactattcgacgaagacgcaaacaccatactcattatcatcatcactacccaacccggacgagggaggaggactacatatcatttgtattatcatccaataacatacaaccacctcgacgaaccagcaccagacgaacaacacagaacacacgacacgacaccacagcaacacacagaactaagcacacgagtcacacggagacgacagaagaaagaccgacggaagaaaacgaaaaacaaagacgtagaaacacaccaagcgccagcaagaagacagacccagtgacgaaaacaaacacaaccggccgagacgacaggcacaaccaaagagaaagaagagaccacgcaagtgaaaaaagaaagaaaggcaaggagagagagacggacgacgagaaaagggagaagagccagcagaggcgacgacgacaccacagcaaacccagaagcaaggcaagaaatagacatcaagaaagaaagaaacaaatacgcacaccgaagacaacgaagacgagacgaccacaca

SEQ ID NO: 652267 - DNA, 656 bp, Homo sapiens
gcctggactctactagataactggagtgtgtgtgttaatccagaaatgcatatgtgaacattaaagatgtgccagaggacgatctactcattttaatggaagccagatagtcagcctctatacacttggagagtgactatgagatccttgacaagatttcctgtgtgcctatcttaaagtgcaacgaacgtacaggccccatgtatgactatttcctgaagtgtaaacgagaatggcgctttcactgtgcttgttagacaactatgtgaaggaagacagaaggcacaggggtgtccaccaagctccttacttcggtgctgaggactatcgggtctgtatggactttacacattattcggacaagactcactcccatggtatctgccctgtggaatgcttcaggctgcttcactaacggaggtgacagatttcgcaggacagtcctgtgaccggatgcttgagcacacagtatcatcaaggcactttgacaggacaccacaggccagacgttctgagtatgccacacgcattcactcacacgctacccgtttttgcctgcgagatcaagaaacaccctctaaatttaccaaaagcgcacgttggcccaagacctggattacgtcgcgaacgtggcagacacaattgcgtgggaacca

SEQ ID NO: 652268 - DNA, 531 bp, Homo sapiens
  misc_feature (456)..(456): n is a, c, g, or t
  misc_feature (493)..(493): n is a, c, g, or t
  misc_feature (524)..(524): n is a, c, g, or t
tagtagagatgagatttcaccatgttggccaggctggtcttcaacttctgatcttagctgatccacctgcctcagcctcccaaagtgctgggattatacgcctgagccaccgcacccagcctcaaatcataaacttttttttgttttttgagacgaagtctcactctgttgcccaggctggagtgaagtgacacaatcttggctcactgcaagctccgcctcccaggttcaagcgattctcctgcctcagcctccccagtagctgggattacaggtgtgcgccactgcgcctggctaattttttgtatttccagtagagatggggtttcaccatgttggccaggctggtcttgaattcctgacctcaggtcatccacccacctcggcctcccaaagtgctgggattacagacatgagccactgtgctcagcctcaaatcataaactttttaaaggnttatccctgaccctctaaattaggttatgtgccttgntatatgctcttttagcacttatcctaattgngattggg

SEQ ID NO: 652269 - DNA, 272 bp, Homo sapiens
agttacaacagctgaattttatttttgttattcttattttttttttttagaaacagagttttgctctgggcacccaggatggattacaatggcatgatctgggctcactgcaacctccgcttcccgggttcaagcgattctcccgcctgggcctcccgagtagctgagaccacaggttgccgacaccacccctggttaacctttagtatctccagcagagacaggttttctccatgtggagcaggctgggctaaaactcctgacctaaggag

SEQ ID NO: 652270 - DNA, 405 bp, Homo sapiens
  misc_feature (405)..(405): n is a, c, g, or t
ggagtttcgatgcttgcgaggtttgcaatgatcgccagagctcgagatcactacacatggatgcacagaatcaacataggaagtggcagatcgttagttgtgatccatcagcattattagggtagacgccatagattagactatgagatagagattgagcctactgtgattctgtgcttagagcagatcaagtgcctaccaggcgacattgaatacacagatcggccttcgagtggaatagacctgctcattggacagcactaagacgggagacctttgatgggactcatgacagcatacctgttaatgtgaataataactatgagcgcagactcatcaatgcacctgcgacatgcaggactgccaagtaatgccagtggcctcatttggagcagatgaaccgtn

SEQ ID NO: 652271 - DNA, 786 bp, Homo sapiens
agacatgagaaggacgacatgcggagcctgaacgaccagctggatctcttacctggacacgtgtgaggagcctggatgaccgaaaatcggagggtggagagcagaatccgggagtcacttggagaagaagggaccccaggtcagagactggagccattactttcacacaatcatcgatgcgaccgtgagggtttcagaattcgttcgtcgagagaatatcgtagtgggatcaactgtcccgtccgtcgcttactgcagcacttgacgaactgtcaccgtcgttgtcgtggctgcatgtacattctcagcagatcaagtactgaggaacagaggcatggaccattggcgacctaggtctgtgagagaacgagcgatccatggggctcccgtccataggatccattcgcactgactaccaaactagtccatcacgcaccttgccacgcgtgggagaactagtagaatccgtaggctcgtcgaaggagcgagctgctcttcgatgaagcaagaaccacgcaagaggaagtaaacaggcctacgaagcaccaagattgctcgagctcttgggtgtttgatctgtggcaggtatgattgcgccccgaaatactcgaggtacctgcgccagagatcatgggagacatccgggtcccaatatgacgagctggttcggaagaaccgagaggagctagactaagtactggtctcatgcagattgatggatgagcaccatagtggtcaccacacagtctgctgaggttggagctgtgaaagaagctcacagagtga

SEQ ID NO: 652272 - DNA, 390 bp, Homo sapiens
  misc_feature (11)..(11): n is a, c, g, or t
  misc_feature (14)..(14): n is a, c, g, or t
  misc_feature (314)..(314): n is a, c, g, or t
  misc_feature (385)..(385): n is a, c, g, or t
gagacggagcngcntctgtcgcccaggttggagtgtagtggcacagtcttggttcactgcaaactccgcctcctgggctcaaacgattcttctgccttagcctcccaaattgctgggattacagttgtgcaccatcacacctggctaatttttgtatttttagtagagatgggttttactatgttggccaggctgatctcgaactcctgacctcaagtgatccgtctgccttggcctcccaacattttggaacttttaaattctaacatttatctggaagaattaaatgagaatgacttttaaatttttgaagnaggaatacatccagggagaaacttgttctacttgaatatttttttttactaaaaaattatttaattttttnctttt

SEQ ID NO: 652273 - DNA, 380 bp, Homo sapiens
taaagaacggttaagggctacaaaaatacaattagatagaaggaataagatctagtgtttggtagcacaataggacaaccacagttaaaaataatttattgtgtatttcaaaatcactaaagagtagaactggaatgttcccaacacaaagaaatgataaatgcttgaagtgatggatatcccaataactctatttgatcattatacattgcatgtctgcatcaaaatatcacatgtaccccatatatatgtgcaactattatatatccacaataatgaagttttatttgtgctttttaagttttagtttttgagaaggagtttcactcttgtcgcccaggcttgagtgcaatggtgtcatctcagctcactgcaatctc

SEQ ID NO: 652274 - DNA, 528 bp, Homo sapiens
  misc_feature (251)..(251): n is a, c, g, or t
cgactctaggatcccaagctctggaaaggggggtctctccacatacctcagtctcacgtttccttccagcagggagtgccactccataagatctccacatttggacagtcaaggtgcgtaattgttaagtgaaacacaaacatggacccttagacatggatttgcataactacacacagctcaacctatttgaataaaatcctactctcagaccccttttggagtacagcaggggtgctgatcaccaaggncctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagagcccttttgcagtacagcaggggtgctg

SEQ ID NO: 652275 - DNA, 509 bp, Homo sapiens
  misc_feature (111)..(111): n is a, c, g, or t
ggtccatacatgtctgatgacacagctgtctccacaaaagagctttcaagtgtaagggtaggaaatttgggtttagattatttttttaagcaaatcaaattctttgatctntgctgcagaaaatatgatatttccaatcactggcacttagtagttcatgctccttcataggggaaagagttaacaaatgttaggtttctaacttttttttttcaggggttttctcaagctttataagagtcctgagatgtagattttttatccggcccttacaggtgaggaaaattaagtatctggtccaaagttcacagctggtataaagcacggatggatggatagatggatttggaggcagggtctcacttggtggccaggctggagtgcaggggtgcgatcacagctcactgcagcctggatctcctgggcttaagcaattttcccacctcaggcccctgagtagctgggactacaggtgcacaccaccatgccgggctacttttctccttttt

SEQ ID NO: 652276 - DNA, 206 bp, Homo sapiens
tccggtcccgttggctctcatggggttggaaccaggccgtcgcgtgcgatccttcttggatttctgtgatcctgtcgcggggttgcgggagtgagcgatactaaatgacttatctggctttctccgaattaatccgtgtatatctgctccgctaactccgtttttttttttttttttttttttttttttttttttttttttttttt

SEQ ID NO: 652277 - DNA, 447 bp, Homo sapiens
ccaggctctctacctccagaaggtttaactcaaacagcacatgcacataccttccggcctatgatccaccaactggagaagcttacgagggcaacacaaaacactatctggctaccaaatatgacccttactacacttcagaattggttggcccacagtgacatagaagggggagtagggacagtgctgggaagggggcgggtcccgtggtgagggctccaccccgcagccggtgcccacgggatctaggtgaggacaggcattttggtttgccggcccaaattgttgcatttcccccagaccagcctggcctgctacgcccggatcctgggccggtaaaaacctccgagaccctagcagacaggcacacaattgggcgggacgtcaagaggcacgcatgggcaaaagacacacgcagtgggccggcgagcggacagcaagggaagc

SEQ ID NO: 652278 - DNA, 335 bp, Homo sapiens
  misc_feature (27)..(27): n is a, c, g, or t
  misc_feature (29)..(29): n is a, c, g, or t
  misc_feature (118)..(118): n is a, c, g, or t
  misc_feature (260)..(260): n is a, c, g, or t
cacagagccaagggagtgttgactttntncttttttcattgtaagtgtcttttattttggctggatgtggtggctcacacctgtaaccccagcactttaggaggccaaggcgagtggntcacctgaggccagtagttcgagaccagcctggccaacgtggtgaaaccccatctctactaaaaatacaaaaattagccagatgtggtggcgggtgcctatagtcccagctactcaggaggctgaggcaggagaatggcatnaacccaggaggtggagcttgtagtgagctgagatcgcgccactgcactccagccctggggcgacagagcgagact

SEQ ID NO: 652279 - DNA, 379 bp, Homo sapiens
tatacaagaaccatatcaggaacgacatgaagtagctatcacagagcagctactacaacacgaagctaaagaggattcagcgtgaagaccacaaggagatagacatcactaaaatcccagtcaagcagatgtgagaccatgagagagacgcacatgcagaaacagccggagagggacaaatcagtcttgacacctcttcggggagatgtagcctcttgcaataaccaagtggcagagaaaccagcgcacacagctgtgccaggaatcacacggcacctgaccaagcggcttcccacaaagtcatcccagaaggtggaggtagaaacctcagggattggagactcattattgaatgtgaaatgtgcagcacagaccttga

SEQ ID NO: 652280 - DNA, 1289 bp, Homo sapiens
caagatcttatataaaacacagaaagtttgatgaagtggtctcccatttgctaaggcagctaagtacatcttgcattgaacaggattcgtacctaatatcacacagtatgacagagttctatctttgggcgctcaagtgcttgattattaggttatctgtggcgactggatagtcttcatgctctctttatgttgatcatcaagatctcatttccaagccttcataacaaggtgttacgtcaaagaagtgacagaaaccacagccatcgtcctgaccttgtagctctatctgtcagctattggcacttttagatagcatttatatctgcgtgattcaagacctgatcccatggacatagttactgtactactggtctctgtctgccaactgcacaaatactggctaatgcaggtctctaacgacgacactttcacacgattactatcacggaccctatgctacgctactcagctgcattgacccctatccgtactgacgccagtcacacgtcatgggtaccctgtataagcctatataccactggcgaaaatttgcaagtatatacgtcactacagatctcgacaaatactaaccggctaatactgctataccgcctgcgcaccattacttgccatttggacaagaattggagccatatatcctacaaacatcgagcctagatgcgaccatcagaacgacaacaagcactgcacacatccactgaacgattcgagacctataccctaccgtacgtctactgcacttcccatgagacaaagataggtacccacacacatcggcacttgccccgaggatcggctacagcggatcagaacaccaggcccacgcaacaactcctcctacctcaggatcgacatagggagatgcagcgagaatcagactctcagacaacccaacactggtaaacaccccggcgaagcgataggacaaaccacatcataccatacatggcaacacagagacacaacgaaaacaccaaacaacataaaaagaggacaaggaaccaactacaagggcaaaaaacaacaaagaaataaaaaagagaatgctgtaggcacaaccaaagggcaccatcaataaacgcaaaaacaacaagaggaacaaaaggaaacacgaaaaaaaaaaaaaaaaacacacaaaagaaaagagcaagcgacaaagacaacccagaagcaaaacaacaacaaacaaaacaaaccacaaacacacactacagacaaaacaaccgacgaaagagaacaacagcaacagaccacacaagaagaat

SEQ ID NO: 652281 - DNA, 233 bp, Homo sapiens
  misc_feature (125)..(125): n is a, c, g, or t
tgaatgtcgggcggagacgcgtatgatgggcagtgaggcggcgcaatgatctaggctatatattcggagtatacgtagcggtaagtaaaaacggtactctagaactatagtagcatgcgcaattnaagagcgctgatatcgatcgcgcgcagatctgtcatgatgatcattgcaattggatccatatatagggcctggtttataataacctcaggtcgacgtcccatggccat

SEQ ID NO: 652282 - DNA, 568 bp, Homo sapiens
  misc_feature (41)..(41): n is a, c, g, or t
  misc_feature (174)..(174): n is a, c, g, or t
  misc_feature (291)..(291): n is a, c, g, or t
  misc_feature (293)..(293): n is a, c, g, or t
  misc_feature (299)..(299): n is a, c, g, or t
  misc_feature (323)..(323): n is a, c, g, or t
  misc_feature (333)..(333): n is a, c, g, or t
  misc_feature (354)..(354): n is a, c, g, or t
  misc_feature (432)..(432): n is a, c, g, or t
  misc_feature (443)..(443): n is a, c, g, or t
  misc_feature (448)..(448): n is a, c, g, or t
aatgaattaattccctgagagtgatagctactcctagaaanccagatgaatcctggagtagtcccgaacgtcaatgcacctccgttcctagtcttgcaaagaagatctctagcttgtcctagcagctacctcctctactcagcctgaggctggcaggtaaatccagtgaccaanacctccggccactcaactggctggacacctagggggagacagcaagggtggtcccaggacacagctccacttccccagtggcgcgcgaggctgcgatcgcatgcttctgcatcggcncngagganatctcgtcatcactcatcacctgnactggtggtnaccactgagtgccagctccanagggtactggacctgcacccgcagccggcactcctcctccatgttgatcgtgtgctccttttgttgcagcacctgctnacgcactggtngtggntataacagggtgagtactgggccaaccctccccatcctcctcctgaggctccccatgagcttacctttgggttcatcaaaggctgatgcagagcagagcccgcaagcagagggcagtgat

SEQ ID NO: 652283 - DNA, 892 bp, Homo sapiens
gggcaccggtgccgccccgtgttctcccacggggccctggtttcgagtctctgtcacagcctcttccggcggcagcgtgcaccgggcgggcctccgtgcacactcagcacacgccatgcctactacagcagtgcgcttgcagtgtcactctggctacagaaacctgtctgcctctgtggatcctacagcctgtgcagcagccgagccgtcacctgatttttcacgtgtttctacctgtgtgctggagctcatgagtattgttataaactccatttaggtagcttcacgtgaagacattgcacggcattgtttgtaagacaactatgaacaacttgtttcttctagctatcattgtcttcctgtttacgacgtcacacaggactactttacgttctactacggacctgttccattttgttaactcttatgacatctgcaggctgtattggcgcgcttatgacgttaaattgtccatcaggcctctctcgcagcaggtaataccctctccttccgttgggtcccctgggcgagtgtgtagaactcaatgggcctagcctccaaaacactttttactgcatatacttaatccttttaccagtcccctcttatttgttataaacgtctggcagtttgatgttctggtttcggcataactgtaatccattttcacttgtagcctaaattcccagtccgaggttcggatattgttcaaagtgagccagggcccgagcttggaagcgcaaggcatccgtcgcctgtgccagtcctccctttgccctcaggccaggtccttggtggaaagcggtgcatcttcctgtcaggcctggttcccctgggtgaactggcgtcacgcaaggcacccgaagttttggcgtgactcctggcgaacgag

SEQ ID NO: 652284 - DNA, 424 bp, Homo sapiens
  misc_feature (57)..(57): n is a, c, g, or t
  misc_feature (65)..(65): n is a, c, g, or t
  misc_feature (70)..(70): n is a, c, g, or t
  misc_feature (96)..(96): n is a, c, g, or t
  misc_feature (161)..(161): n is a, c, g, or t
  misc_feature (207)..(207): n is a, c, g, or t
  misc_feature (212)..(212): n is a, c, g, or t
gagctaatgaaactttcaagaatggtgaagcagatgcttgggatacggtcacagtcngtaatatngccanattcttgaccgatttagggtcagaanaagtctttgtcaatgattatggggatattattgagaatccagaccgtgagcaacaggtcaaaaanaagtctaaaatcacggtttactttgacaacttacggaaaattaacnaggancaattttctaaatttagagatatggctgatctcaacttcagatcatctgattttgcctctgaagaaacaaaagggaatgtcttctcaagcatgatgtcaggcattaacctcttcttgcaagataatattgccaagctcacctctaaaaattccattgacttagagtcagtcgacgcggccgcgaatttagtagtagtagtaggcggccgctc

SEQ ID NO: 652285 - DNA, 179 bp, Homo sapiens
tgctcattgtgggacagatctcatgcagtctgggacccacggtgacggtcgactgttcagctcgttggcttggtgttgggcaccagctgacgggccagcagctagcagcggtgctgaggttagtcgaggtcccctgaactcgacggccatcaatcccgggcctgtcgggctagtcgggg

SEQ ID NO: 652286 - DNA, 114 bp, Homo sapiens
gcgacgtcagagagaagcaacttcgccccggtgagagagctcgcccatcaccggctggagccagctttcagtaaggatggcaggcagaactgttgcttgattccaccatctgcc

SEQ ID NO: 652287 - DNA, 241 bp, Homo sapiens
tgcctggctgaacacttccacaccttgttcacaccgagccctgcatcgacgccctcaaacaaaccctggtgcaacttgctgttatgggaaaattggtgccgcaagatcccaacgatgaaccggctagtgaactgctcaagcgcattgccgaggaaaagtcacggttggtggcgaaaggcaagctcacgactgcagaactcattgccagacgtcgttttttgaggaaaaaccgtatgctttg

SEQ ID NO: 652288 - DNA, 163 bp, Homo sapiens
acctagaggatcccctcacggtagattgtgagtactatcttttttgagggaaagtatgtagctgtcatcatattctccaagaaggtctacgggttgggcaggtgcggtggctcacgcctgtatcccaggcactttgggaggccgaggcgggcggatcacgatg

SEQ ID NO: 652289 - DNA, 952 bp, Homo sapiens
  misc_feature (442)..(443): n is a, c, g, or t
acccccgtctgctctaggagtgcacctccccccacccccatcactgcaggtaccagggtgcccagtggaaagggacctgctgtggaaagggacctgctgtggaaagggacctgcggcttcacacctgtgcgcagcaactgctttccatgcccaccaagcataagatagcagcccccccaggcccggtccacccttgaagggccacatggcctatcagggtccagatcatcacaccacggaagaggcagggcagtgctgggatctcttgagttatagatgcggacatggggaactcaggacctgccgtgacctgctcagggtctcagagcccctggtggctgctagaccgaaggggagaggccacctctggtcagcaggcagctggttccagcctaggctggggcagagatctgccacctggcaggatgcccagcctcctgtnnccagcgggctgtcctaagactgggatcgtacgatggtgagtatgggacccacgtgtacttttcaaaacccgtagaaaatacagcacaagagtgaatcctgatggaggcttgagacatttgtaataataacggatcaatattggttctttgactgtcacacgcctacaccctaatgagagaaggtaatcataagagaaactgggtcagggagaggggtgtgcgggacctctaccatctgctggtgttctgtaagctaaaacattaagtctgctatttaaaccaaacaaactagaaaatcaaaaacaaggggggcgacaaagattcctgagggccaattaaaggacgcagtgttgggacaagggcccaaaaggggcgcataaacgcagacgggcgcggtaacacgccggacggacacggcacgggcctggaggcgccacagggggacacatggaaaacacagagaagcaggaaaaacacggcgggaacacgacaggaaaacacactagagc

SEQ ID NO: 652290 - DNA, 862 bp, Homo sapiens
  misc_feature (850)..(850): n is a, c, g, or t
gataagttcaaatccaggggggcctttatggggcttcgacgcagatgggaattcgggattcgggagcgaatgtcactgccaatcctattgggacattcaatgtcgggaaccactcgcgcaaagccgttttgttttggtggttggaacggcgtacagtcgtccagcatcgagttctctgattcgacacccgtatcggtcctatgcatgctggctgtcatcgagtcaccacgcttttgtgccacgccatgctgctggctcggagccctggagtctgttcggatcctgaagagcgcctgtagggacggctgcttcagccgccagcaaccagcgcaacggtcaccactcatgagacagagtgcctatactggatttccggcctcccttggttgtccacatgcccgcagccacatcatccctgtgcgggttgcagatgctgctaaaaacaacagaagtctgtgatcgaactaatgacgcagacaggagacatctagcggtgcaagcaatcaatgtgagcccttaccggctcgcccccggggagaagaggcctcctacggagtgtgcccccacccctgcaccacacacaccccagatgatgaactactgtgccgggttgaggaatctgctagtcacatggaagcatagtggggctggaactgagagccgctcattcctcagctgagtgcaacgttctgcaggaggccactgcattttgaagtgatgagtgaaagagagaagtcctatgctctcaggcttgagcaagttggtatctgctcacgcctgagcatgacctcaattatgtcacttaaccccaggccattatcatatccagatggtcttatacgttctcggnatattagataga

SEQ ID NO: 652291 - DNA, 165 bp, Homo sapiens
cacaatagattctataataccaaagaggagggaacacttctgtgctaggggtcccccaaaccattcccaggcttgatgattcactatgaggactcagaatgcagcagacagtcacattcatggtgagagcacacagaacaaaatcttcaaaggcaaaaggcacat

SEQ ID NO: 652292 - DNA, 1167 bp, Homo sapiens
  misc_feature (1)..(1): n is a, c, g, or t
  misc_feature (51)..(51): n is a, c, g, or t
  misc_feature (60)..(60): n is a, c, g, or t
nacatggagtctcgctctgttgcccaggctgagtggaatggcgccaactcngctcactgnaaccttcacctcccaggctcaagcgactctcctgcctcagcctcctgagcagctgggattacaggtgcccaccaccacgcccagctaatttttgtatttttagtagagacggggtttcaccatgttggccaggctggtctcgaacacctgaccttgtgatccacccgcctcggcctcccaataatttgtaagttatgttagcgggatcctcaaggccttgctttgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtgtagagagtgtgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggctttcatgtaataaggatatttttagtgaaaaattgttttcctttcaaattacagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatctgaaaaaacaaaaaaagggggggctaaataccgggggccagttcgtccgtttgtaagggcccaagggggtaaaagaggggggtaaaggggagaagggcttggacccccggggag

SEQ ID NO: 652293 - DNA, 1060 bp, Homo sapiens
  misc_feature (1)..(1): n is a, c, g, or t
  misc_feature (51)..(51): n is a, c, g, or t
  misc_feature (60)..(60): n is a, c, g, or t
nacatggagtctcgctctgttgcccaggctgagtggaatggcgccaactcngctcactgnaaccttcacctcccaggctcaagcgactctcctgcctcagcctcctgagcagctgggattacaggtgcccaccaccacgcccagctaatttttgtatttttagtagagacggggtttcaccatgttggccaggctggtctcgaacacctgaccttgtgatccacccgcctcggcctcccaataatttgtaagttatgttagcgggatcctcaaggccttgctttgccccgtggagacgcttgctcggatgagctcaggaaacagtaccggctgcgtggcaggtctgggtgttgtgtgcgaggacgtggcctttgaacaccgctgtgttctcagaggtccttaggagatatttttttttgtcttagggggactgtgttaagttcagacaaatcatgctgggtgtgtagagagtgtgaaatacgtcagtgaagtaagtagcagtgagcgattgtgaatgtgtaatgtaaatggaaaaccgggttttaccgtgttaagttattcactagggagccagtcgtagttctttgtaatcctctttcttccaaacctgctttgctgaaagttgcagaaaaggaagtgtgtggagagaaacagaacccttcagggtgggtcagaggacgccatccacagtggattcgtgttcgtttgcaggtggaagcagtgatttttaggacccactgattaaaaacaaacattcccaagtgtctctgagagatgctgtttatttgttaattaaaaagcttttttctctgtcttttaaattatggctttcatgtaataaggatatttttagtgaaaaattgttttcctttcaaattacagaccttttaaaaaaacttaatttgagcgagtaccttttcatttgacacttttcctgtttctaaccttaggaaaccagaatagcgtttggcagacacgacgttttcagtttacctttgacacctgccccactccattttgctttgtgatgtcttcatttaacaataaattatctgaaaaa

SEQ ID NO: 652294 - DNA, 1377 bp, Homo sapiens
  misc_feature (380)..(380): n is a, c, g, or t
  misc_feature (724)..(724): n is a, c, g, or t
ggtgacgcgtagcgcgtggggttatctcgaggttgcgggcaggtgcccgtcgcggcccatcccgatgtgctggaggcgtctgaggggcggacggaggcggcggcggggcggggtagcgggagtcgggtcggcgtagtgggagaggcgggtgccgggatgtggatgccaggcttgcacgtaggcggtggacatggatgcgagtcctctgcgctggtcgtcgcgactctggccgtggcgtccgtggagcgcgcgagcgcggtcccgatgacgcggacgcacactgccggagtcggtgggtcgaggacggcgtgtgttgtggtcgcatcgtgtgcctgcggacggaggtgtgctgccttgaggacataaattatactagatantatcttgggaagaccaagagccaagagaagccacttcatgcaattctacagaatcatctatcatgttcttagaatcggtaggctagtatgagatcatagcacgtatatgagtcggtcatacgactgatcatgtaggcttagaaccacgtttttagctaggtgaggcgtaggtgaccttgacgttaagcattagggtgaaatctccacgtaggtatccgatgagaaggcccttggagagacgtgggtgatgaccgcggatgtgacgagagctccttcgtccttcggtaattcaccatatacatatgcatccggaggcaccatgttggggagagaaactccaaatntgtcgccaaccggaaggggaagggtacgagctgtagtggggtggcaacccatggtgtccccaaagaatttcttaccgggactaattgcaaacctggggggggctagcaaggcaacgttctcgatgagggctttccttcctgttggcaagcggtgggcccatacaggcagagagcgaagtagggggtaaaaaaccgtttatgttcaattctttgggggaacctagggattaacaagccaacctcaaaaataaaggggtgtccccatccggtcgcacttccactttttttggcagacgttccctttcccgtcgggggttccattgagcccattggttgtcacttattgccccccgtctctttggggggaacaccgtaattgttggggagcctgcggggtgggccccttgtgaatttaaacccatatttggcgttccaagttttaccaaacgtcttgaaaaaaccgtctgttgaacgggggggaaccacggtgccggccgtttgagagtccggtgaagcgctgggcgcacgggacaaccaccaggggtttaccttgggtccgtggctaggccggaactccctgcgaatgaccaagtcaagaattaggtcaccccaggctctttgggaagaacacccacggtgtttgcccctgttga

SEQ ID NO: 652295 - DNA, 673 bp, Homo sapiens
cacagttgatggggcagagctgtgtggaggccaggtttctccagtctttcctgctgccccagagtggctgagcagggaatccgctcaggcgccatctgggtctgccctaccctctccagcgtgtcctctcttcccaggatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatggtcagactctcaattcctgggcatctgagttggttctgtctgatgacacagtgaaccacatgaatgcgtggattttcaatttgcttgggctgcgggaagctcaaagacaactggtaggctgtctttcataccctaacatctaacaagaaggcacggtgggcaacctaattcaacctatatttctaatttaattacaattttaccctatttccccggctaatgggtatatgttgggggccctggttttgtg

SEQ ID NO: 652296 - DNA, 1079 bp, Homo sapiens
  misc_feature (166)..(166): n is a, c, g, or t
  misc_feature (1079)..(1079): n is a, c, g, or t
gatgcccagcaccttggtgtgatggcacgcatccattcgcctatcgtagaagcagcttatcaggcgagccatgatcacactggtccagtaatctcaatttttctatatatacatggattgcgctttgatgtgaatgccccctgctcctgattcaacatcataaganaatataggcataagtacgtcatcgatcatcagaagcagcctcaagggaaatagaaatcggatcgggacttagtcctcggccgggctcagtcgtgctcttaagaacgctgcaagtcttcgctcgcactattcgccatacagtcgatccattgtacgctatacagaccgatgctcaagcgagactctcatctcgcattactcgttccaagggtctaaataagggtcgacctagatgtgtactttgccatcgtacatagggttcttcagactgatcggagaggaattgatagtcttctaatggtcctaacatatcgtgtcaccaccaatgattgcctagcatcaaccagtgggaaatgcttggcggacctcacctggaatggttgactatatctgacgtagtgacttcttgcggattgggatatgtccacctcaaattacagatagtaaataaatcacgattcaaccgagaagaaagacctttgtcatgtctactggagacctggacccacgcgatcactgtagggcattcccggaaaacgagaagttgtcgaattggcccccgttgcaatgtactcacggagcaggttgcaacgattacaagtgacttgacagagacggtgggttatatctactggtatatctgcgatctgaattggtgttggaaccaatagcacagggtcttcagtgcactatacgttacttacgacatcaaatgatgtttaagaatctaatgaaagatagaggtggccggaatgaaaggcccctaatatttaggccctcggttgaagaggttaatggaaagcatttcatgggtggaaccgggaggacagttttgggaacagagggcgagtggagaaaagagggtactagggggagttggaatttggtcatgtttagtgtgttttaggaccagn

SEQ ID NO: 652297 - DNA, 491 bp, Homo sapiens
  misc_feature (51)..(51): n is a, c, g, or t
  misc_feature (106)..(106): n is a, c, g, or t
  misc_feature (110)..(110): n is a, c, g, or t
  misc_feature (115)..(115): n is a, c, g, or t
  misc_feature (120)..(123): n is a, c, g, or t
  misc_feature (125)..(128): n is a, c, g, or t
  misc_feature (137)..(137): n is a, c, g, or t
  misc_feature (142)..(144): n is a, c, g, or t
  misc_feature (171)..(171): n is a, c, g, or t
  misc_feature (220)..(220): n is a, c, g, or t
  misc_feature (279)..(282): n is a, c, g, or t
  misc_feature (290)..(290): n is a, c, g, or t
  misc_feature (330)..(330): n is a, c, g, or t
  misc_feature (355)..(355): n is a, c, g, or t
  misc_feature (361)..(361): n is a, c, g, or t
  misc_feature (367)..(367): n is a, c, g, or t
  misc_feature (405)..(405): n is a, c, g, or t
  misc_feature (408)..(408): n is a, c, g, or t
  misc_feature (416)..(416): n is a, c, g, or t
  misc_feature (425)..(425): n is a, c, g, or t
  misc_feature (462)..(462): n is a, c, g, or t
agcatgggctacagatcagtcctaggatcccgctcatcactcgctattggnctcggcctcactgcctgtgcctgcccagccatatgggtgcaatggcctccctganaggngaggncactnnnnannnngagggggcntggcnnngtactggggaagatggaagcagcaaanaaggctgtgaacaaagccaggatgcaagccagtggagccagtgcagagnacacatgctcagatgatgttgttctcctggatcttctctcccaagtaaaagcgggtaannnngaaggggntcaggtcgatggtctggaacctgcccttcagtaccatctntgctacagctcgcccaatgccaggngcctgntggagnccgtgaccactgaagccagtagcaaagtacatgttganaantagcgggngggggggancaagggattctggtcaaaggtgttgtagtcgtaatanccggcccaggcgctctgaaccttcagagt

SEQ ID NO: 652298 - DNA, 443 bp, Homo sapiens
agctcggtacctgattaggattctgaagatgatattactaggaagtaccgtaacagtctgattataaagatacatatcccaagatggttgataataaatacaaaagagaaatgcaaaagctgtaaagataagggcatgcaaccagataatctcagaatatccaaattggcaacaaggaacgtttggttggaatttgaagttttttcaacgtcatctttgtctttggctccatgttttaggattcgtgtgacctcaatgtaattgaaattccccttttatatcaatctggtgcttctctgtacagctcatccacttcctcatctgtcgaccgatcccccatggttgtcaggagctctctcaagtaatcttcctgtatggtgccagttgcttcttcatcaaagcaagcaaaggcatttctgatgacatcttcagaatccaaatca

SEQ ID NO: 652299 - DNA, 283 bp, Homo sapiens
gcgtgagccaccacgcccagccaatttactgcattataaaggtggaataagactttatttttattttttatttttttagacagactctgtcacccaggctggagtgtagtggcacgatctcagctcagtgcaaactccgcaccctgggttcaagtgattctcttgcctcagctacttgggaggctcaggcaggagaatcgcttgaacccgggaggcggaggttgcaatgagcggagattgcgccactgcactctagcctgtccacagagtgagactctgtctc

SEQ ID NO: 652300 - DNA, 168 bp, Homo sapiens
aggcgccgccacaattggtgcgcatgatgtgcgcagtgctctcaggtatcacatgcgaaagagagcaacgcacgtgctattagccgtctcaaagtcatcgtccgttctcacttgatgatgaggcatggttacatttgcgaatttgaatcattgatgaccacagagctg

SEQ ID NO: 652301 - DNA, 172 bp, Homo sapiens
ggactacagggaccaaacaattcacaagagaaataccggccaggcggggggacttacggcgaacccagcactttgggagggcaaggaagagcttgagcttagcctagacgataaagaccagcctggcaacaaagcagaccatctttacagaaattaaaaacgtgccaggcgg

SEQ ID NO: 652302 - DNA, 182 bp, Homo sapiens
aatgcaacagaaatccaatctagagctgctccgatctaactgctgctcctcgagtcgtggctggagccctgtgctggatcctcaggagtatgttcgccaacaaactggtgtatgacaactctggacagcgatgactcatcacctacctaaaaggaaactaaaggcaaggccatccaacaaag

SEQ ID NO: 652303 - DNA, 154 bp, Homo sapiens
cacacatccccccacacacacacacacaaatacaatgagcagatgtaaccccaagactctagatcactggttctcagccttcctaacactgagacccttaatacagttcccccacgttatagtgaccctcagccataacattgtttgtcgacgc

SEQ ID NO: 652304 - DNA, 916 bp, Homo sapiens
tatagtgaatccatggcacttattctttctagtctgatctaggatataactttgatagttacagtgcatgtatataaagtatgatgtaatgaaataaagtatgattgttactggcgtaacaaagccatacataggctgggcatgtggctcatgcctgcaatcccagcacttggagtggttgaggcaggaggatctcttgaggcctggattttattttatttatattttttttgatgaaggagtcttgctctgtcccccaggctggagtgcggtggtgtaatctcggctcactgcaacctctgcctcccgggttcaagtgattctcctgcctcagcctcctgagaagctgggattgcatgtgtgtaccaccacgcctggctaatttttgattttttagtagagaagatgtttttccctgtggccagctggtctcgaactcctgacctcaagtgatctgcccgccgtggcctcccaaagtgctgggattacagatgtgagcccccgcaccggaggctggaatttgagaccagctgggcaacatagcaagaccatgcctgtactacaattttaaaatattagccaggcatagtggcgcgtgcctggcgtcccagctactgggaggccgaggcaggaggatggcgaaggcagggacgtcgagggctaccggagcggggaccactggcgcatccagctggggcaacaaccagaggaaaaccgtattcaacaaaaaaacaaaccttttttccagacaactcgcatacaaactcggggctgaccttagatggggacaacaaaaccagcctagacccccaggagcacggaccctcgagaacatcgcccaacacaagaacagaggactcgcaaaaaaagcggaaccgccaccacaccaacacaaaaccgacaaacgcaaaacaac

SEQ ID NO: 652305 - DNA, 350 bp, Homo sapiens
acagtaagaaatacaaacaggataacaacatattagaccaggctgacctcaaactccagacttcaaatgagctacctaccttggcctcccagagtgctgagattacaggcatgagccaccatgcccagccaactcatttataaatataccacttatctggtgctgatgacatattacctcatattgctaattctcaatttgctgttatatcttagccaccttcacaactctattgagttttcctgagggcaggggtggtggttgttctatgttattatcacactaagtatagttcatggctaaggcaatatgttgtaatgggtgcaggagagagacagattagttctgaa

SEQ ID NO: 652306 - DNA, 144 bp, Homo sapiens
tgcaacacaaatccaggaggaagtgcatgacgatacatgcaaatattacccccttcagggcatacccaaaaccagccatacttggtggtttcaatagcttccaggaaatgcttgcacactattttagtttttggttttttcttt

SEQ ID NO: 652307 - DNA, 229 bp, Homo sapiens
gacttagagttccgatagtcaacacactacatttaccagcctcaccacagtctgtggcagcagcctccctctcatcatcaagcagcaaaataaaggaatattcacactaaatgggatacaaagattcaaggtcagttcagattagattgaagcacatgaattttgtcaccaaagcttatggaaaccttgtttaccagagctcttttggcatattggaattacacattac

SEQ ID NO: 652308 - DNA, 469 bp, Homo sapiens
  misc_feature (29)..(30): n is a, c, g, or t
  misc_feature (34)..(34): n is a, c, g, or t
aactgtatccctaaaattagtgctgaaannatgnggttaacatcgagccaccaaaagaatgcggttaacacatttgcaaagcacccctcgcgtatccacattttcaagaattgactgcaggctggtcattacaagctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccaagacagcaagctccctcctgtctcaactcctgaagcaatttgctactttcattaagcacatcatgtgcagcagccaagatattatccaattgtttaactagtaccagcttatttttctggtgctgaatatattctttcaactgctttacagtgaccaatcttcag

SEQ ID NO: 652309 - DNA, 731 bp, Homo sapiens
tgagccccccccccccccccccgaagaaaaccaaatcaacgccccagagaagaaaaataggtctctaacgacccaaaaaatctctagagattagccccccaaaaaccgaaggaaccgaatttaaattcaacccgcccctaaatatatcgcccctgcacttccgtctatctaatcgagaaacaagatagaaaatagtttagtcctaccctacctcccccgtaatactcgaacacgtgcgcctaactctccgactagtcggatatgcacccgcgaatctactctcagtacaagtaccacctaagcactcttagacgttagctaccctagaaggaaacctaaaactctcgcatcctccggttataactccaacaacacggagtccgggcaagaggccgtagctagttagtgctagtctgcttttacttagaaatccttccttagaaatagcgatacttctggcgtcgcaggtactcaccctactaggtagagggtcacccaagcaaccacttagtccttctagggttcctagtaggcctcccctacgaactctacccgtacttcctcctgcgccccccacaaatgtcgagaacccggtaaatatgctacccttcgtggaaccagacctgggacggcgggcttttagtccgggacatttcgggggagttccgcgttgaaccttccgtattttggggggattatcagcctcagagtggttgctattgtggcggaat

SEQ ID NO: 652310 - DNA, 916 bp, Homo sapiens
aagagggtcaaagcgcgcccgtacaagaggtgttacccagacttcaaaggtacgcgcgctgtcacaacagatgggactctcgcaaagccgctaaggggtcaacgcgcggcctgaggtgtcctcggcacaaatgcgcgcaactgatgtgtcgcagaggtgtgcacaccccgctctgtcagcacatagtccgtggcgaaattccccaagatgcgagagccggctgtgggagtggaaaatccacgccgccaccacactcaaataaatcccgcgaaaacaccgggggctcaccgcaataaagatagaaagggcgctgtcaaaataggagacgtgtgactgtccagaaaggcccaactgccaaaaaaggcgccccaagtgggacaagaggaaacgaagatacccccggagatgcactctatccgggggcgaggtaaacaacaacgtccactgattaacaacgcctacaaggcgccccccttggaccttggcaagccgcgccgggggcaaaacatgctccgggtgggagtaagcaacagcccacaaattccgcccgctcgaacaaagcgagtagttaatatcaatattgtggatgcacccgaaataataccgggcgtaggcccccattaaacaagcgataaaaaaactcatgcgggcaatcgtatttggaagccccactagagtttcagacggtatgtatcggtcacataacaccaattaacaagggtgtccccgcccctcttggaccattcaaagcaacgatactctcggcgggtctgttccatacaaggtggttacagatctttctgacaagccttgaagaatgtatgggtgggtcacttaacacacaccctggggattccccaccatgtgattccctttgagagggaatattaaaaaaactaaactccccacaaaaaca

SEQ ID NO: 652311 - DNA, 145 bp, Homo sapiens
tgttcccctcgacgtggtgcgcgcagcatgttgtcgtcgtcaggttcggggatgggctgcgaccatccgcaccgcccggtcgatcatctcgacgaggttggggaagtgcatcacggtaacagagcctggacgattctgcggggca

SEQ ID NO: 652312 - DNA, 693 bp, Homo sapiens
tgagactcaaaaaaaaaaaaaaaatgctttttcccttgacctgcccccaaaaatcagggggcgtaggaacggggaatgaaagtagggtctcctcactccccaccaaccggggaaataagggactggaactggtcgggcttacaacagaatccagtctcatgtcagtacctccttgaaggctcttaggtggctcggtctaaacgattggctctccgggaacttcaacagcagtcgtgggccagagaagagcacaggctcttggcgctaaatctagtttcttcaatggaataccaaatttagaaactaccagggataaggggagggatttcatttgtcagcgaaaagtgggcttaaggacttctagtggggaaaagggatcagaaggccaaggccaaaattaagggagaagggccagctggcctccacccatgggcttcccctttccggcataaactaagggatgggtggcaaatcagggtcccaagagaagcagcagcaggggattatggcacgcattatccctggcagacagaacacaaatttcccacgcagtttggggagcctggatggttggtggggctcccagagtcgggtcaggagaccaacagcttccaatcccagcatttacatggaagggggtttctaacaagctttggaacttttctatagcatgggtatctcatttctcaccaa

SEQ ID NO: 652313 - DNA, 229 bp, Homo sapiens
agcctgataaaatgatggatggaacatgaaataggatgacagctctagtcgacaggcttggcaggtaaaatactgacttcctctgatatagacatgtggcgccactcctataaggagagttcaagcctgtgggaagtagaaaaatctcactcccagagtcagaggagaagagacgttaccttgaccatcgtcctcctctcagctagcagagggggcagctaggaaggtg

SEQ ID NO: 652314 - DNA, 353 bp, Homo sapiens
ctcttgggctatagtaatcatgattaattacttaacagatcacagtatcgaccactgacatatagaacactcaagcctaagaaccatcacagaatttagtaactctagatctgtgaacatgaaaagatttctattgtggattccaaaggagatcatttatctatccacaaggcaagacatcttgcagagactctgaattccaaatctgagtgagacagggaagccactctgattcatggcggattcctaagcaacatatatacatgtgactaagacaaccttatgttggcagctggactcctgaacaccatatgcaccctatgcatgctgttccttttcttgatcacatatcg

SEQ ID NO: 652315 - DNA, 507 bp, Homo sapiens
cggcacgaggggcatttggctttggagcctcagtgtctgcttcgatgagatgagccattgagaattaagaggtgaagtaggtggaagtgtttcgctacctgaacagggccgggcagattgtccagacgattccgctcccctggtgtctgagggcaggggcgtctcagggcaggggccccatcgtgttcatccctgtgtctttaaattcctagcatagcatctagcatggggcggatgattgtacagggcatgaactgcaatcccaatgaggtcagagcagcctcactgtaggccgaggtcgttccagtgggcttcatggaggaggtggcacctgggcgagcggggtgttaggtttggaggtcaggggcctctccaggtgcaggggagagtgctgtgggtggtaggaagagaatgctaaaaattaatgtctatgaaatcttcatctcatccatcacacatttaccgagttgttgccccggcctaaacaggcggtactctctgttatta

SEQ ID NO: 652316 - DNA, 1040 bp, Homo sapiens
  misc_feature (21)..(24): n is a, c, g, or t
  misc_feature (27)..(27): n is a, c, g, or t
  misc_feature (29)..(29): n is a, c, g, or t
cctccaacaaccccttgatannnnttngnactacaatcagacctatgctagtcctgtcatctattcgctactaaatgcagactggagggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcca

SEQ ID NO: 652317 - DNA, 127 bp, Homo sapiens
ctaggtaagtcatcatggagatcaagttggtccttgtggtgggtgacgaccttatagccctttgtatagcgagcaaagtttaatgagagcaggggccggtgtgacttttgagtagtcttgaatgagg

SEQ ID NO: 652318 - DNA, 797 bp, Homo sapiens
  misc_feature (29)..(29): n is a, c, g, or t
  misc_feature (65)..(65): n is a, c, g, or t
  misc_feature (71)..(71): n is a, c, g, or t
  misc_feature (73)..(73): n is a, c, g, or t
  misc_feature (85)..(85): n is a, c, g, or t
  misc_feature (89)..(89): n is a, c, g, or t
  misc_feature (92)..(92): n is a, c, g, or t
  misc_feature (100)..(100): n is a, c, g, or t
  misc_feature (104)..(104): n is a, c, g, or t
  misc_feature (106)..(106): n is a, c, g, or t
  misc_feature (120)..(121): n is a, c, g, or t
  misc_feature (131)..(131): n is a, c, g, or t
  misc_feature (140)..(140): n is a, c, g, or t
  misc_feature (156)..(156): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (239)..(239): n is a, c, g, or t
  misc_feature (254)..(254): n is a, c, g, or t
  misc_feature (264)..(264): n is a, c, g, or t
  misc_feature (267)..(267): n is a, c, g, or t
  misc_feature (278)..(279): n is a, c, g, or t
  misc_feature (284)..(284): n is a, c, g, or t
  misc_feature (293)..(293): n is a, c, g, or t
  misc_feature (302)..(302): n is a, c, g, or t
  misc_feature (313)..(313): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (343)..(343): n is a, c, g, or t
  misc_feature (403)..(403): n is a, c, g, or t
  misc_feature (439)..(439): n is a, c, g, or t
  misc_feature (590)..(590): n is a, c, g, or t
  misc_feature (609)..(609): n is a, c, g, or t
  misc_feature (621)..(621): n is a, c, g, or t
  misc_feature (645)..(645): n is a, c, g, or t
  misc_feature (680)..(680): n is a, c, g, or t
  misc_feature (694)..(694): n is a, c, g, or t
  misc_feature (702)..(702): n is a, c, g, or t
  misc_feature (731)..(731): n is a, c, g, or t
  misc_feature (790)..(790): n is a, c, g, or t
tgaccaaaaaaggcaactatatttaaagnaaatgtatgtgattcttgtcacaacaaatatttgcnttttcncngcggccgcgcgngggnccnggggggcnccgncncgccaggcccgggnngggcccggcnccccccccngaacttcctggctacncatttccagcgaagtttaatctatttttaataatcgttcagttttcaaggnaangggggggcngttttttcccccggggcggnggccctggggggggncgggcccagnggntccggccgcgnngccgncagcgcctncggcagagngactgaggcgngatttcgttctcagangngngaggcaacgntttcgggggaccagggggggggcggcgcgcgcggggccacagcccagccccgcgccccgnccgcgtcacagccaaagccccgccggggggcgcgcngcagaggggacacgccgctcatcaactggggcagcgcgcggtcggtcggcgcggtggcgggcggcagggaaaaggtggggtccgggacagccacggagcccggagtcacccgcgaggccgccccggtggtgcgtggggggcggcgcggggngcggccgggcgctcaaaantcctcgtgcacnctgcgcgcgttgtccaccagcttnctgcccgtgaagaactcgctgttcttgagcccctnctcgggctccaggnggtggttntggttctcgtcggcgacggcgatcatctncttggcctcgttcagcgcgttgtactcgttcatggggtccatgttgctctccagccccncggcggt

SEQ ID NO: 652319 - DNA, 516 bp, Homo sapiens
  misc_feature (36)..(36): n is a, c, g, or t
  misc_feature (38)..(38): n is a, c, g, or t
ctatgatttacagaccccaaacaacacacacgccgngngccgcgctgtgaggacaaccatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcca

SEQ ID NO: 652320 - DNA, 170 bp, Homo sapiens
aaggaggtgtgcgtgggtcctgcggtgtccatttcccgtgttgtctgtttcgccaagggtatccttaatgtggctcagtgctacataaacatctacagactttgcgtgatagtgcgagagatttaaacagcgcgcgtaaaattctcctacaacgcggggtcccctctagc

SEQ ID NO: 652321 - DNA, 124 bp, Homo sapiens
catatcagcagcgggccaagaaaacttcttcaaggagcgtcgcttgatgtcgggacagtatccaggtgtcgtctgagaattctaggacgtggtgctgggggtgctgcaagtccccggggcggca

SEQ ID NO: 652322 - DNA, 1069 bp, Homo sapiens
  misc_feature (141)..(141): n is a, c, g, or t
atcacttgtgccctccacctacaaatttcaactctgattctacagcagtgattctggggcctagctgcacatccaaatagatcttggagctttaaaaacatcctgatgcccagacttcacgccagaccaatcacatcagantttacttgattggaagctggcatttgctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcca

SEQ ID NO: 652323 - DNA, 1274 bp, Homo sapiens
  misc_feature (21)..(24): n is a, c, g, or t
  misc_feature (27)..(27): n is a, c, g, or t
  misc_feature (29)..(29): n is a, c, g, or t
cctccaacaaccccttgatannnnttngnactacaatcagacctatgctagtcctgtcatctattcgctactaaatgcagactggagggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaaaaaaaaaaagtacaatgctatacctatcaaactaccaatgacattcttcacagaactagaaaaaaatattttaaaatcaatatggaaccaaaatccccaaataaggaaggcaatcttaagcaaaaagaattaagccgaagacatctcgtcacccaacttcaaactacactacagggctacagaattcaaaacagcatggtacctcggccgcgaccacgc

SEQ ID NO: 652324 - DNA, 470 bp, Homo sapiens
tgatgtctcctgttgtacaaaagtggctgtaccaccaagacctggatgtccagtaccgcagtgggggtgctcctcaacctgggcctgcccatttaagcctcaccatcaccctggtaaagactgccaaactgtggggaggcactttcctttggacctaaacctgaaatccccctctttgccctgggtggatccggggaaaccctttgccctttcctcgggtcccaaccctacaaacctgctgtgtgacctcaggccaatgtgccgaccctttttgggccccagtttttccagctatgaaaacagctatctcccaaagttgtgtgaaacaaaaaaaaaaaactggaggaaggccgtgggccaaagggaaagctcttgttattattaaaaatgttgcccctggtggggtggtggtattaaataaaattcaaaatatttattttaaacctacaaaaaaattttgggcccgtgga

SEQ ID NO: 652325 - DNA, 158 bp, Homo sapiens
ggtcttggcctttttatttttatatggaaaagttttaaggacttgggccaactaagtctccccccccgaaaaaagaaatttgccttgtccctttgggtacacccatgcaaaactgtttgttggctcccaaaagttttgccaataaaagattctagcta

SEQ ID NO: 652326 - DNA, 798 bp, Homo sapiens
  misc_feature (21)..(24): n is a, c, g, or t
  misc_feature (27)..(27): n is a, c, g, or t
  misc_feature (29)..(29): n is a, c, g, or t
cctccaacaaccccttgatannnnttngnactacaatcagacctatgctagtcctgtcatctattcgctactaaatgcagactggagggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaagaccccaaaagagctaagaccccaaaagagcaaagtccccaaaagagcaaagtcctcaaaagagcagagaccccaaaagagcaaagaccccaaaag

SEQ ID NO: 652327 - DNA, 781 bp, Homo sapiens
  misc_feature (21)..(24): n is a, c, g, or t
  misc_feature (27)..(27): n is a, c, g, or t
  misc_feature (29)..(29): n is a, c, g, or t
cctccaacaaccccttgatannnnttngnactacaatcagacctatgctagtcctgtcatctattcgctactaaatgcagactggagggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccaaccttaacgtggggcccatcccattccactttgtaataatctgttcctctatctccccgcctctacccccactaggttatcagccctttcaagacagggaccacacagtattcattttttatattccccaaagcctaacacagaccacaaaactgctacagttcaattctatgccataatcaacttttaagtcaagtgaggatgggccgacattgtaacctctagatc

SEQ ID NO: 652328 - DNA, 258 bp, Homo sapiens
  misc_feature (236)..(236): n is a, c, g, or t
ccaggctggagtgcagtgatgctcacagctcactgctacctcaaactcctgggcccaagtgatcttctcacctcagcctcctgagtagctgtgattaaaggtacaagccatcatgcccaggtaatactgtatgtttttaaaagaatcattcaaagatccagaaagagctcctgtaaattaaaaataggacataaaaattcagtggaaaaagatgacatctaagatatttctcaganaatgaggggggaagacaataag

SEQ ID NO: 652329 - DNA, 153 bp, Homo sapiens
gctccgggacggctgggaagcagtagatggcggtgggtaccgactcaggcgcatgccatccctagctcaacacattcctccctggtcccgatgctggttaaacttcatctctcggcggtgaatgagcccacagcatcgtgtggactggcactg

SEQ ID NO: 652330 - DNA, 146 bp, Homo sapiens
ttgtccgtgtgataatgtaacctgtctcttagagagctatggatgggcaaaggctctgcaagggccagaggtctcttcatgctgtgagctggcagggactcatattctgaccaagtggcagctgaccaggcatcacacagctcatc

SEQ ID NO: 652331 - DNA, 347 bp, Homo sapiens
tttttttaggccaattttaaaaaaagggagaggcgggagaaaaacccccttccccccaaaaaaaccttttggcgggaaaaggggggggaaattttttaaaattttgggggtttttccccccccctcctttttagacccccctttttatgtgggggaaaacccccctcaaaaatggaccagagccccaagttgccttttttatttgggccctcccggccaatccccccggcctttgggttttttaagggcccccccccccattgggttgccaattttttcggttttccccgggattttttaaaaaatttttttttttaataattaaaataaaaccccccttttggcca

SEQ ID NO: 652332 - DNA, 1489 bp, Homo sapiens
cgctcgtccgtgtctggttagtgttgtagtgtggctgtgttttgtcgcggtctcgtggatttctcgttcgttctcttattgtcgtgatgttagcacgaaagtaaaacgtggtggtgaaccaaacactgcttgtgtggggcgcacgttggatgctcgggtggatactccccttgtgtgtttacataaataccaggggttgtgttgttatttctgccccccgctcttattattttgtcggtggttttaattgtgtgtgatgtgtctgttggtggtgcgattttgtgtctacacaagtaggttttttttttttttgtggttgtgcccctgttcttgtctgtttgttgggtcgacacactttgctgtagtagcttgttttttgttgttactcccaccatgttggggtgtttctttggttgtgctgctgccgccccccctgtggtgttgtatccccttgtgtgtgttttcttgggctgggtttgttttcacactcgtgtttgtgaagggtgtgtgtctttcccctcttttttgtggggtgattatctccctgagtggtttttcttgttgttgttgtgcggcttcgtgggtcgtccttttttgtccactttttgaacaaccccccttgtgggtgttgtcccccccctcgtggtgttatattaggttgcaaccaacaactactcgtggtggggggccacccctcacgatatttgttgttctccccctctctgttttttttggggcccttgttgtgttttgtgtggtgattatgtgtgtgcccctctgcgtgttctacaacacaggtggttttctccccccgggggctcacagtggtggtttctttttgttgtttattggtagactctctttttttcttcccccccatagtggtgttgtccctttcggctcctccatctttccatgaaggttggggggggcacaacacgggtgtgccccaccccccgctcctcctcttgtgcccatcgtgttgtggggcccacctggtgggtcacgccctccctctggtgctcctgtggaaggtggctctcttcctctcggtggggaaatatttgtgtgtgttgggagggtgttgttccttcccccgcggggtggggccctgtttcccctctttcctggggcaccagggtggggaaaatgagaaggccacaagggttctccccactttatacttattaataagtgttgtgtgttacacacaccacaaaaaaaggtgtgcgcaccaccaccccctcgtatagttgtgttgcccggggccacggcgccccggaataaattatgtgtgttgtgtgcacacaagtgggtgggtgaccacacccacaatcgttgtggagagagcaccaagggagacaccctgaggtgtgagcgctgggggaacacaccccccgagaaacacaccccgcgccccccccccccccggcccggagagaggaactttgtccgcccccctaaaggggggggtcgcccccccccgcga

SEQ ID NO: 652333 - DNA, 183 bp, Homo sapiens
  misc_feature (35)..(35): n is a, c, g, or t
  misc_feature (44)..(44): n is a, c, g, or t
  misc_feature (55)..(55): n is a, c, g, or t
  misc_feature (68)..(69): n is a, c, g, or t
  misc_feature (115)..(115): n is a, c, g, or t
ttgttgctatggacactgggatgttagtacatttncagaactangtgagaggatnagtcatttctgtnngaagtggttacatatttaacctgtttcacagagcccagtgaatttntcctttaactatattctttcttttttttttttttttttgggaaaaaaatttccgttttgggggcccgg

SEQ ID NO: 652334 - DNA, 480 bp, Homo sapiens
cgaagacggtggctgcgctttgttgtgtttgtgctgcagatactgagcgtatatgcttccaaatcagttggtcttttgctggtaatggcttccacacctcagccagtttgtttactaagttccccacaatctataccgggatggtcagccacaattggtcaggcgatactctttacagaagacctggtaggccgacatgttcttcttttttgggttttctcctctctctctctcttagtccttctcttctttttgcttttgtttttcactatgcccatctgtgtggaggccaggaagtggcaggggaggtgctgtggctccagcgtatgggatgctgggaggagggccagatgtcacggtgacctctcccacgggcacggcagaatgtcctaagagtctcggggccttggagtgtcgcttctctttatgcagctcctagtctaactacttagggcactacttgccacagatctcgcgggg

SEQ ID NO: 652335 - DNA, 171 bp, Homo sapiens
ctcaaagtgcacaggaggtggcagcagggtcaggcgagttcctgttccagggacataatgagagagtgcacaaacctagagactgcacgaatctcatgttgctggtgcagcacattgagcaagtgcagccgggacagctggtcattacccagagccacattgatcatttgc

SEQ ID NO: 652336 - DNA, 117 bp, Homo sapiens
gttcaagaccagcctgttcaacaaagcaaaacctcgttttcacaaaaaatttaaaaaattaaccagatgtggtggtgcatgcctgtaatctcagctatttaggaggataaggcagga

SEQ ID NO: 652337 - DNA, 110 bp, Homo sapiens
cattagtgtggacccataacccaacctgactggtagtcttgtaaagaaaaggggatgtggagcactcaagtgatgaccccatggtgcacatgcaggacacccaagtgagt

SEQ ID NO: 652338 - DNA, 662 bp, Homo sapiens
ggcctctccaggtgcgaaacttcctcgagtcagcctctccagtgcccaaggctcctcctgcctcccaggtggcctctttcggccagcccagctcatggtcttctcggctggccttcccaggccccgcgtttggattttggcagcctcttcaggcgcagaacttgtatctccagtcggcctttgcaggccgggctcctgcctctcgaaggcctgcactgggcccggcctcggcctcggcctcacagggatctccagcccagctagctctcgcctcgatgcggctcccgcagtccaagagctccgtgccgtttcggtcacttcggcagggtccagcatcctgtcctgccagtgtgctcgtttaggcccagctcattcctcacgtcggcattccaggccccgttttttcccttccggcagcctctggggcctctaagttaggtatctttttgtgtataaatcccaaaatattgaatttgggaatatttccagcattatgtaaatatttggtaggtaattatttggcagtgagtttctgcgccaagcccgaattttgtattgatttcttattattcgggttaaacaggtttaatgacggtcatggcaagtttttggcacaatgaaaaatatcgccacgatcaacgtgttctgtctggggaaggggg

SEQ ID NO: 652339 - DNA, 315 bp, Homo sapiens
  misc_feature (237)..(237): n is a, c, g, or t
catggcagtagcatgaagccactagggttctgtcttcttcttataatacaccatacaagttcatgtcagacacaaaaaggatcgtagtgtgtctcctctagcgcgtcttcgctaagcactggggctgtggtgcagcttaatgtgccaggacttgacatcaggcttactacggagccagactggggaaggatgactccacaatctgaagtcattccttccagctttagacgcacgggntcagccggcatattaatgagccagcactgcgctgcgagttaacatctcacactggctggggaggaatgaccctcgaat

SEQ ID NO: 652340 - DNA, 330 bp, Homo sapiens
  misc_feature (69)..(69): n is a, c, g, or t
gtattctgtatcttgataggggtttgggttacaaaggtgtgtttgttaatactcgatgaatgtacactntagatttgtgcaattgcgttgaactttatttcatcttataagaaaaaaaaaccgcaaacgaatattgaactctggttgataatttacattctgcatgttttggactgaagtatactactgtctgcgatttactctactatgcatactaattatatatgtttattatttctggataatggatggttagagggatggaaagatggatagactatgtgataaaacaagcgttgcacaatgtcatccaccagtggaaatcgggta

SEQ ID NO: 652341 - DNA, 323 bp, Homo sapiens
ttgctccagatcctaaatcatctctctgaagtcgagttcacaccatctctagggcaggggcaaaataccaccagcctctttgctacaacatagcaggagtgatctttactctaggtcccaactaagttcctcatctccatctgagaccacctcagcctggacttcattgtttacatcactatcagcattttggtcaaaatcattcaacaagtctctaggaagctccaaactgtcccacatcttcctgtcttcttctgagctctccaaattcctacaacctctgcccactacccagttccatagtcatctcaacattttcaagt

SEQ ID NO: 652342 - DNA, 416 bp, Homo sapiens
aacaggtagtgtggcatacacaatatagctgtccgtttacagtagcctctggcatagccatagggcatgtaaaataacattctgtagcagcaggtaaggaaactatggagcactcaccagtggtacagagcaccttaacgaaaagacatgagattggattcggctactttagatgcaaaatgtctaggacagaactgtaagttcagtacagttactaagaagcaaacactagaacttgatataacttccaaaagcgctcattcaagtagtagtacatattattctaagtgacaaaaaggtgctaagttatttacagatataatggttgtacagtaccttttagatctgcaatttaggtttcagattgtccattaagaatgaactgcactgaaattctataaatgatacttaagcaa

SEQ ID NO: 652343 - DNA, 1547 bp, Homo sapiens
  misc_feature (183)..(183): n is a, c, g, or t
  misc_feature (268)..(268): n is a, c, g, or t
  misc_feature (277)..(277): n is a, c, g, or t
  misc_feature (296)..(296): n is a, c, g, or t
cgaagggcctagatgcggtcaagcaggtgatttcggtgtcacatcctgtcgatagaagaagtcagagtcaggcctcaagaacaagtggatgtcaataccctcgtgtgttgtaccaaggggtccttaatacgtatcggcatttggtagcaggtattagttccagaccccaaacatagcagctcnacccgacataggatgagacacatgtgatcgcctgttagtatccagtgttggctaggctggataggtcctgagccgggtccatacntgattatancgcaggcatagatacacgntgcacatctcttgcctgtattgtgataagctatggtatacgaatcccaaagggtctcgcataggggacctcagcacaagaaaagaaggcttcacgtgcaaaggctttggcttttaaaggcttccggtctcacaagcaaaaagttacaagaagcccatagaggacactagaaatgactaacagacagcaacggatacgtcatggacgcatcttgctatgcggccctggaggccgctggagacgaaaggtgtagctagtggaaaaaggcgcggaccggtccgcacatggcacagcagcaccgaggctgctgctgtctccgtcagacccatcgatagatatgaacgcgacctgaatatgacgactattctatgcgatgggaccacgtaaccaaagacaacacagatctcccagtggtggggattggattggccttggtcttaccaagtggacgatgggacatcctcgaatacgaaattcttgggcataggctctgaactccgtgccatggggccctagtttgtttcccggacacagaacatagcgggggcgatttccccggtgtaaccgtggcaccattgttagtccgataagggccggcgcacacagggtccaacagacaatctgtagagagaacgcgggatcagtaaggattctctagcagggaaaaagaacgccttgaatattccacctaggtaacgagcactttacaaataaacacaagtgtaaaacctccgtgacacacgaaccagaacagcggagcggcctactaaggcgcgtaaacggctaggggcagggagaagttaatacaaagaggaccccaaacttgactactggaagcagaactaccctaatgggaggactcccggcccaaacaactggtggccgtgggcacaggagtgccttgggagtcccacaaaagatcccagggggcgtacaggacttggggccaaatgctgtcggacagacaggggcgaacaggcgctaaaaggcaacctgggacccattaacacgggggcgttcaccctgtcccaccgggcgagaactatgacagggccaacatacccgtagtggcaatacacacccaagctgtccctcagagaacaacaacgacgcacacccatcgagcaaccacgccgggacggcgacaaaccgctatgacaggcaccgggcacaaagagagtacgcgcacccaaaaccggcaacactgaaacgagacacacacaggggcacacgagacagacacacaccacat

SEQ ID NO: 652344 - DNA, 519 bp, Homo sapiens
aattgttgtagccttgggtgagacccagtgttaggctggcttcatttctgacccaatatagtcccagtggcggtggccacaggagtgcttgtgtcacccctcccacagcttcaggcagctctggagagagagagagagagagagaaagaaagagagaggagaggggagaggggagagagacagagagacagagacagatttcatctgtttggagggaagtaagggatgagaacaagagtctctgcctggtaatccagggaattcttctggaagttacccaagaccaccacggtggtatctgtacaagcctgcaatagccacagcgttattgggcttggggcacccctaaagtagaaacgggtaaagtgaccaaaaacttagatgactacacccatgtgcctttaaatacctggaaagcctttccaaggataggcagaaacaagcccagactggaaagacttccgtgaatacctaactctttaaaaccccactgtcgccccaagcatcgacctttcaggg

SEQ ID NO: 652345 - DNA, 144 bp, Homo sapiens
gatgtatgcccagctctaacaccatccccagcatccagtcagacctagtaagaaactggattcttacccaagatggctgtaatcactagcttttttttcctcatggaaaaaatagagttcaaaaatttttcctctcttttccat

SEQ ID NO: 652346 - DNA, 104 bp, Homo sapiens
tctctattcacatgggattttatggacttttgagcctcctggtgctattcgttctcttagcgaatgttcagggacctggtctgactgattagtctgactgatta

SEQ ID NO: 652347 - DNA, 760 bp, Homo sapiens
taaaattaaacaataatgataataattagctgggcatagtggggcatgcctgtggtcctagctacttgggcaggcctgaggtgggcaggcatgggttgagcccaggagatcgcaggctgccagtgcagcttgcatcatgcctcatgaactcaagcccggcgcaacagagcgaggacctgcccccaacaacataaaagaataagagattcctagtcaagccactccagtcaaatatctaactagtctggtcgaaatacctgcatcagcgcattggcatagttctggcgctccaactggcagcctcatcgcatctcctcttccagttccagatctccgcactagcatccgacagggctacgctacagccaggatttagcaaccaataacggctccactgcgctgacctctcacacaaccctgaccacactgcatctggtgcgccataccgttcaacaccccacgcacccacggactacacatccactacgacactaaccttcagatgcctaagggcaccagcaacttctctcaacggctacacaagtttcacccaccactttacacacggctcctcacactcggggggacctgggttacaccacacaaccattaacaagctttccgggctaagccactttcatcaccgccaaaggccgggccttgtgtacacgaccaatcttaaaacctatcgaaacgtgtaagttcccaaatagtttacggctttcatagcacaaagcttggcacgccgcaactaccccac

SEQ ID NO: 652348 - DNA, 456 bp, Homo sapiens
atcctcatttggttaaaaataaatccttgtatatgtgaacccacacagttgaaacccatcttgttcaagggtcagctctatataaaatatatatacaaaaaagaaagaaaaaaataacaaagaaaaagacaaaacaaaaaagaaaacaaaaaaagacaaaaacaaaaagaaaaagaaaagaaaaaacaaaacaaacaaacaaaaaggaaaaaaaaaaaatcaaaaaaaaagaaaaataaaaacaatacaaagactaaaaaaaaaaaccaataaaagaataaaaaataaaaaaagaaaaaataatatgaatatataatataatatatccaatatgataaaaacaaaataataacataaataagaaaagaaaataaataataatgaaatataaataaaaaaaatatgaaaaaaaagaaatgtataaaaaagaaaaatataaaaaataaaatgtcagat

SEQ ID NO: 652349 - DNA, 180 bp, Homo sapiens
  misc_feature (162)..(162): n is a, c, g, or t
tgatgtcgattgttgacaaagaagaataaggcgtcctcaggtctcaggtggattctcttccggattaagaagtagaactggccaacagtaaggtcagagggcactacggtacttccgtcttgtccatgatcagtgcaccctgtgctttgtggagccttctcnatacaatcacggtggacc

SEQ ID NO: 652350 - DNA, 538 bp, Homo sapiens
  misc_feature (6)..(6): n is a, c, g, or t
  misc_feature (31)..(31): n is a, c, g, or t
  misc_feature (66)..(66): n is a, c, g, or t
  misc_feature (97)..(97): n is a, c, g, or t
  misc_feature (104)..(104): n is a, c, g, or t
  misc_feature (158)..(158): n is a, c, g, or t
  misc_feature (165)..(165): n is a, c, g, or t
ccccanaaaaaaaagccccctaaaaccttcnacaaaaaaaaactccccccaaaaaaaaacccctgnaaacgggaaaaacaccccccaaagccccccngtttggnccgggaataaagccacaattaggggtaatatttccacacgaagggaaatccccnagactgncaaatggggaaatgaagcctgcaaactcccaccccccaaccttggaagtgtattcacccaacccctagtgttgaacgagataaggcaaaaatgcacccataggattcccatttatataaagtttaaaaccccagccaaaattccatcccatgcggttgccaagtagagatcagtccctaagaagacagtaaccagaagggggcatgaggtggtgcttcctggggtgttctgtttcttgatctggttgcccggttacctgggtgctttccgtttgtgaacattcttggagctgtacacttttgatctgggcacttttctgtgtgtatgttatacttcaataaaaagttgggctttgtgactagcaaaaaaaaaa

SEQ ID NO: 652351 - DNA, 142 bp, Homo sapiens
ctttgtccatatgtttgcagacaaccctcctcgagcctgtctttcccactcaccttcttcagcagcacaatactcattctcagcagctgtgcggcggttaatttcatctccgtacctacagcaaaggaggtcgccgggttgt

SEQ ID NO: 652352 - DNA, 699 bp, Homo sapiens
  misc_feature (556)..(556): n is a, c, g, or t
  misc_feature (699)..(699): n is a, c, g, or t
cttttgggcaggtgtcagcgcccgtgtcaccgtcacgttacggacatggtgatttcagaagcgtgtggatatactctgcatactaagaggaggccttgatttgattgttgagctagctactcctaacgaaatttttctcaagatggcactcaaacatgtgttgagtgacctgccaactaagctggcttcaaacgcccttgtgttcaaaatttgccacagttcagaggatatatggcctagcagggacataaacaccattcctggagaactgactgaccgcttgtgcttgtgagaacatactgcgctttattcaatgtgcgccagacgaagatatgagcagaaatttcctgagaaagagggacaagacgttatcagacatgcatcacatagtcaatatagatcttatgctggaaatgtcaacctacctggcagctgtaacgcccatcattgaaagggacagcgtaggacaccattatgttaatatgactatacctgccaatgcagctatatctgttgctacagaagaaacatggcgaaaagttcgtaaactcctgtntgatgcaattcataatgaactaactgacatggttgactttttattccagggctataaggctggacaattcatatccttcaggaatacaaatgccggctgcagcctatggaaggagtacatgatcttttatctgctacgaagan

SEQ ID NO: 652353 - DNA, 363 bp, Homo sapiens
acgcatatttaagatgtgataatggctggtgaagataggtgggattattagtgaccgatattagcagatgaggcggtattctagctgttatgctacttcctgttgtttatgctgttcttctcccttgtatcgaggcctgcatagaggcattcatcaggatattctcctgagtcttcttagtagcttgaaagtttgaacgtgattcagaagagggtctgtgggaaaatctggacttagtttcatatatagtataagatcggcatctagtccatatttggccccatatatggaacgacatttatttcaacagtcaaatctataggtcctttctattcttgctgcgactacagcagctatgagatc

SEQ ID NO: 652354 - DNA, 983 bp, Homo sapiens
gtcgatcagatcgatctaagatggctgactgttgaaccggaaatcacccttactcgtaatcccccgactacagacagagcgagaaaatggaatctaatcaggagttggctagcccagaacactattagtgtaatagcatctcccgtacagaaccatgagtgtggcatcatcgtggttgccttagaagaatgatcaaatgcatagaagtttggcgatggctagacacctgcgggctgtatcgtcctaagttcccgaatactgttgaccgactttcggtgctctgtacatgccattatccagttgtctagtcatgtatatgcctggctgttgactactcactgtctcaagtgatggtattgaagcctatctgtgggagaggactgtggagatacatcgaacatcggggcacggacgaatggcatatacttacattgacccaaacagcagagacgaaggttgagctcgatcggtttatgggtaggagaaaaggtcctgggccttttgggaggacctctttggatgcctacgggtgactcgatcgtttgggggccgcgtgttgttaactgtgagagctagaggtgatcaagattggcaactttgtactactggactgtggacccgacgacagctgtcccccattatagggagggtattcgggggacaggttaggaccttcctccaaagatagtgcttggttatcagccccacggcgaccaagttactaagagcggtccccccacttaacatggttgtggtgcagaaacaacgttttgggtttccacaaagagaccgggtcgcaggcaccggatttgtgagcgacccaggcttttaaaggcgaggtgctgcttcaatggctcccctacagtctcatacgcgcgaggcttggtgtgtgtgtcgggtcgtatttgggcgaacgccaccaaaagacggcccacaataggtccgccatgagagctcaacctcaccgcagccgttctacggtg

SEQ ID NO: 652355 - DNA, 986 bp, Homo sapiens
  misc_feature (402)..(402): n is a, c, g, or t
  misc_feature (701)..(701): n is a, c, g, or t
actctgggtcctgagtcaaaggaagacaagcagggcatactctgggctgagactgttgaaggaaaaatagctgaaggcaagctagataaaaagcattgtcaaacaagcagaaaacagcaccaaaaagcagcagggaggaaactggggcagtgaacaaagctcaagtccaaacaagacgcacagaagaagtaagagccaacaaactgcctttagggttccagcagccacaggagagtggcagtagctggcttcatccgtacactcaaagctcaaagcctaatgcagcaggtagtttcctaccaacccccagttcacaagtaaaaagcagaggtctcagtaattacatgactagcgcaacgtcatgggctagtaagtatccgttctagaacttgaacccaggtntggctgagagcaaagcccatgttctcagtctccatatgataaccagattctgactgagtcaatgaagaaaaaaaggagttatcaaaggaaatccaaaaggaatgaccaagattgagggtgatgacaggaaggcactacccaggaccgaagtagtccaggaagggcatcacagcaaagacctgagaaagggtcagagcagagttccacaggcttagagatggtgggatcatgaggagagagaagtcaagtcttcaaagtggagcagtcaacaggatgatgagtgacagtcaaattcttgnagagctcctaaaggtctgactgtccacagtagcccagagagaggacactgggcatcagtcagttcattcagcaacaaatgtagctaataatgggacaaacctagtcatgccccaaggaacctgacgtctagcagagaaaacagatactgacagactctacacagtgccaaacctgagagagactggtgtgagcagcaacagtgggcagaagcacaggtcagctccctggctcacacccaataggtgtcctatctgtgagctctgacagtgtagctaactgccagg

SEQ ID NO: 652356 - DNA, 156 bp, Homo sapiens
agccagctctccatgctcagtatgagcagtaaccacgaaactaggcaattggcacatcagcctgatcagagatgcatgggaggtctatgtcgtaagtgtaaattctaaagagctaaaggatgaatcaggacagtgatggaatggatgacatcatca

SEQ ID NO: 652357 - DNA, 315 bp, Homo sapiens
gtttcagatgcaggagtaccgggcgtccttcaacacttcgaaaggatcatggcgggcgctggggccgagagttcaagggctgcctcatcagcctggctacgacgtggaagaacgaccggccaggtgaggccgagttcaaaccgcatcatgagccttgtcgaccccaaccatagcgggcttgtgaaccttccaaggccttcatcgacttcatgtggcgggagaacacccgacacggacacggctagaccaggtcatcgcttccttcaaggtctaagcaggggacaggaacttcatcacagctgagggagctgcgga

SEQ ID NO: 652358 - DNA, 441 bp, Homo sapiens
  misc_feature (8)..(8): n is a, c, g, or t
  misc_feature (20)..(20): n is a, c, g, or t
  misc_feature (66)..(66): n is a, c, g, or t
  misc_feature (114)..(114): n is a, c, g, or t
  misc_feature (123)..(123): n is a, c, g, or t
  misc_feature (128)..(128): n is a, c, g, or t
  misc_feature (141)..(141): n is a, c, g, or t
  misc_feature (182)..(182): n is a, c, g, or t
gaattttntgcctgaagggntccaacttttcccgctgcttttcctgctgaagaccagtgggaaacnaattgcccagttcctgttgacccgccccccggagtgcccaactgcctntgggctgcntggcnttaaaaggacacntctgtcccattggtcagcttagggccctttagcacccacancgcgtgactgagaggagagaggtggaggaggagggattgtcctgctcagctagagggagataaagagcagcctgggagcttggagctcgagcctgggaacagatacagcttttgatgtatgaggaagatcaaaaaaaattgtattaagtttctgttctgtttttcatttctaggaaaatacacctttaatgtcatattttctaatctaaattcttgtaccatcttctttggaaacgattaaagtactactcattttaaa

SEQ ID NO: 652359 - DNA, 213 bp, Homo sapiens
gctctcagcccttccctgaggtgcctccttggaccggggaagtaagccaagccaagagagatggaggtgcccttggggggggcccttggacctcctctaatcgatcttccctcctaaaaagaaagttaagggcgctgctaactcccctcgaagcctcgagaccagcttgcttgggggaagatgaaaaggttgagccagagcgactggctataa

SEQ ID NO: 652360 - DNA, 162 bp, Homo sapiens
tgtccatggctatagtcattataacttaatggccatggaaattcttgaaatccccttcgatacttacacatacactggaactacttatctgataccacagagcagaatgtggattatgagcctgtacgtatcagacattatcatatatcaaaaatttaactg

SEQ ID NO: 652361 - DNA, 257 bp, Homo sapiens
  misc_feature (5)..(5): n is a, c, g, or t
acatntatcccacccagaaatacacacctgcccacctgccaccaactcctcaaacccaaccaaatgagagaaccttgctcaccagaatcctactccctcactcctcaccccaccccctatcccagaatcccacctagagactctctccacccttctcagaattccagtttcaaccagaattccaaccaatagactccatcctctaaattctaaccaatgaaatatctccctagcaagatcctcttcttttcccagag

SEQ ID NO: 652362 - DNA, 477 bp, Homo sapiens
ctgtatacgtagggctttcatctagcatggcataatacgacaaagtcagattagggtcagttcagctgatttatgtccttctcaaaaaagttattacagaaggtatatatcacatctgacaggcatgaacttgacatgattagctggcatgatttttcttttttttcccccaaacattgttttagtggccttgaattttaagacaaatattctacacggcatattgcacaggatggatggcaaaaaaaagtttaaaaacaaaaacccttaacggaactgccttaaaaaggcagacgtcctagtgcctgtcatgttatattaaacatacatacacacaatctttttgcttattataatacagacttaaatgtacaaagatgttttccacttttttcaatttttaaacacaacagctataaacctgaacacatatgctatcatcatgccataagactaaaacaattatatttagcgaca

SEQ ID NO: 652363 - DNA, 102 bp, Homo sapiens
aaagccaaggccccccttttttgcctagggtgaagcccagtgggggggtcccagctcgctccacccttgcccccctagggtcaacccctcccccccccttta

SEQ ID NO: 652364 - DNA, 1136 bp, Homo sapiens
  misc_feature (336)..(336): n is a, c, g, or t
agcggagctcactctgctgaagggctgagaggcgcacccggtcggcagttgggctcggagcggcaacggggtcaggatggacgaagacgtgctaaccaccctgaagatcctcagtctactcggcgagagtggggtgggcaagtccatgctctgagcttgaggtgacacacgatgactacgtattgagcgcacagacttgcagcgaacacatcgtgtgtcgacgtttcagcgtgatggactatttccacgtggggtgttggcacttatgggtaaagctttgccctactggggagtacgttggcgggggcgataagaggagggttgtataagcgattntagatccccagacgtaattatatgaagggtgctacacggggtggttgatagtatagtttattgatggtcttcacagaaagtagatagtatttttgttgcaagacctcgtgataatttgtgggcacacttggttttggggggaccaatatcgtggtgaccaaggagagagtggacgcattatgtagtgaggagtgtgttattgggggggaacttaaaagtcggcagtaagggggaaactctggtggagaaggtcgcagtgggaaaaatgaaaaggggcgtgtagaattttttgcgaccgcaaaaggacgagtttccactggtttgatgtttataagcaggggcgaagggtggccgaaaagaacccctggttgaatggtggtgtgtacacccactgtggccccttttggaaagaaaacttttggtttgaaaccaaggagttcactttcaagaacccccctgggagctgctggggacaagttggggtaaccccgaaaataaaagggggggtcaaaacctggttcgacaccactggacataaaaggtccaccgggagggagagggaagccttgtgggggggggaataggcgtcctgcgggtggataaaacctcctgggggagaagttcccatactcgttggcggtcttttggaaccacaattcagttgagcagtacttttctgtcgttttaaaaggcctttaaacctgctattataagagggaccctgcagagttggcacgtaattggttaaaataccattgccggacacaaatatttggcaggaaatcccccccaattgaccc

SEQ ID NO: 652365 - DNA, 172 bp, Homo sapiens
attctgcctctgcttctgcttcctgcttctgctccttgggatgtgcttcttccactccgttgtacctcactgaccctcttgctctatgtctgcctatgtctgatgattaatcattagctctggtattactacccaaccacaagatgagcaattgatgtctgtaagctggatg

SEQ ID NO: 652366 - DNA, 878 bp, Homo sapiens
gcaacaatcccttctcttccctggccgggaactccgacatgctcatcctcccagcctctgcggactgagaatcgatgagcccctccctaacccctggagccctacggccgcactgccaggcacccgcgtccttgttggtagagcaccgcgatgagcgcacagagtgagctgatgcactacccccgttgtccgatcaactgcagacttcgctacgtagtcggtccgactcctgttgaacgtacgccccctagaccaaactgcgaaaaccctcccagtcccagtgatgtaaattcattcccccccctggccacaaaccgcccgaaccgtccgcccccgcaggcgctcagcgggatcgccgtacggccacacttcgcgccccacggcgcagacacagcgtatgggccgtggggacacacctcagccgtgcccacagcgtcatacaagaccccggtttcaccaaacatggcccgagcgcacgccgcacattgcgcaactggtccgaccgcaacccgtcttaatgctcccgccaaggaacccctcgcctctggaacactactattgcctgcgagtcacccatcccaagtatagttggcactgtggggctccaaacaatggcgtggccccccggacagtacatatatacagccactcggacgtgacacacatcgccgcggcgaaactccttgggcgcaagctgccaacgcagaaggacgactcaccaggcgactcgtgcccaaagacaagtttcgacacccaaggaatgcgtaataccactgacctagacgcccaccagcagagattgaccagagcgtcactcccacccatacgcgacgggattcacgcaatgccatccacaactgacacctatatgtccccaa

SEQ ID NO: 652367 - DNA, 225 bp, Homo sapiens
aagccccccccccaggggggggatttggttttgccccctttccccccggggaaattcccccaaagggggggggggggttttttaaccccctaaaccccatttcctttttttaagggaggctttttccccccctttttgggggggttttgttttccccaaattggggcctgttatttgtataaatgccccccccctttcccttaaaaaaagggtttttggggccca

SEQ ID NO: 652368 - DNA, 278 bp, Homo sapiens
ttcatcatgcaggtcggtgttttaatctgacgcaggcttatgcggaggagaatgtttcatgttacttatactaacattagttcttctatggggtgatagattggtccaattgggtgtgaggacgtcagttatatgttggggattttttaggtagtgggtgttgagcttgaacgcttagcttaacttggtggctgcttttaggcctactatgggtgtacgatttttacctctctctaacaaggttttttcctatgtgtccaaaagagctgttcctcttg

SEQ ID NO: 652369 - DNA, 213 bp, Homo sapiens
cacactgcaatgcgtgagtatccatattcatgcaccaagcaggcattcttcttcattggcagcatcacagcagtctccatttgtcacctgcctggactgcagtgcacataaacacggcttgctatagccttgacctgctaggctcaagtgatcctcctgccttaaccccttcaagtagctacaggtgctcaccaccatgcccagctacttttt

SEQ ID NO: 652370 - DNA, 258 bp, Homo sapiens
  misc_feature (49)..(49): n is a, c, g, or t
ctccatctaaaaaccaaacacagcacaactaacaaatcaaagcgaagcnttggtgattgtatgctgcagcgccagcaccttcccttgatgctatgaatagagctatgagtgaaattatgaggtatctttaaagaaagggcaaaagtggtcgaaaatttaattggtttaatattgtactagggtatcatctgtgcgagcaataacaaggggtatatttacctttagaatagcttctagaatatagactaatctttgaaa

SEQ ID NO: 652371 - DNA, 141 bp, Homo sapiens
gacgcgttctcctggactatctatattagagtcacctagggcctggtcagggctggcttaaagggcatgtggtctgtgcattcacatggagccacctgccaacagggccccatatttagtttaaccccctgctgttaccat

SEQ ID NO: 652372 - DNA, 321 bp, Homo sapiens
acaggccttgctacagcatccgtccactgctgtgttcatccgacgtatgatggcctgccaacccgaaggtctcgcgctcgcttctggtaggatgtccttctggtgctgccgtggggccgggtcagtctggcccgggcgattgttgtctagaatgggcacgaggttgtgcagcttatagatgctggcgaaggccatggcctcccatacagagccctctgagagctccccgttctcccagcaagcaatagactcggtagctggtcttgtcgaagtatttggcggtgtaggccatcccacaagcggcccctaggccctggccca

SEQ ID NO: 652373 - DNA, 203 bp, Homo sapiens
acttacaggcaataacattaggagcacactcagtacagctaacagatcaagtgcaggttcctaaaggtgggcttgtgaacatcccgggcctttcagttttaaacgctggacatatgaatatttactgtgtatctggttttttcatggcaggctttggatactcggccatgatatttcatgttttttccttttttttatttgag

SEQ ID NO: 652374 - DNA, 313 bp, Homo sapiens
tgaagtcaattgagtaaggacacctccagccatccagaaaccaacactgtctgggggccaaggtctgacccccatgttaatacaaggacgattgttcacttcatcacggaacacagcatcattatgcaatatgaaaccagccaactgccttttgtgcggtctcctataggaagtatcgcaattgttttgtcctcatttctcgtagtctaacccttttaatgcctttccctcaacttgttcgcaccacaactatctttgcaaaaaaaagtaaagacaaagtaaatgatggtttacaaaatccaccaaaaaaaaa

SEQ ID NO: 652375 - DNA, 207 bp, Homo sapiens
gaacgcaacccgtgaggcgttgctaggcgtagagattagacgggctctgggactacgcttcggagcccggggagatcggctcctgtatccttcacggtggtccgccagggcttccttccttgctgttgggagctgacggctgagggacgcgactgccccagccgcgccacgttcgagacttgtgtcagtcaccaggccattcaacgg

SEQ ID NO: 652376 - DNA, 259 bp, Homo sapiens
  misc_feature (88)..(88): n is a, c, g, or t
ggcagctagaggatccgtatatggttgctagatctctagcaaggctggagatctagacaaccaatacaagaagtacaaagagcactgngaaattcatcacaaaaagattatcgtctaagcacatagtcatcaactcatctaatgccaagacaaaggaaagaatcttaagagctgtgaggcaaaagcatcaggtaacctgtaaaaggaaaacttatcagattaacagccgatttctcagcagaataccctacaagctaca

SEQ ID NO: 652377 - DNA, 314 bp, Homo sapiens
tttggtttttttgcagttccccagccctttgtttgcccccttaaactttgtcatggagaaagtggagagcatcctcccctccagtttttggccccagctaacccgggttttagagaagccctgttctcccctcacctcccccgccgctgcccccatttcctttgtgcccactccttgtgggccccaaaaaagcattgcttttaaaaagggaagcccttccgagatttttaaatgttcatgggcttttccatttttaaaactgttttttttgtccaaaattcccttatgttccgttttttttttttttgccttca

SEQ ID NO: 652378 - DNA, 268 bp, Homo sapiens
ttttttcctgtttaacccccccaaataaagggggctaaatagggaatgattttcctagggcctttgcaaactgtgataatcctgggccctgccatagttttaccgggctcttgggccttgaattattaggatgtaattggacctccttgtagggttccccctatttaagccccctttgatgttaattagcttcgggtttttatgcttgttttaagatcccccgttttggatgggaggggaccaagctaaataaatgtttgtttggtga

SEQ ID NO: 652379 - DNA, 129 bp, Homo sapiens
ggtttggtgggaactggaggatccagttgagtagggccccggtttaaggagaccaatagaaactgggcttgtcgagacagagaagactcttgcgtttctgataggcacctattggtcttacgcggccgc

SEQ ID NO: 652380 - DNA, 1035 bp, Homo sapiens
gctctttggataggaaggatctagcgcatccatatcctggagctcctgtgtgagactgtctcagccaatgctgatgacttctccccggatgtctggatcaagtcccatgtcctggctccaccgcaatttagacacagactagactggactgtgggcctgaggcgtgaagagcttcttcgaggggcacttcaatgtgtgaagtgccaggacactagcatttattgagatctgtaagcttctcagaagacgagtggacctcccaggccacacccgagggtacggggctggcacggtggcatcctggcgctggactggagtgctgctgcgtctccagacggcatctacgagagaggatgctgtctctcttggtggtggacgtgggcaatcctgaggaggtcagacgtgacagcaaaggctatgctggtggcacctggtgcaagtcatgccttggtagcagccctcaggagtggcagcgccttcaccagctgaccaggagactgctggagaagcagctccgtccagtgtaccttatagcctggaagtatcttcagtccgaaccccataatcaagctgaagcaccttgaccaggagttgcaactctccgtactctacctgaggactatacaggtacaatctgcagcatagctgtcgtacataggattcctctggcaaagctggaacccacgtggtcaaatcctctgtggcagtctgacccgactcctggactccaatcagggcgatacaggcagataggccacaggcgctaaaacggacccagagctaggatcatgacacacagcacagccactgaggcaaacgagcccagggggatcctgcgcaggctccgtgaaccaaccaagggaccaggcaccaacccgggaggactgagaacgcaccaatccagcgtgacagccaaggagaacaccacgtacggtgcacagacagacactcgagcacagacacagcccgctcagtaacacacaaggagaccaaagggacacagagacgcgttaccacacgccacggcgcagcgcc

SEQ ID NO: 652381 - DNA, 333 bp, Homo sapiens
gcctgattcccgcgtgacccggatcgaaggttactggaagtccgacttcgcccactgatccgtccctgagacccgcgccctcaagcaacctgatgccaggggcgctggtgagcacatctgatatgaacgaaaccgtgcaaccgatggtgatgactactcacgcgggcgatgtgagcggtgacaaccgtgctgctcgcgatcagcgcaatgacctgtggttcaaacgctccatgttcggcgctgccatgctggtcttgctgttattggccagcgttgctgcctcaacgctttggggcggcggctggccttcaagacttttggtttcggtgtcga

SEQ ID NO: 652382 - DNA, 129 bp, Homo sapiens
  misc_feature (20)..(20): n is a, c, g, or t
  misc_feature (32)..(32): n is a, c, g, or t
gtcctttagttaatcgcggntccagcttgagnggggcaccggtttaaggagaccaatagaaactgggcttgtcgagacagagaagactcttgcgtttctgataggcacctattggtcttacgcggccgc

SEQ ID NO: 652383 - DNA, 136 bp, Homo sapiens
  misc_feature (19)..(19): n is a, c, g, or t
  misc_feature (67)..(67): n is a, c, g, or t
ctgctgcagtgccgccttncgccccgctgccgtgcccaggctcgccccctcctcctcgtcctcggtntgtcgctcaggacgcgccgtcctgcatcaactccttcccctccagcgcgtccagctccagatccacagt

SEQ ID NO: 652384 - DNA, 430 bp, Homo sapiens
aagagatgggatcttgctctgtcatccaggctggagtgtagtggtgcaatctcggctcactgcagcctcgaactcctgggctcaagcagtcctcccacctcagcctcttgagtagctgggactacaggcgcgtgccaccatgcttggctaacttttcgtagcttttgtagagacaaggtctcacttttttgcccaaggctggttttgaattcctggcctcccaaagttctgggactataggtgtgagccactgtgcttggtgctgttgagctcttgataacttgaggcatcccctttccagtcaccttggagatagttctgtctcccagaaatgggctccttatgaaacccaccccattccaaaatggaaatctggaatccaaatactgtttgaaaaaaaatggtaatctttttcccaaagggaatttaa

SEQ ID NO: 652385 - DNA, 487 bp, Homo sapiens
tagattgctgtgtaaattcttatacagcaatagaaagcattctaaatagctgctagtctgcctggtctcagtattcatttattagagactgagttctgtgattatttgaccctattaactttggggggtggggaggaaggaattattcatgaattttggactacatcagaaatctgagatatccaaagccttggtactgtagctcagggtcaggggccagtttctatctgtagtgtacctgacttatggttatcatataaacaagccaggagatattctaaggagaagattgggtcctttttattgaacccaggacctcacatgtgttatgcaagcactacaccaagctgtactccaggcccgtgaaaggttgagactgggttagcactatttccaaagtcacaagacctatgattgcttcattaagattgtaaggttaaccatggcttaaaaataaatggttttggtgaactactaaaaaaaaaaa

SEQ ID NO: 652386 - DNA, 1508 bp, Homo sapiens
tgctggtgtgtggtgtgggctggtgtcgtggtctgcatgtgatcgttcggatggttcgctttctcgcgtcatttcgtgtggctgttgcgcgggctttatttgtcttccggggggggtacgcgtcctgtccgttgtgtgcacagctgtacgcttggtggttgtgtgtgtgcccccttgttgcctcccactgtgtctcttgggtttctagtctctcctcgggttgggtggcgccgcttgttcctcggggtgacgtgttccaccaatagtgggtttgagtcagcccctgtggtcgagggccagtgtctcgcctagggccggtttccgccgtgtgtgtccccacgtagaggcgtgtcgcccacagtctgtttcggtcccccgggggtcccccggtaggcgtctcttccgggttatatcctcttgtccccgggcctctgggatgccccatcgcccttggttgggcccgctatcccagcgttctcggttggtgagtatctggggaccctttggattagggccggcgtttcttatccggtgcctgccatttgccccaaagttcatgtccttggagccacggggctcattcatgggcctagtctagtttttgtggacgcccctttggggcgcagcacacacgtttgcccagggcatctgggcccttggaggtgccccccgcccccctgggtggctgttcttgccccaccaggggtttccgcttgccttgcatggctctttgtctggcccacccccccccagggcccccttatactcttgtctgtggttccccgttccccgaacctttgcctctctgagcccctcttgtctgttactcgggggtcccccccttggtgaactgtttctccacgcttctatagaagggtatgccctcgcacctcaccctcggggggggtttctgccacggcgctgtctctcgggaggttttccccacagggccccctcttgagaggccccccctctctcgtgtgaagagtttgtctccactgctgctgtgtctctgggggagcccctctacagagagtgtgtttgtttgtcaccctcgtgtgcacgtgtctgcactgttgtacgcctctttcccactatggtgctcgattgggtcctcgcccaaatttcctcgcctcgagtttctcgggtgccctctctgagcctccccacaaggttcacggcttggtggcttgagggttcttccctcgcttctttggtggcacgctggtgtgcacgccaccacgcacgcacgcacgcagctagccagcagccacccagagacacttctccccatttccctctagaccccttctgctcgggttagaagaggccactttcacggggacttccctccccagctgccttcttcatactgggaatagagcttaaaccaggctgagcctcctcctgttgcttgtaaataatgatgatattaaggctggatttggagatttgtatccccggtccctctgggatgctccatttaaacccttccccctcccttggga

SEQ ID NO: 652387 - DNA, 374 bp, Homo sapiens
ccgttgtcagtgagccaagatcacgccattgcactctggcctgggcaacaagagtgaaactctgtaaaaaaaaaaaaaccaaaaaaaaaaccaaaaatttccccgatttaccccctctttttataaaaccaaaactttttacccaaattttgggggaaaggaaaagggttttttttatttaaaaaagggggccttaaaagaaggaggggtttatttttaggaggcaaatttgctccttttggaaacataaaaggttggaattttggaaactaaggggggagagggggacccggggcctcttggattaaaaggccttcttgttttaatgcagggcctaagattttttaaggggacccgggctcgaattcgaaata

SEQ ID NO: 652388 - DNA, 104 bp, Homo sapiens
tctgacgataattcaatagctttagctatgtcttcatcctctttgtttttgttcgatgacgtaccattcttggcagcagctgagacagtctgagaacctgctgg

SEQ ID NO: 652389 - DNA, 389 bp, Homo sapiens
tgaggtatgagctgagagtcaaacttaaaactgtaaactccggggtctgcatccttctctggtactgtcagagaacactcctccgccttgtattttaaaacttcttttcggccggtcgcggtggctcacgcctgtaatcccagcactttgggaggccgaggagggcggatcacgaggtcaggagatcgagaccatcctggctaacacggtgaaaccccgtctctactaaaaatacaaaaaattagccaggcgtggtggcggcgcctgcagtcccagctactcgggaggctgaggcaggacaatggcgtgaacctggagggcagcgcttggtgtgagccgagaccgcgccactgaactccagcctgggcgacagagcgagactccatctc

SEQ ID NO: 652390 - DNA, 144 bp, Homo sapiens
gccttcatttgaataggaatcagcccctccctgtaattaccacatcatcttactgttgcctgtgccttcaccagactgtaagccctggagggcagtacctggtctgtctcattcatggatatagctctagctgaataatctcaa

SEQ ID NO: 652391 - DNA, 246 bp, Homo sapiens
ccctcatattgtcttatgcccaatttctgcctccaaagaaaaaaaggtaaaaactaaaaggcagaaatgaaatccacaagcagacagcccggccccacaccaagttcttggagattactctttggcagtgatcttccccctgcacttttctgatctaattactgtttaataccttatacccaaaacacttactaccaacacagctgttgtaactgaacagctgttgtaactgaacagggggatcct

SEQ ID NO: 652392 - DNA, 156 bp, Homo sapiens
  misc_feature (29)..(30): n is a, c, g, or t
  misc_feature (82)..(82): n is a, c, g, or t
  misc_feature (108)..(108): n is a, c, g, or t
  misc_feature (126)..(126): n is a, c, g, or t
cagtgatctgtgctaacagctgtattcanncttgaggaaaagtcacttcctgaagagaatggaaattcaacttgaacattcngaactttgcctacgaacataatcctngtatagtagggtgatgtnactatagtgaatatagaactaggacacagg

SEQ ID NO: 652393 - DNA, 507 bp, Homo sapiens
ctactacacagagctaccaaaatgaggcaggtcatatcgggtagctaacttagtgggagcaagcagaaggggatttgcaaatagtctgccccagagggcctgattcctggaactaagaaaatatgcattgtctttgcacccttaaaatggaaggtgctggattctaacgagacaagaaaggcactgctcactgctcctactaacataccgaagtaaggggttaagtctgcctgggcccaagttccctccggaatgcaggacaggtctggggttctggcctgctgctgttctggcttatcaagggtgcctctgctctaggtagtctccacagcctgtctacaaccagcccagacttcgtgggtaacagcagttctgattttccttacagattactattcaaggtcgacttccaaacaaagggtgtgaatgatggaagtgaaccgtgagactgggaaaagggtgcagggctgaggggtgaggaggaatcagcggggaaagaagacccgt

SEQ ID NO: 652394 - DNA, 183 bp, Homo sapiens
ggacggatgaggcagatcagaaactgggggaggcctcaagaagggttacaacgaatggagagcagatggccacgtggcctgctctgtcttatagcgtcacaagccaggagcaagccgcagagagagatgctgttccatgctggcctgtataggttactttgctctgttctattatctgtcccc

SEQ ID NO: 652395 - DNA, 121 bp, Homo sapiens
ataacttttattcttttggcagagcacctgtttaagcatgtacccctagtgttaaagatttgtgtcctctcattccctctcttcctctgtaagtgcccttctaataaacttttcatggaag

SEQ ID NO: 652396 - DNA, 694 bp, Homo sapiens
taagataacagggggaagataaaggaacctatttggtggtgagagttttacattctacttgaactagtaaaatattgattgtatgtagactatgaaaagttatatatgtagactgtaatctttaaaagggccactaaaaaattattcactgagataattaaaaacacattaaataaattaaatttaagcattaaaaatatttaaattatccaaaaaagtcaaggaatagaaaacaaaggaatgaaaaatagagaaaacaaataaaatgggagagctaaattcataataattatattaaaagcaaatgatctaaatataccaactaaaacatagagattgttaggatagatggattaaaaaaataaaccaactacatgctatgtacaagaaactcacttcaaaggaaataatataggtaggttaaaggtaaaaggttagaaaatgatacgtcatgaaaacactaatcaaaagtaaatggacatgtttatattaatatctgacaacattccatcgaataacagcacatgaaatattcctttttaagtgcaaatgggaaattcactaagatagattatattctggggaaaaacaaatttaacaagttgaaaagctgaaataataaaagatgatctctgaccacagtagaattaaactagaaataaatctagttgaaagatatcacgtgtatagaaat

SEQ ID NO: 652397 - DNA, 136 bp, Homo sapiens
  misc_feature (2)..(2): n is a, c, g, or t
cnccgaagaaagtcacaaatacatatcaaatcatttaatacatatacatttgcgaatcattgagggttgctacggctttgaaatttgagactacttctttatctgtgtatgtgctttacacttgtgtcattgcaat

SEQ ID NO: 652398 - DNA, 394 bp, Homo sapiens
ggtcggtacgcaggtgctgcaataattaaatcattggaactaataaaaaaaagggcactcgtgattaaatggcattacagcctgcgaggacacctggggccagctgggttttacgtctagaatttgactggtcgccccaccccacttcttccaccccacttcttccttcaccaacatgcaagttctttccttccctgccagccagatggatcgcacagatgggaaaggcaggcgcggccttcgtggtcagtagttcttcgatgtgaaaggggcagcacgagtcattgtaaacttgatccatcctcttggcttcttacaaagttagaacagctaaaagacgtacgataagaaggcaaggctggtggaatgtacagtgcatatgggctgcaccctg

SEQ ID NO: 652399 - DNA, 133 bp, Homo sapiens
ctcattctggtggttgagtgtacggagggtgctattggctggctggcctggggttggaactgagctgcctgtgttcctgtccaagcactgttgaagcagtgaaacccctgacgactctcaaccacctgtggac

SEQ ID NO: 652400 - DNA, 894 bp, Homo sapiens
tagcatcaacataaaattaatagattatattcgacacaaataagcgggccttgttagatcacttctatcgataacttttgataattagtgagtgtggaaagcaaagaagtcacaggtagggacatctagacaagagtgactcacacacaaggaatgtgttccttcttttattgtgcgtcgttttaacctgactgaatacaagatcatcacgagcactgcactcctggcaatgattacatacgttagaacatggatattgctctgtaaacaacatttaacaccattctattggggactgcattgctttttatcaaatctaaaatatagattcatttgacaaacaaaagaacaaacaaaaataatattactacagaaactaacacactctacttctcaatccaacaaaacagcataaagacgaaaaacttcgtctactacatcagttttccatctcttctcacagcgaattcgcatagatatgatttaattacatgctctaaattcacgccaaaacgtgatacccccacgatacccaaacacattagacaaggatcacatcccgtttcaataacccacaaattcctattattctatctgaccttcgtcttaatacctaacagccacggtaaaaaactctatgcttgaccagtcaaccactgggcctaattagtacccttaagacatactccttaaccatcatttagtatatatcttacatccatcttcaatatccccaccaatatcgtgttaactcgcattatcgtctacaatcaggtaatttatattaagacaatcagactctcattaggcttcggtactgagtcagacatacaatatacttccaactcacgcagacagagctacatgtcgcgcgatattcactatgaatgacct

SEQ ID NO: 652401 - DNA, 252 bp, Homo sapiens
gtgcagacctatgccacagacttaaaaactgacaggtttactcagtaataagggaggtctatgcgaaactcagctggaggggaccagcaagccttacaggttcgctatggtcagaagatgatctttacatcagttgttggagctgacaggttagcagtttccctgttccctgagggacagcaataggacctttattctagctaatactcatggaggtttgaaaaggggaaatttgggatctcttggctacta

SEQ ID NO: 652402 - DNA, 119 bp, Homo sapiens
ttctactactattaggacttaatcgctgcaaagcgagggctctcaaatcatgaacaattattattattactgctgtgcgagaaatgaatgagcctacagatgataggctatttcatgtg

SEQ ID NO: 652403 - DNA, 586 bp, Homo sapiens
  misc_feature (128)..(128): n is a, c, g, or t
ggcttcctttttctttctttttaaattttgtgtgttaagcaatcaagaggtgactctgttgatttgcaatttgatctaatccattgttccacagggctgtctccccttggatcacaccctttctgggnttgctggggtcacgggatcatgcaggccaagagtgggggcctttgtcctatcctcagtgttatcacatcagggtcacctgctcctagtagctgaatctggtcatgagcatggtttctggaacacagcaggctgggtggccagtggcaaggcactgatttctctgtgcttgggtttcctcttagataggaaggttgaattaatggggcctggcctcctagggtaagtataaggattaaggagttgatgtgtatgaagtgcttaggacagtgccttgggcagagtctgtgctacctaagtattttctgctgtaattactattaaaaaccactccaggccaggtgtggtggcatatgcttataatcccagcacttttgagcccgaggtggaaggatagcttgaacccaggaaattgagaccagcctgggcaatatagggagactccatctctacaaaaaat

SEQ ID NO: 652404 - DNA, 546 bp, Homo sapiens
  misc_feature (54)..(54): n is a, c, g, or t
tacaggactcacttaacgccaaactcgcgaattgagttatacaaaaagtatatnttggttcatctgaccatatgactgacattctcccaatattcttctggatcatccaaatgctctctagcaaacttcagaagggcctggacatgtactggcttaagcagtgggacacgtctggcaatgcaggatttgagtccctggcggcgtagtgttactgatggtaggcttttttttactttggtccagctctctgcaggtcattccataaggtccccccgtgtggttctgggacttttgctcactgttcttgtgatcattttgaccccacggggtgagatcttgcgtggagccccagatcgagggagattatcagtggtcttttatgtcttccatttcctaataattgctcccacagttgatttcttcaaaccaagctgcttacctattgcagattcagtcttcccagcctggtgcaggtctacaattttgtttctggtgtcctttgacagctctttggtcttggccatagtggagtttggggcgtcaaga

SEQ ID NO: 652405 - DNA, 468 bp, Homo sapiens
  misc_feature (214)..(214): n is a, c, g, or t
  misc_feature (400)..(400): n is a, c, g, or t
  misc_feature (432)..(432): n is a, c, g, or t
  misc_feature (463)..(463): n is a, c, g, or t
ggtatttgaaccagagcgactccattttgagtgagggctgggaaaatgaggctgagacttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtnacatatttctggcaaaccacagaaaggatgatactgaagaaatccccccaaccccaaagaaatagactgcagcactgattggaccgactttgggtaagtgatggggtacccgaagtaacaaaatgggatttgggttaagaggcccaacttaaggggaatttggaatttccccctaaagaccagaantgagttaagaggcccctccttaattaaaaggncaaggacaccttgacctgaccttaaggggtngaagg

SEQ ID NO: 652406 - DNA, 450 bp, Homo sapiens
  misc_feature (165)..(165): n is a, c, g, or t
  misc_feature (386)..(386): n is a, c, g, or t
  misc_feature (427)..(427): n is a, c, g, or t
ggtttggcctcgctcccacgggtcggtcaggccctccccgccccctctcacctgcgggaggcggggcgggcacggctccaccggagccgcagccgccgccgccgcgccggggagggggagtgggggagggggagggggagaaggggaaagggcagaggggaggangaggcgggaggaggaggagtaggggagccagtgaactaggcggtcaggcctgccgggcggcgtacaatagcgcggctgtgggcgggggaggctgccctcccgcggctgcagccggagccgaaggtggtggctgcacagtagacgccccctcacggcttcccccacacgctcccgccccctcgctcgcccatcgcgcttccctcacaggctctgcagtcctnccccacagacgccttcccccttggactctcattcccttttncacggagccccgcgctttcgtga

SEQ ID NO: 652407 - DNA, 163 bp, Homo sapiens
gaggggtacatgagaaggttgctatacaggtaaagctcatctcacagggggttgttggtacagattgttacattatccacgtattaagcgctagtacccagtagtttgcttatttctgctcctctccctccctccaccctctagcctcaagtagaccccagtg

SEQ ID NO: 652408 - DNA, 200 bp, Homo sapiens
ggcgggggctaccactcacccttggactcagtgtactgaatcacatggggttccactctccgtccatctcttcactcccagtcctcgggattcttagcatcaggctcggggatatgctcgcggcttgtcccgagtcctcagtgcattgagagtcgtgtagggatcaatcgatcttgtggcccgctcacccctagtgctgc

SEQ ID NO: 652409 - DNA, 291 bp, Homo sapiens
tgccgactgcacaattaaaacagatccagtcactgtgagatcaagaggaattggatttgtgctttttaaagatgctgctagtgttgataagggtgtggaactgaaagaacacaaactggttggcaaattgatagatcccaaaagggccaaagttttaaaagggaaagaacctcccaaaaagttttttgtgggtggattgagcccggatacttttgaagaacaaattaaagaatattttggcgcctttggagagattgaaaatattgaacttcccatggatacaaaaacaaa

SEQ ID NO: 652410 - DNA, 351 bp, Homo sapiens
gatcctgtctttacaaattaaaaaaaaaaaattagctgggcatcgtggtgcacaattgttgccccagctagttgggaggttgaggcaggaggatcacttgagcttctgacctcaggtctctgcccaccttggcctcccaatcactatctttctataacccaattttagtatttatccttctcgtacgcctatatatatgtatacacactgtttatatttataaaaatagggtcacattataactttggaaacatgcttttgttgcttcatgtgttctctacatctttttttttttcttttttggagagggagtttttctcttgttgcccaggctagagtgagtccgtctca

SEQ ID NO: 652411 - DNA, 390 bp, Homo sapiens
ggcgactgtggagttagcgtcctcaatgtggaccgcctgagctcccattaggagcgctggtgccagcaggggactagcgtgagagttggctaaaaaaaagaaaagaacatggaggcagatataatcacaaatcgttgagcctgcatcgaagatttgtgattatatctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgtgagaaagtttgggctgcgaatgtgaggctgttatacgtacaacaaaaaatgcacctggagaaattggaagaacaa

SEQ ID NO: 652412 - DNA, 178 bp, Homo sapiens
atctcagtgcggtgatggtagcctttctgcccaggtgtgcaacagagaaggctacacgagcaggatgtcatgcccaatacaggcaccttgcgcaggcctcgggggtcttgcggagcgcttctgttgtgcaccaactggtgaccccttttagccttgcccttgtcaccccgatgacgtg

SEQ ID NO: 652413 - DNA, 255 bp, Homo sapiens
tggaccattctctaagaaagatcagtatgatgtgaaggcacctgctatgttcaatataagaaatactggaaaggacttggtcgccaggacccaaggaacccaaatggcatctgatggtctcaagggtcttctgtttgaagtgagtcttgctgatttgcagaatgatgaagttgcatttagaaaattcaagctgattactgaagatgttcaggacaaaaactgcctgactaatttctatggcatgggcccaacgtt

SEQ ID NO: 652414 - DNA, 514 bp, Homo sapiens
  misc_feature (6)..(6): n is a, c, g, or t
  misc_feature (22)..(22): n is a, c, g, or t
  misc_feature (47)..(47): n is a, c, g, or t
  misc_feature (72)..(72): n is a, c, g, or t
  misc_feature (170)..(170): n is a, c, g, or t
  misc_feature (198)..(198): n is a, c, g, or t
  misc_feature (475)..(475): n is a, c, g, or t
aaaganaaataactctcctctnaccaaaccaaatccccctcctaaanaactgaatcaccccacccaacccgnccccctccccctgaatcacctccttatttcaatgcccgcaagggtaaggaaaaaaattgtactcctcccccgggcccctacatggggcagggcggggnaagtggggttccccccggaagaagggantccttaagaagtcctaggcagggggcagtggctcatgccctgtaatcccactttgggaggcctaaagtgggaggatcacttgaagcccaggagtttaagactagcccgggcaacacagcaagatgcccatctctacaaaaaaatttaaaaattagctgggcatggtgtcatgcacccgtagtcccagctacttgggaggcttagctgggaggagttggagctcgagagttcaaggctgagtccaggagctggaggctgtagtgagctatgattgtgncgctgcactctagtctgggtgacatttttaagactctgt

SEQ ID NO: 652415 - DNA, 729 bp, Homo sapiens
ccgggacgtttctccccaacttccccagagaggtttccagagaagtaacacgccaggtccagtttagccttgaccatggacgcaagttctttggacccgggagtttgaaagaggggaccactggagaaatgccctccccgcgttatcctggagtgcggccaaccacgcgcaaacccagctttttttgccagaaggagacttctatccaagacccatgtaaagagtgtttgggactccccctaaggccttgatcaggattatggtttcccgctttctgggaattgacactggatgatatccgagcccttttatcacgaaagaaagtatggtatctccccttggccagacactccatcgggtggaaccccagggagattatgagaaaatcgtcgggggctctttgtggaggagaactaaacacttccccctgatggtttaccaggctatgatgacgggagactctttattaaatattttcatccttcataaggctttaattagggaagatttttttcacacacgggttaacaacgctgtaggctacctcacactgctggaaaatatagctctttaatcactttttatattataactctcgtataatagagataagatccctttttttaaaaaggtttcccccaaccattgaaccccatacacaggttgttttagtaaccaaacatgagaaagaagtttatgtagctggaaattaaaggcgtccccaggcca

SEQ ID NO: 652416 - DNA, 332 bp, Homo sapiens
atatgattctgaacccagtaggtgctggtcacctgtctagatgcgtacaacatcatagtgaacagaatcgaaaaagcaccccttagaggctgcactctgatcaaggagagacagtacacaacacaggtgttgtgggcagaagtgtatcccccagaatgcacacagcaaaagctaatgcctgtgagcagaaatgtatctcccagaatgcacacaccaaaatccaatttctgtaagcaaaagtgtatcccccagaatgcccacagcaaaatctactgcgtgtgagcaaaagtgtctcccccagaatgcacacagcaaaatctaatgcgtgtgag

SEQ ID NO: 652417 - DNA, 331 bp, Homo sapiens
  misc_feature (51)..(51): n is a, c, g, or t
  misc_feature (71)..(71): n is a, c, g, or t
  misc_feature (86)..(86): n is a, c, g, or t
ttttgaaagagatcagaggatttgtgttcctagaaaggaacttgaataaangaaagaaagaaagaaagaangaaagaaagaaaganagaaagaaagaaagaaagaaagaaaaaaagcatgtcattggcactcaatggggtcacattgtattcaaaagattctatacttaaatccatgagtacaggaatcaaggggtcatgggttcttcctccatcattacaatagcattaaaaccaagcatttttaatccctcaagcaagaaaaacaccagtaacccaaagtttgagccaaatttgaagtgagttttattaaatactagccaggaaaatct

SEQ ID NO: 652418 - DNA, 201 bp, Homo sapiens
cctttttggaacttggtggggctcaggaaacaggttctctccagcggggggctttcctttttgttgggggttttttgagggccccccttcatgaaggcccatgagtgactcctcctttgtgaattaattgctatatgtgaagggcctttgagaacaaatttttttcatagccttttccttataattttttttgttctgata

SEQ ID NO: 652419 - DNA, 335 bp, Homo sapiens
caccctcctcccacgtgcccatccgtcttcatggccttcactaatctgttttccatgtctacattttggcttttcaaaaatgttctatacatggaatcatgctgttgaaggacatctgggttgtttccagttctggctattatgaataaagctttgtgtacaggtttttatgtaaaaatctatgttttcctttctctgggacaaatacctgagtgtcattactgggttgtatggtatttgcatgcttaatcttgaaagaaactgccaaattggtttctagagtgtgaatcataattttaaacacattgtattataactatttctccttttaatta

SEQ ID NO: 652420 - DNA, 315 bp, Homo sapiens
tcctgcccatgtgctctcaggtgctacgatgataggctatttcttctgtattgcctaattagcattatagtagagctctctttactacctgattggtcgggtgtgaactaagctccgtgtttacacggtgggtgcagtcacccttccccagctaggcttaggaattcttagtcggcctaggaaatccagctagtcctgtctttcattatctcctgtggagaaaaagctgaaattgtggaaaaacagacacaagctcttatcatgtgagtggctgacatgaaatgaaaggtgcatgcacagtcttgccaggtgtct

SEQ ID NO: 652421 - DNA, 261 bp, Homo sapiens
tgatacaatcgagctcgtgtaccaggaaacagctatacgcagggccgtggtttttccttgaaggcttttacagattcagctttcactggcctccatgcactacctcccactaccacccaatctgcctgccacagcatagtgcaggcaccctgggtcccctggtggttgcgggaaggggctacagggcatccaggatgtggtcgatcttggtgaccagctcctggcgctttcctgagatgagcttctcattctcaatgtacg

SEQ ID NO: 652422 - DNA, 260 bp, Homo sapiens
ccgactggtctaaagagacccgggcaccaactggcaacgacttggacatctgagctgtcactgccgaacacacgccccaggaaagataatcaatatgcatttccaagcctttagggtatatgtgggtcttccgctcatctaacttaatgcaaaagctatggatgatgatgttggcacggaagactgtcaataaactacagactatattgaagttaatgaaagagaactttcctcacagatgagatataagacacctcagc

SEQ ID NO: 652423 - DNA, 468 bp, Homo sapiens
gaaaaaagatggaagtgcttcagcagcagcaaagaaaaagcttaaaaaggtggacaagatcgaggaactggaatcaaggaaaacgaagcagcgttaaaaaaaaaaaaaaaaaaaacaaaaaaaaaaagtttgtggtgggcgcgcgcccgggggccccctcaaaaaagcttttcataaacccattcgcgtgtgggggcggcgcgggggcgcccagttaggtgtatcgatgcaccctggtcggccattcagccgctgtgttcccaaagagaggagatcccggggggcctagcgacttatggtggtcgggggtttcctaccccatattaaaaacagcgccccgggggggcaccccggaggcgtgttttggaacaaacttcccagagagtggaggctccggggtggtccatcacggggttctttctataccaggggttccaaggcggacgtccgttttcaattatcgccccg

SEQ ID NO: 652424 - DNA, 257 bp, Homo sapiens
tttatatattctcgttttgctcttgttgcccaggctggagtgcaatgctgtgaccttggctcactgcaacctccgcctcccgggttcaagcgattctcctgcctcagcctcccaagtagctgggaatacaggtatgcaccaccacatctggctaatttttgtatttttagtagagacaggatttctccatgttggtcaggctggaggctggtctcaaactctgtcgaaaagcccccgaatttagtagtagtaggcgg

SEQ ID NO: 652425 - DNA, 133 bp, Homo sapiens
tactaggacctgatgaagtcctagttagagccaccaagaagttcacgacgcctcctcagatctcatagtgaaccacccgctctggtacttatagagggatcaccgcctcgttccaggtacagattattgtaag

SEQ ID NO: 652426 - DNA, 1642 bp, Homo sapiens
  misc_feature (1363)..(1363): n is a, c, g, or t
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcggagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaacacaccaaaanacgtcgggtctccgcggccccgggttattgtaggaaccatcccggcccgcgttatcgtaggaactattcgggcccgcgttactcgtagggtctggcgccgggccgggccccaccagacgggaatccccggcccaaatgggggccgaggaggtccttggccagagttttttgggagccaggccgggtggattggctcgccggggcccgtgttgttcctccgggccggggtttggtcccgaccggtcccgagggccggcccattgttgaccgcgggggttg

SEQ ID NO: 652427 - DNA, 983 bp, Homo sapiens
gcatagaactttatcctgcacctatcaaaggcttccttcttccttccatctgggcaacagggttctgactacttagaacaccagcactcagatgctgactagagtcattgtgttgcaagacccaaacctgggtcaacatcaggctcctgagatttgaggaagggcacctctcccctgccataactgctattttttttacatgtatgttaattgaaagagtttattatttcgttatgagccagaggggggaagcacattttaaatatgggaaataagttagcttggtttgtactgtattgggaaggtaatagatttttcacaagtgatttgtgccttgttataaatgtcaattgtcattgagtctacttgtcaaagtcacagaatacatttttctttcaaaatggcaacctgatttagcttgtttgaatattacaataggaatgcttactgatactacttgataatcatgtatatccttttgacttacacacacaaacacacatgagacaacaggattgataattgcagttgtatgtctttaaacactaaacgtaggaagctttttaatgttgccttgtgtgtgtgtgttgctttactgagtgagggagaaaatcctttgcaccaagcttagtggtgataagtggtagcagggggtaaaattcctgtaaaatacgggggggtgttataacgttaggtgctacttgggattctacctcctttctacgagaaattgggttctttaccattgcatttgttctgttgtggggaaagaggaaccgaggatagtagaattcttctctttggaatttacacaaatacggaaagtgtgtgccacaatagtggccagtaaggttgcgcgtataatcttcacgaaggctgaacgcgattcattataaagagtttaaaagggtagttaaacgaagcttgtaggacagagggctgatgttagtttactatgtattatcacgaactagtacagtctt

SEQ ID NO: 652428 - DNA, 1091 bp, Homo sapiens
  misc_feature (812)..(812): n is a, c, g, or t
gacccactgctgttactgcgcctgtacccgcagtgcccccctgcttgctgctagtgacacttctacctgtgctgtgcctccggtatcatgcacgagtgcacgcctccccagggctttgagctgcctgcccctggcctcctgggaaggtggcttcttgccgagcctccagggtggcccaggtaggtaggccccgagcacaggcacccggctatctgacggtgcctgtgcccatcactgtgggctgctgtctggtacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaacacaccaaaanacgtcgggtctccgcggccccgggttattgtaggaaccatcccggcccgcgttatcgtaggaactattcgggcccgcgttactcgtagggtctggcgccgggccgggccccaccagacgggaatccccggcccaaatgggggccgaggaggtccttggccagagttttttgggagccaggccgggtggattggctcgccggggcccgtgttgttcctccgggccggggtttggtcccgaccggtcccgagggccggcccattgttgaccgcgggggttg

SEQ ID NO: 652429 - DNA, 355 bp, Homo sapiens
ccccatcggcacctgagttggcgtgcgcggctcgcgcgtcaatgccgtgacgaccgagttggccggtgagcgcgtggacatcgtgctgtggagcgaggacccggcccagttcgtcatcggcgccctggccccggccaatgtgcagtccatcgtcgtggatgaagagcgccacgccatggacgtcgtcgtcgacgaggaaaacctcgccatcgccatcggccgtggcggccagaacgtgcgcctggcgtccgagctgaccggctggcgcatcaacatcatgtcggccgaggaatccgccgccaagcatgagctggaagccgagagcgtccgcaagctcttcgtcgacaagctcgac

SEQ ID NO: 652430 - DNA, 360 bp, Homo sapiens
  misc_feature (245)..(245): n is a, c, g, or t
ggaatttctgcccattgtgccagggagcaattgaaaaatcagttagttcagctgggtgcagtggctcatgtctgtaatcccagcactttgggaggctgaggcgggcagatcacctgaggccaggagttggagaccggcctggccagcacggtgaaaccccgtctctactaaaaatacaaaaaattggccgggcgtggtgatgggcacctgtagtcccagctactctggaggctgaggcaggagantggcgtgaacctgggaggtggagcttgcagtgagccgagactgcagcattgcactccagcctgcgcaacaagagtgagactgtctcaaaaaacaaaacaaaacaaaacgacaaaa

SEQ ID NO: 652431 - DNA, 306 bp, Homo sapiens
cgacctggataacaccggtctgaactcatatcacgtaagacttgaatcgttgaacaaacgaacctttaatagcgcgctgcaccatcgaggatgtcctgttccaacatcgatgtcgtccaccctattgtggatatggactctcagaatatgattgcgctgttatccctacggtaatctcgtgcctgttggtccagttatagtatcaattaaatactagtatattcgctgtgcactggtgaactcttagcatgtactgctcggacgttgggttctgctcctaggtcgtaccgagctaaatttcttatg

SEQ ID NO: 652432 - DNA, 105 bp, Homo sapiens
ccggtccatgtcttatttagaacttctcaattcttttcatcatatatatttcttactacctttcgttatcagtatttcataattgatggtgtaatgttagagata

SEQ ID NO: 652433 - DNA, 499 bp, Homo sapiens
gagcagcggcggcttgagtgacccgtggagaccctcaagaatcgacccatacatggacgccatgagctgcttcagctggtgaccaccttctccctctaacacattcttcccttcttcacaaactgtgcccatgtcatgactgaatgtgctcaatgtggggatgcctgcctgcccctggacgcttgaccccgtgttctcccagggtttgctcttcagggtggcggctggctggctgtgctccatcgtgcattggtggtgctctgggtgcgagattccctgtgtccccaactgctacacctctccaatgggctttgcatggcatgattgtgccattcatcctgcctgtggcctcctgaaatggatgctcatgaaacacctacacttccatggacaccggaagtgaagtttgatgggagatgggctgatcatgttaggacttgcatgggacgtgcccatggttctggcatttgcctttcctgaggggcccacgctgtggaag

SEQ ID NO: 652434 - DNA, 155 bp, Homo sapiens
gggtttttttttttccctaaacccctttgggcgttttccccttttttttttattttcccggggttggggggcccttgggttggcccctttttttttaaaatttttttggggaaatttttttttgggggataaggtttttttttttttttccccca

SEQ ID NO: 652435 - DNA, 252 bp, Homo sapiens
actgtacttggtgctggatcagggcatcccatttcctggggctccccgtgatgaagtgccacaaactggatggctttaaacaacagaagtttactttttcacagttttgaaggttagaagtttgccatgaaaatgtgagcacagccagtttttttccaaaggctccaaaggagaatccttccttgttttttcccagagctccttggcaaacagctgcattactccaagatttgcctttcttgtcacccagca

SEQ ID NO: 652436 - DNA, 282 bp, Homo sapiens
aaataagattgctggaagagcaactacaacatgacatttcaaacacaatggaggaatttaagattctaaatgaccacacaaagcattaaatcagaggttcagaggctacagactcttgttctgtaccagcctaataaggatgttgtggacacatggaaaatgcattcagaaaagatgagagttaaggctgtggaggattacttgaactggcttattcaggtgcactaagaggaggactgattcatagacagaattcatctttacaagggagtcagcttaaag

SEQ ID NO: 652437 - DNA, 169 bp, Homo sapiens
ctgacctagaggatccccccattagctgtaccatactccaggcacacaaaaatactgtagcagtcggcgtgtgaatcattaagcttgcgacccttcggcagcaagaaaccatacgagcaaatatcacgaaaattagtcacgcacaagccattgggattatccataaaac

SEQ ID NO: 652438 - DNA, 489 bp, Homo sapiens
caaacggaaaaggtaggtggaggcctagtggacacggcaatgggcatgggaaaatatgaagaaaatccaggggggtgggcggggtgaagatcccaattcaacttatccagaataattctctccattctcaaaatttcagatgaggaacatccacagaaacggtctctggccaatacctttagtgaggggaattctctcatcttcctcaacagtctgggcagctaggaaaaaccagcggatggcaatacaactcaagtatttgggatgagcctttagggtagctaaaaacccatccaaaagacggctagccagagcaaatgtgtcggggtaagggtggaatgggtactggagttgggccagccatggaattacttcatctctcggggagggagaaccattcggatgggaaggcattttccgcacattcactttccagatcggtgcttccctagggattggcttttccaacaggaaagacaatctcgggtt

SEQ ID NO: 652439 - DNA, 473 bp, Homo sapiens
  misc_feature (458)..(458): n is a, c, g, or t
atcatccacgtcttccccaaagtttgatataaacatggtgaattccgtggtttggctccaagctcagcttcccgcgtcttggcgagactagagtctgcccacaaatactctgcggtcatggaggagcatggcattcatcttctcaatggccttgtcggcagcctctcgggtctcgaagtggacaaaggcataacccttagagccgttctcatcacacaccaccctgcaggacagtatgtttccaaaagcagaaaaagtatcataaagtgccttgttatctatagatttgtccaggttcttgatgaagacgtttcccacaccagattttctcaaagagggatccctctgagaccacatgatgcggattggctttcccttaatcacatcaaagttcatggtgtccaaagcccgctcagcgtcggccggctgctggaagttgacgtaggcatagcccaggnagcggcgggtgatca

SEQ ID NO: 652440 - DNA, 605 bp, Homo sapiens
  misc_feature (77)..(77): n is a, c, g, or t
atgctgagtgcttcttaattaaccaccgtcagggctgaaaaccctgcccccacatgagagcggactctggggggagngggtgttttgttataactcccctgccaccatctggctggctggcctgcggcccgggaccacctgctttatagcggtgaaccgcggctgatgactcactgcgactcttcactattacctttttggaggcgtagtgcatttagaccactgcgattgacaacgagggcgcggaccaatcagagggtgatctctcattcaaagctgcaatgaccttctaccagccgccttgtggcctcattcgcagagactcaagagacagtgttgatgtgatggtggtggtgttgattcattgtggggtggaaggttgctgggatgccgacgacccagccttctagctgggttaaacatcaactataccacctcacacactcgcaaaaacaagtgttactaagaggtctgatattaattgtactgcactgtatacaatctgtggtttgacctttacagagagtgtcgtcgagcatatctctttataatcacccccttttttttactaagttcaacaagacgaacggttggtgggggtatat

SEQ ID NO: 652441 - DNA, 131 bp, Homo sapiens
tgatatgggccagaaattacagtgaaaaagaaaagataagaaatggaacagactgaagaaagaaaagagactcagagaattcctatttctaaaaatgttcaaaatattgcagagtacattcgccgtctctc

SEQ ID NO: 652442 - DNA, 172 bp, Homo sapiens
tctagaggatcccggacatctaggtccattgtggcgggcactgcagtcccagctactcaggaggctgaggcacggaggactgctttgagtccaggaggtcaaagctgtagtgaaccctgttcacacagtagctcatgagtagtaaccccagcaccttgggaggccaagtcag

SEQ ID NO: 652443 - DNA, 651 bp, Homo sapiens
aattaaggttattacatccatgtatctttctgtatctactcctaaagtacttgtgacattaagttacagggttttgactcctgggtctaaaaggacaagtcctgctaaatcttaacactgacagcaattaaagccttatctccaggccccatagaagatgctaatcaaaataaacggcatccctgagacacagggccaataattaaagccattcaactcttcaaggtcccgtgactgttgtgaaagaggttggaatgtgggattttaagggctgcttttaagagataaaataagttcagtttctctataatcattactgtcaaaggcacactgatgcaagaccagtatatgggcccctgtgtcagattaacagggttttcttgaagcattaaccaactccttaataaaggttataaaaggcatttggaagctgtattgctttatgttatggtcaaaattaaaattttatagtttataaaattttgaaaaataaatttaattggcttcatgctgttttaattagggcttgttcagaaaattatgtctcctttttcaaagaatgaaaatttttgcctttttcttgttgcattgtataaaaataattaggccaagtattataaaagcaaacccaggcggacccaggatttgcct

SEQ ID NO: 652444 - DNA, 157 bp, Homo sapiens
ggtttcacatgtagggcaggctacggtaggagaattgaatcagggaggcggaggctgcagtaagctgagactgcgccactgcactccagcctggacaacagagcaagactccatctcaaaaaaaaacaaaaacggacaaaaaaacccccgaaaattc

SEQ ID NO: 652445 - DNA, 208 bp, Homo sapiens
agtttcggcaaaaggattttctcccaagatgcttttggttgtccaacactggagactgtggctttcccatgtggaaatcattttcctgaagtctggaaccatgtgtgagaagtcatgttcttaacacttgtgtgtttttaacactttatctgggatgtgtaagtgccaccaagactgtaagtaaatgcagttgtagatgcgttgtgga

SEQ ID NO: 652446 - DNA, 103 bp, Homo sapiens
aaaacttgttcaccaaagaaagtttcaactctggggcatgaatgcaagcatcacaaagaagtttctgagaatgccctattctcgtttttttttgtggaagata

SEQ ID NO: 652447 - DNA, 180 bp, Homo sapiens
  misc_feature (54)..(54): n is a, c, g, or t
  misc_feature (115)..(115): n is a, c, g, or t
  misc_feature (152)..(152): n is a, c, g, or t
gcttcttcgaggtgaagcaaactacggagccaaacttccctgagatcctcctanttgccatcaacaagtatggggtcagcctcatcaatcccaaaacgaaggatatcctcaccantcatcccttcaccaagatctccaactggagcagcggnaacacctacttccacatcaccattggga

SEQ ID NO: 652448 - DNA, 1142 bp, Homo sapiens
acgtcgaagtacgttctacaatgacgcataacttgcagcgtattcccagtaagagtgttctgaagccttctacaatgatacgaacggctggtcggaataatcatcactggtatagtacgtgactcacttacatccaagggattcccatgtctctccgtaggcactgcactgaattggggactagatatacactagcataccgatcatcgaagagcgtgatcaaaggaacactaggagaagcacgtcatgcaaacctaattacatgacctcgccacagtcgatccttcacttgcgtcgattcggaccgtcgcaatggcatacgcaatacttttctagatgtaacaggaggaggtcatcctagaataccggctgcgccttagcattcatacatttccaattatggccagcgcgatacgtggcctactttgaataacccgtagctggtaggataagctacctctgaccctatcgtgatgtcatcttacactgcctatgcaaaagcatacacgtaaaccattgacctctatcgcccctacttaaaatgaacgcttagggacatccccgacggggatcgaaccacattggtctggaaccgtatcccatttggaccggcttttgcacccacaatttgctggaaagactgaaggttagcgtacacaccgatgagtcatgaaatacgttccccgccacgattacgcggtcctgtgacattacattgtacgcggttgacgcaaggagggcagttggctcatatggcaatggatacagctgagaaaccgtaggatagcctcaagagggagactccacacgtgggccttatagtagacacacaatgtccaggaaatcttgccacaatttacacaccagaggaagaggcgctacgtaaaagaagggccacgaaacacacccatccatttgtgcaaacacaaggtgttaacgtcagcagggaaccccgtgtgagtgcgacataatttcaccgtctaacgggagcgttacgataattgggagttcttgggaagacgattccaagaacattgcacacggctcacacatgatccacagcgatcgagttacacgtagcaggcacccctaatatcagcaacacaagaggaaggatttagaaatagtactggcgttaaaaa

SEQ ID NO: 652449 - DNA, 99 bp, Homo sapiens
ttccaacctcagcaaagttgggacaacagggtcatgccactgaacctagctggcatagaaattttttttttttgggaagactggtccaatctcggtggc

SEQ ID NO: 652450 - DNA, 369 bp, Homo sapiens
tgtctagagatccatggcgcgggacactcaaagatccagttcactttttgtatcactctgagactgtaacagatccagttcattttgatgacacacgagaccctaagcagtatccagtcattcttcgattacaccacgagacacatcccaagactcccagttatttcttcaatcagcacactgagaccacatccacagtactccagttcaattctttgatcaccatcacgagaccactcacagagtactccccagcttcacttctttgataaccacctctgagaacccgtaacaacagtactcccagcttcacttcttcgattaccaccaccgagacccccttaagcagtactccgtgggggtcgccat

SEQ ID NO: 652451 - DNA, 412 bp, Homo sapiens
gacatgtgacattagttactgaaacattgaacattatttggatgataaagattaaagcagttcatatgtaaatttttgaaataatttttatttttaacactttagttgtactaagggtatttgctatgataaatattactcggctgggcatggtggctcgcgcctgtattcccagcactttgggaggccgaggcaggtggatcagctggggtcaggagcaataccagcctggccagcatggtgaaatcccttttctactaaaaatacaaaaattagccgtgcttagtggtgagcacctgtggtcccacctactcaggaggctgaggcagtagaaccgcttgaatccgggagtcagaggttgcggtaagccaagattgggctactgcactccagcctgggcaacaggagcaga

SEQ ID NO: 652452 - DNA, 931 bp, Homo sapiens
  misc_feature (52)..(52): n is a, c, g, or t
  misc_feature (686)..(686): n is a, c, g, or t
gcccgacccgatggcccatgtccccagtgcatccggttgatgcccccttcantggaggtaaaatggagtgagtgtttttcttttcacatactcctggtgttcttccacaaatacaattttcacctcttgaatattttcaaggattctccatgctacacacagagaaatccaaactccccatcaggaccccagtcttcccaaaccctctttgcacttttctgcctccatgcttttccttgggtcatcctcttctctaatataaccttgtgtattattctaggttctccagagaaagagcagagagatagaggtagagatatacacatagagagagacagattgatttgttgtaagggatggctcacctggttatggaagctaaggagtcctggagtctgcagccagcaagctggagacccaggacagccaatgatatagttccaactcgagtccacatgtaaagtcaggagaagattgatgtcccagctcaaatataatcaggtaaaaagagcaaattctctgtgattctacctttttgttttgttcaggccttcaatggattggatgaggctcacccacactggggaggacaatctgctttattcagtctaccaattaaatgttatcctcatccagaatacctcagagacacacccagaataatgtgtagccaaatatctggggcnaccccaaaccagtcaaattgatacataacactaaccatcatgtcttgcttctactctctcgccattctggcatggcaaatctttccctttatttcaaggttagttcaaatgttacctcttaactaagcctttcctggtaaccccaaatattatagaaatggggtgtcctcccttctctgatgtctcaaaatatatggtggttcctctttcatggccttctgtaacaaactcccttacaatcaggc

SEQ ID NO: 652453 - DNA, 135 bp, Homo sapiens
gaggagtaaatcttggccgataagtaaatcttggccgatgagtaaactcttggcgacggagtacacatcttggccgatgagtacatctgggctcggccgccgggacttcctcatcgccaagatttactcatcgga

SEQ ID NO: 652454 - DNA, 425 bp, Homo sapiens
  misc_feature (425)..(425): n is a, c, g, or t
cggtgtctttggaggcgctgtacttcgaggccgtcatggctaatgggctggacaagtggatcacggggatagatgaaaccgcggttctccaccgggaggccagcaagctgaacactctgcagctagagcctcagctggccctgctggcacgacagctggcccagactgagcattaactgaacaacctgatggcccatctggacctcctttttgtgcgtgtgactactctggctggagcccagcaagagcttctgaacatgaagctatggaccatacacgagctgctgcaagatagcaagccggacaaggatatggaggcttcagaaccagctgaaggctcgataggcgagtctgctggaggtggagacatagtctctgctggcattccttgtctctgccgacacagaggccagcagacctttccn

SEQ ID NO: 652455 - DNA, 365 bp, Homo sapiens
  misc_feature (52)..(52): n is a, c, g, or t
gcccgacccgatggcccatgtccccagtgcatccggttgatgcccccttcantggaggtaaaatggagtgagtgtttttcttttcacatactcctggtgttcttccacaaatacaattttcacctcttgaatattttcaaggattctccatgctacacacagagaaatccaaactccccatcaggaccccagtcttcccaaaccctctttgcctcaggctccaaactagcaagtgcgtctgaaaaaggcacagtcatccgggtgttctctgtccctgatgggcaaaagctctatgagttccggagagggatgaaaaggtatgtgacactcagctctctagtgttcagtatggattcgcaattact

SEQ ID NO: 652456 - DNA, 98 bp, Homo sapiens
aataacaacagtagcagcagtagcaactcaggatgggatcagctcagcaaaacgaacctctatatccaggactgctcccacacacgacagactgtgag

SEQ ID NO: 652457 - DNA, 136 bp, Homo sapiens
cgcggaatctcctgctgctgtccctcccccttgtctttcccttctagtaccctctcagctccaggttgctctgagtgtgcctgtacctacccctacccctagctacaatggactggataggtgaagggggtacctg

SEQ ID NO: 652458 - DNA, 122 bp, Homo sapiens
  misc_feature (19)..(19): n is a, c, g, or t
ttgggcgctcacgtcaggnccctcgatcaggcccagccgccgggggagcgggcggggcctgggattcgagggcccgggaggggagcccatccgagaaatggagcccaaggggtaccggagct

SEQ ID NO: 652459 - DNA, 373 bp, Homo sapiens
tacatttctagaggatccctcagcacatggagtatgggcagcgtatcggatcgtaacaaattcccagtgtcgaagagaacacaaattggatgtctcctgctatgagggaagcaccaacatcgttaagtcaacttcttgacaactctggagctccccatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgcgctgtgttcatcccttgtgcatcccgaattgagtgaggtcagttctaacgttgcaccaag

SEQ ID NO: 652460 - DNA, 153 bp, Homo sapiens
acacaaccactggcattagccgagacacacagacgttgaagaggctgcagaagagtctggcgtccatatcatatctggagccgggtactatgtggatgcaactcactcctcagagaccagagccatgtcaagaacagcttaccttaccgagta

SEQ ID NO: 652461 - DNA, 172 bp, Homo sapiens
aaactatagggcagctgaactcagtgcagctgacgtcgcatgtgggaagcgggacagagccgcggtcttcggctatcaagaggacgcataactccggattgtaatttgaactgtcctgactaatggaacgactctgtgacggctgacagtgacaggaggccgactacatcgt

SEQ ID NO: 652462 - DNA, 233 bp, Homo sapiens
  misc_feature (128)..(128): n is a, c, g, or t
  misc_feature (163)..(163): n is a, c, g, or t
  misc_feature (231)..(231): n is a, c, g, or t
tgacgaatattcatcatgtgtaaaatgggagaaatgaaatgttattaaaacaaacatgtgagacttcgatgagaagagacggtacccggtctaagcgcccaccgggtcgcgaggatccttttcctggntaaggcctgggtcacagcgaaagccctaggcccangggggggggggggggcccgagatttcagatccggggcccggctgtcagggtggacccgccggggggcnct

SEQ ID NO: 652463 - DNA, 836 bp, Homo sapiens
  misc_feature (4)..(4): n is a, c, g, or t
  misc_feature (70)..(70): n is a, c, g, or t
  misc_feature (79)..(79): n is a, c, g, or t
  misc_feature (88)..(88): n is a, c, g, or t
  misc_feature (112)..(113): n is a, c, g, or t
  misc_feature (118)..(118): n is a, c, g, or t
  misc_feature (120)..(120): n is a, c, g, or t
  misc_feature (127)..(127): n is a, c, g, or t
  misc_feature (143)..(143): n is a, c, g, or t
  misc_feature (145)..(145): n is a, c, g, or t
  misc_feature (150)..(150): n is a, c, g, or t
  misc_feature (159)..(159): n is a, c, g, or t
  misc_feature (174)..(174): n is a, c, g, or t
  misc_feature (182)..(182): n is a, c, g, or t
  misc_feature (185)..(186): n is a, c, g, or t
  misc_feature (192)..(192): n is a, c, g, or t
  misc_feature (196)..(196): n is a, c, g, or t
  misc_feature (200)..(200): n is a, c, g, or t
  misc_feature (203)..(203): n is a, c, g, or t
  misc_feature (208)..(208): n is a, c, g, or t
  misc_feature (210)..(210): n is a, c, g, or t
  misc_feature (231)..(231): n is a, c, g, or t
  misc_feature (245)..(245): n is a, c, g, or t
  misc_feature (256)..(256): n is a, c, g, or t
  misc_feature (262)..(263): n is a, c, g, or t
  misc_feature (287)..(287): n is a, c, g, or t
  misc_feature (404)..(404): n is a, c, g, or t
  misc_feature (715)..(715): n is a, c, g, or t
  misc_feature (766)..(766): n is a, c, g, or t
  misc_feature (821)..(821): n is a, c, g, or t
agcnagggaccacggcaatcctggccatccatccatggatctgtttctatacaacttcatcatgtgacanattccagcngtgaaagangaacagtacagaaatgtgggactnntcttngntgctccnttcagatggtccaggngntttgngtgtcaggngccaagggggggggngggggggnggnntggggngggnatanttnaagangnagccaaatgtggaactaaggngggttcagtggggnccagggaaggnctcatnnccccagtccacaattgtgccccanccccggcaatgaaactcacgcatatgcacaaacgcacatcaacaaacacacaaaaacacacagagcaaataacattactgaaagaacctggaggctattaaatacaaaatggcagtnttctttcaaagtgaaaatatttgcttctttgatactcctcagtgccttgcagtctcccaatcacagaagagtagatatgggaagggccaagaggagtatgttgccagtggccctacaagtccatgtgtgctgaagtccctatagcaaccaccttactcttcagcccagtagctgcctcccatgtgaccattcacccgattggcaccattgctggagctactgtcacagggactttttgtgcaggtggtcacatcttcttcctctgagctgctctccacatcactgcgatcatccttcgatacatgcaaganatgaaactgtccagctcccgccaggcatagaaaaaaggaaggaggtgaggnagagtggaaagtacagggtctaatccttcctggacaggtcacctagtcaggaaanaaaagcaggagagaa

SEQ ID NO: 652464 - DNA, 944 bp, Homo sapiens
ctgttgaccggggttatttgtccctcttaagagtcttgtgtgtggttcccgtggcacctggtgacggtttcatggcttgtttctttcaagggtagtctggcttggcatgctcgactgtcgtggccccgctgtttatgttggctcgctgtcgcctctgtgtgtggagggaatctcccttctgttttgtgggcgagggggttcaggtgcctccttttattttgccgtccctttggttgagggggggtgtcacggcagaaaaggcttgcgcgtcggggtgcctcttctttcctggccctaagtgcgtgggccacagtgtttgttcgtgccgaggggccattttctactatttggttcctcgtcttccagggggggttctcctattttctcccgcccggcggaccaccctcgcggctgcgctggcctgccactatcgtctgtgaagcccgcctggtgggcaccactcaccatttcttgagattgccggctatttttgcatgcagcatcccgcgttttggtggctcgcctctggtgcagctggctcgagctcgctggcaggggtggtgtttcttctcccaggaccgcggggcccttcggtgtatcgccgccgtggtcgctccacagggtgtctcactcacactacgtcccaatttcggggagacacaaagctaattttcctttttttgaaccacaccccctctttacgatcacgaggaaaattcaatgattcttttttcacatacccagtagggagataacaattcttgccgcagttcataaccgcagaaacagactgacatttgtttttcttatcagtagtaaaatacatccagcgatagtcgttaaacacacaaattatcgctcccgctgtgtattcattcatttttacggcccccccgggggtccccccccccgggaaagggaaaaaacccaagcacaaccaaaac

SEQ ID NO: 652465 - DNA, 335 bp, Homo sapiens
  misc_feature (189)..(189): n is a, c, g, or t
gcctcatatgctgtcttactctttctaatagaactttccctctaatgttactttctataatttgtcttacctgctaaaatataagctccatgagggcaaagggccttgtctttcatgtttgaggcctagttcttaacagtgtctgacacatattacagtaagttttgtaatgaatgaattcattttgcntgacaaaatgagtttcaagtggttcttatcaggggtctgtagctattaagtgactgattctgattctgtttccacgcctccatttttatatttcactaccatgtgtggcggctgataccttggttaccggagtagcatgttgcatt

SEQ ID NO: 652466 - DNA, 835 bp, Homo sapiens
  misc_feature (289)..(289): n is a, c, g, or t
gtcgatcagatggagtggatgtagcgaagtggactttaagaactggagagaggtggctacaaacacgtaataaatcttccagattcatctctcattttatctgtccagaaatgtgctgagagatttataagcacaagaatcgatgtttaatatcaaggtgtcgtcgccgcattcactcgtacagttcatgtattaatagttgcaccagtaaagggagcctatctgatttctgaagtgagcttgcaggccttcattccatagaatatcgtgttcgcaaaggaatgtagcncagtgtgaagccaatgtggaggcaattctttatttcctccacatataccttgcattacacgtctgatcaaatcaatacatttatcaatcttcttacatcatagcatttattggcatcttattatgtctgagggaggtccctattcgttctgcatgccggtgctatacaacgaggaaatgctgtcttagaaaaagtttcttaaatggagtaagcagatcctcactaggcatgagttataacgctggggcttccactactctttgcacacgaagttctcaagaaccagactgcccgttggccaagtttagttcacagtataccgaggtcctcacgcttgcagtgacttggtgatggcggcatagcaagtggggttctagtaaaagctataagatgtttgaacacacctgtccttctttacttagttgtacgcaaagcccctttattgttccaacaaaggggggaattttgttcaccatacacatgggtcacttgagtgtaccttcgggtacaaatggattcggtcaaacagaaaacttcttttcgccc

SEQ ID NO: 652467 - DNA, 258 bp, Homo sapiens
agcttatttctcatcgtaggagaacaggcatttgtggggagggagggacaggctctcattctgccacccaggcctgagcgcagtggcgaaatcttggctcactgcagcctcagatttcccaggctcaagaggtcctcctacctcagcctccctggtatcagggaccacaggcacacgccaccacacccagttaactctttgcacttgttttgtacaaatggggttttgccatgttgccaaggccggtcccaaactccc

SEQ ID NO: 652468 - DNA, 486 bp, Homo sapiens
tttctccactttttggaccattatccacatgcaataaacccagaggacccaagcaaagaaattcttctagccatcttgatggcggacaaggagaagaaaggttacgtcatggcgtcacgactgcggtcaaaactcacgagtctgggggagaagctcacccaccaggaagtggatgatctcctcagggaagcagatatcgaacccaatggcaaactgaagtatgatgaatttatccacaagatcacccttcctggacggcactattgaaggaggagaatgggagagcctccggtgggcctgaaaacttggagcaattaattttttttaaacagcgttcttttcacttgggagagctggcaaacacagtggcaagacacacattacccaactatagaacagaggctaactagcaacaataatagatgattccagccatggtatgagtacatctttaataaaagatttgtactgattttattaaaaaaa

SEQ ID NO: 652469 - DNA, 198 bp, Homo sapiens
agaggaccctgtgatgttatcccaacacctgaaaacaggatgaagccctgtttactggcaattccttttacccagtgtatcatgtctacctatcaacagaaaattacaaagcatacttaaaaggcagaaaatgcagtttgaagagactgaacaagcattagaaccagagtcagtcgtggcaggagtgttgggcgataa

SEQ ID NO: 652470 - DNA, 132 bp, Homo sapiens
  misc_feature (55)..(55): n is a, c, g, or t
tatcagggcaacagaatttcaatggcagctggcgcgccaacattaagtgatcgtncttctctaaactaaccatgactaactccttttttatcatctctggaacacacacaatccgtgtgcaggtccctgcca

SEQ ID NO: 652471 - DNA, 772 bp, Homo sapiens
gatttggaaacatgggctgaaaatgaaggcccatagtgcataggaacagtaaagccaggtgctgacgtgtgtgtgtgtgtgtgtgtgtgtgtgtgtgtgtgtgtgtgtggtgttgtgtgtgtgtgtgcgtgcaccatacacatgtgtggtcactcacgtgtgtgtaagggaactgagggacgcgtcaagggggtgggtgatatcactgacgagctgttggtctcaaatatatagcaggcaccaggtcttgtgtagataagtcagtgtgtgtttataaatatgtcatataagtggtatctcttttattacactctaccaagatgaaatgagggagtctccttgtagacccctgttgtcgcgaagagatgtgcggtcgggactagtgtttatccatgagtttctttattcctaagtgcagatgagaaagacctttctccgttgagctctgtgactcccagaaggtaccccagtcccccagtgtacttagaaaggatctcgaacattgctggacgtcctcatagtactcacaagggggctacgccttgagtgtcactcgcacagtcttcagtctcctgacagagagatacactcacgtcacaggtctctgggtctcaatctgaaaagtgctgccggcgcgccgaagagactcgcatggcggcaccatctctagtgggagggcgcagagcccaccgttcgcccccatagacctgacaggtgcaggtgccttggcttgcccgcgcctccctgggggccctgtccaatgaaaaacaga

SEQ ID NO: 652472 - DNA, 234 bp, Homo sapiens
ctgcacgaagtgggtggattgcctaaggtcaggagttggagaccagcctgaccagcatggtgaaaccctgtctctactaaaaatagaaaattagccaggcatggcagcgcatgcctgtaatcccagctactcgggaggctgaggcaggagaatcccttgaacctgggaagtgaggccaggcatgatggttcacgcctgtagtcccagcacttgtgggagccacttcgtgggcag

SEQ ID NO: 652473 - DNA, 139 bp, Homo sapiens
tcacatatactgctacatcacccatcagtctccaggtgagtctctgcatcactaaatacttcttaataaccatggcatgggtctggacggagaaggtgaccctagatgatggatggatgtggccaggttgcggcttgga

SEQ ID NO: 652474 - DNA, 733 bp, Homo sapiens
cccacccaacctacggctaggacgaggccccgggttaatcggccgagggttgagcctgtccatggaagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggcactctggcgcaaacaaaaatatgacatttccaaccagggcacaaacatggaggccttgcggcttacgtgatgcggctaaactggcaacgactggcttgcacgctggcgactgactaatgggcagaacttactgatgctcttttggcgcacacacagcgtgctttaacagactcgcatttggcgagcctactggggcaaggcgactggcggaggtgtacgtgttagtcaacgtggaggtcaggtgggttatcttctgcctccttcactggcttcatgtgaacttgcctgtgacagaatatcttgccctagatgtcctcttccctcttgccatcgtgcacaaagcatgcgatcttatgaccgtgagttcttattcgtggatgctaactaactggggtaatctcaggcagtactggggccatggctctttcccttgtcttctcttgc

SEQ ID NO: 652475 - DNA, 161 bp, Homo sapiens
gcacagacttgagacaagaagacccgtgtgaagctgccctccgtgctcagaaggttatctcctcagccaacagagctgtggttggtgtgtgtggcgtggaggtggccgaattgacaaacccatcttgaaggctgggcgggctgtaccacaaagtataatgg

SEQ ID NO: 652476 - DNA, 182 bp, Homo sapiens
  misc_feature (165)..(165): n is a, c, g, or t
agatcctaacagggatcaccacgtggctcccaaagtgatgggactacaggtgtgagccaccaggcccagccagaatgtagatcttctagttgatatataggagggttcataaggagcccctcatatattatgatgctgttgtgatatgacgtaggacgtaatgtntcgcccatcgtggtcag

SEQ ID NO: 652477 - DNA, 234 bp, Homo sapiens
tcaggccggaccgctctcgtgaactctctccgtgagaccctccttcacatgcctcgaatcctcctcatccaaatttatctgtgctggtccaggttggcatatctcagccaggagagcagtcaaattctttaaccaagattttccatcagtggtccaaactcctatcaaatatgaaagcatttttcctgaaataagtattttgtttttatggtgatataataccagtctcacgga

SEQ ID NO: 652478 - DNA, 185 bp, Homo sapiens
ccccccccccccgcttttccaaaaggaaaaatggtcggggggggcggtttttttggcccctttggacccccaaaaaaaaaaatttttttttgcgcgccctttttgcccccccccccccccaaaaatttgggggggtttgggggccccctttttttttttttttttaaaaaccctcccccccccca

SEQ ID NO: 652479 - DNA, 342 bp, Homo sapiens
caagggggtttagagggttctgtgggcaaatttaaagttgatctaagattctatcttgcacacacagctgctacatagacgggtgtgctctttaagctgttcttaggtagctcgtctggtttcgggggtcttagctttggctctccttgcaaagttatttctagttaatccattatccagaaggtataggggttagccccttgcatatattatgcttggttaaattttgcattttccctgcggtctatttattgcgacaggtttcaatttctatcgcatatcctttatttgggtaaatggtttggctaaggttgtctgatagtaaggtagagtgggtttgcg

SEQ ID NO: 652480 - DNA, 1503 bp, Homo sapiens
  misc_feature (576)..(576): n is a, c, g, or t
  misc_feature (598)..(598): n is a, c, g, or t
  misc_feature (820)..(820): n is a, c, g, or t
  misc_feature (860)..(860): n is a, c, g, or t
  misc_feature (872)..(872): n is a, c, g, or t
  misc_feature (876)..(876): n is a, c, g, or t
  misc_feature (882)..(882): n is a, c, g, or t
  misc_feature (891)..(891): n is a, c, g, or t
  misc_feature (933)..(933): n is a, c, g, or t
  misc_feature (1008)..(1008): n is a, c, g, or t
  misc_feature (1019)..(1019): n is a, c, g, or t
  misc_feature (1050)..(1050): n is a, c, g, or t
  misc_feature (1063)..(1063): n is a, c, g, or t
  misc_feature (1067)..(1067): n is a, c, g, or t
  misc_feature (1072)..(1072): n is a, c, g, or t
  misc_feature (1078)..(1079): n is a, c, g, or t
  misc_feature (1081)..(1081): n is a, c, g, or t
  misc_feature (1084)..(1084): n is a, c, g, or t
  misc_feature (1236)..(1236): n is a, c, g, or t
  misc_feature (1294)..(1295): n is a, c, g, or t
  misc_feature (1391)..(1391): n is a, c, g, or t
  misc_feature (1394)..(1394): n is a, c, g, or t
  misc_feature (1479)..(1479): n is a, c, g, or t
gctagtaactcacggacgacaacttcgagagtcgcatctccgacacgggctctgtgggcctcatgctcgtcgaggttcttcgcgtccctggtgtggacactgcaagagacttgcacctgagtatgaagctgcagtaccagattagaggaatagtcccattagcaaaggttgatggcgagctgcgaacactaacacctgtaataaatatggagtcagggatatccaaccctgaagatatttagagatggtgaagaagcgaggtgcttatgatggacctaggactgctgatggaatagtcagccacttgaagaagcaggcggaccagcttcagtgcctctcaggactgaggaagaatttacagaaattcattagtgatacagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacangactgtggcatatacagtgcanaaaaatgaccagtggcaaaattaagaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactntgctgtagctagccgcaaaacctttagccatgaactgtcngattttggcttngaangcactnctggagagnttcctgttgtgctatcagaactgctaaaggagagaagtttgncatgcaggaggattctcgcgtgatgggaatgctctgagaggtcctgcatgatactttgatggcatctgagagatncctgagctganctatccagagagcatgatggcctgtaagtantgtagcgagaatntgtnaatantgaatnnantangtgtctgatgaattatgccctgtgtgcactgtagacttgagcagttaagacttgcagagctacaaactgaatcgatgcagatgtgcaagcatgaggctttcatgagcagagtctacatactttcagcaaagactaccaggaattgagggccnataggattttcgttcacgaagtcaaccctgatagagaaccaaaaaagcagggcttagnngaaccatgaagcttaccgtggacttgggctgccatgatctagcagcaagaatactgatttactttcttgacacaactgtgaaaattcgtagacgcntanggggggggtggttttacaacacaaaaaacgcgttttttttttgttggtgggacatttgcgcggatagtctctcattctcgcatgnggccctctgtccgtcttcttcgct

SEQ ID NO: 652481 - DNA, 742 bp, Homo sapiens
  misc_feature (554)..(554): n is a, c, g, or t
ggcgcatgtcgggtaagcgcgtctagggcgctgcgcggcgcaatgaaaatggcggcttccattgtgggcgcgcaatggccgatggatcctgcatttgtgcacttcttgtacctgcatgcttgcatgcatgctactgctaaccaaccagcctgggggtcctgcagcgggctcagataggcttcagtcgccgggtacgtcccgacagagtcttaccactctacctccacctggaagaacgaagaaggatatgcgtcgattactaatgatgcagacgatggcagcgatcttctggaagtcgattgggagacagatgatgacattgatcgacggagatcttccacgagctacaagagatccttctagcagccttgtcgagcttctcagaaagatatgacccaagcatagcctgtgaagcatattgaatagtgacgataataacgggaagcactctcagtgactgtctgtcatctggtatcatggagagccctagctgatgaaggacgacacgaagcgaatatgtaccgagcctcgtgtctagggcaagtcttttcaantgccaaattattgacgtccagaggtgtcactcgtgggagtcagaccgtgctatcttcatgcttcgcgattgggagctaggcctgggagattcaaggactttggtggtcggtccagacaggtgtgctgatgtaactctggagggcctgttgtccccggcaaaggaggaggacatcctgagactacttgc

SEQ ID NO: 652482 - DNA, 1440 bp, Homo sapiens
  misc_feature (576)..(576): n is a, c, g, or t
  misc_feature (598)..(598): n is a, c, g, or t
  misc_feature (820)..(820): n is a, c, g, or t
  misc_feature (870)..(870): n is a, c, g, or t
  misc_feature (945)..(945): n is a, c, g, or t
  misc_feature (956)..(956): n is a, c, g, or t
  misc_feature (987)..(987): n is a, c, g, or t
  misc_feature (1000)..(1000): n is a, c, g, or t
  misc_feature (1004)..(1004): n is a, c, g, or t
  misc_feature (1009)..(1009): n is a, c, g, or t
  misc_feature (1015)..(1016): n is a, c, g, or t
  misc_feature (1018)..(1018): n is a, c, g, or t
  misc_feature (1021)..(1021): n is a, c, g, or t
  misc_feature (1173)..(1173): n is a, c, g, or t
  misc_feature (1231)..(1232): n is a, c, g, or t
  misc_feature (1328)..(1328): n is a, c, g, or t
  misc_feature (1331)..(1331): n is a, c, g, or t
  misc_feature (1416)..(1416): n is a, c, g, or t
gctagtaactcacggacgacaacttcgagagtcgcatctccgacacgggctctgtgggcctcatgctcgtcgaggttcttcgcgtccctggtgtggacactgcaagagacttgcacctgagtatgaagctgcagtaccagattagaggaatagtcccattagcaaaggttgatggcgagctgcgaacactaacacctgtaataaatatggagtcagggatatccaaccctgaagatatttagagatggtgaagaagcgaggtgcttatgatggacctaggactgctgatggaatagtcagccacttgaagaagcaggcggaccagcttcagtgcctctcaggactgaggaagaatttacagaaattcattagtgatacagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacangactgtggcatatacagtgcanaaaaatgaccagtggcaaaattaagaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactntgctgtagctagccgcatgctatcagaactgctaaaggagagaagtttgncatgcaggaggattctcgcgtgatgggaatgctctgagaggtcctgcatgatactttgatggcatctgagagatncctgagctganctatccagagagcatgatggcctgtaagtantgtagcgagaatntgtnaatantgaatnnantangtgtctgatgaattatgccctgtgtgcactgtagacttgagcagttaagacttgcagagctacaaactgaatcgatgcagatgtgcaagcatgaggctttcatgagcagagtctacatactttcagcaaagactaccaggaattgagggccnataggattttcgttcacgaagtcaaccctgatagagaaccaaaaaagcagggcttagnngaaccatgaagcttaccgtggacttgggctgccatgatctagcagcaagaatactgatttactttcttgacacaactgtgaaaattcgtagacgcntanggggggggtggttttacaacacaaaaaacgcgttttttttttgttggtgggacatttgcgcggatagtctctcattctcgcatgnggccctctgtccgtcttcttcgct

SEQ ID NO: 652483 - DNA, 146 bp, Homo sapiens
ggtcgctctagaggactcccccagtacccgactctggaaggagactgtattcaccacgtctccctatcaggagttcactgaccacctcgtcaagaaccacaccagtagtctccgatgcagcggactcaggacgaggtaccgagact

SEQ ID NO: 652484 - DNA, 257 bp, Homo sapiens
tacgatagaactataaagcagaagagtttagaaagaatttcctatttaagtgacgaaacctcatactccatttgtgatacatggcacaaaggttacaattacttatttttgaccaaaagctcttttgacattctattaaacaatcaccgacctatttaattatcatcatgcaaatggcagatgttttcataagtcttatactaataaatcatttccctgattttttgggtaaaaccacatattcataaaaaaaaaaa

SEQ ID NO: 652485 - DNA, 421 bp, Homo sapiens
ttatgctaaatgaataagccaatccagacaaatactgcatgatttcacttaagtgaagttatctgaagtagtcaaatttatagaatcaaagagtggaatcgtggttgtcaggggtgaaagggaggggagggggaaatgtggagttactagtcagcaggcatgaagtttcagttaagcaggatgaataagttccgccatacagtattgtacctatagtcaacagtactgtattgtacacttaaacatttgttaagaaggtagtattcatgtatgagaataaagtaaaaagtaatagttttggcagtggctcatgcctgtaatcccagcatgttgggaggcggaggcaggaggatcgcttgagcccgggagtttgatactagtctgagcaacatggggagactccatctctacaaaaaaaatt

SEQ ID NO: 652486 - DNA, 210 bp, Homo sapiens
  misc_feature (20)..(20): n is a, c, g, or t
  misc_feature (33)..(33): n is a, c, g, or t
  misc_feature (208)..(208): n is a, c, g, or t
gatgaataggcagagcctantttttagggcagngaacctaatctgcctgatgctataatgatgaatacatgtcattgtaaatttgtctaaacccatagaatgtataacaccaagagtgaaccctaatgcctatggactctgggtgataatgatgtgttagtgtaggatcatcagttatcagaggtaccctctggtggtggcgggtggngt

SEQ ID NO: 652487 - DNA, 178 bp, Homo sapiens
cgcttgtagggagtgtctaggtgactctccattgtggtctcatggcattcttgagcagctcggaggattagtcagtggcataggatgaagggaccgggcagcacatggccattgatgcggacacgtggcgcatagccatacttgtgctcacacaggcgtctggcaaagtccacccact

SEQ ID NO: 652488 - DNA, 427 bp, Homo sapiens
gagggaatgtttgtgcccacacttctcatctctcacttttgccagccgagtcactcactgggttattaacagttccctctgcctcctcactttttgctgcacagacgttccaccaggtaaattcacctgtctggctagggattacctggcactgcccatgggaacacaacaaagcctgcttatggtggctcagaaacacctgcttcatacatacagtagtgcctacttgaatggctaaggattaacaaaatccaggatatcgaggaatatatctttcatttagcagacacatctacataggaggtgggtaaccttgtacaagttagtgtgtgacttggtttcttcaaataaggttaaaaaataccagctacttcatagtagaaggtaatattaataatagtagaggcagctaacatttgagtgctaa

SEQ ID NO: 652489 - DNA, 346 bp, Homo sapiens
acctctgaccgagtcaagaaagaagtagtaaaaagtaaaaggcagaaatgaaatccacaagcggacagcctggcgccacaccctaggcctggtagttaaagcttgacccctgacctaatcggttatttgcataagaaaagcactgtaaagatccctgtcctgttctgttccattctaattaccagtgcatcgagcccccagccacataccccctgcttgctcaattgatcacgaccctctcacagggacccccttagagttgtgagcccttaaaaaggacaggaattgctcactagaggagctcagttgttggagatgtgagtcttcccgaagctcctggccgaat

SEQ ID NO: 652490 - DNA, 1112 bp, Homo sapiens
  misc_feature (549)..(549): n is a, c, g, or t
  misc_feature (1112)..(1112): n is a, c, g, or t
agcggggcgcgctgctttgtggggtggcggctggcggccgtcgctagcgattgctggggccgggcggctgacgtcgttacgctggtggctcgacggccatggcgtattctggcgcaggggggttcgcccagacagtactggtggacatattgtccctagccgagaagactttcatacctgtgtgcggcatactgcaagaacggagtcgggcagacgcttccaatggctatgtgggcccattccatgacagtacaggattatcaggatctacatggaccggaggcatggctgaagatagtggtagacatatatgtgtacagccctagtcatgaatcgagatactatgtggtcactcagttactacaattacaggtgccgacctttaccaatttcagcctttcagaaatctctacaagcaaggttttggaagacccaatgctggcactctttctggcctaacagggcgagtgcttcctcacaaggcaagatctggtgaagcgcatgcaccgacccaatggcattcgcacacatgggattgccatgccttgnttgcgtgcgttgcactttcgtcattcgctgcaactaatagctgagactattcagctggtgactcttaacccagcacctgcagcgtgcctgaccattgcaacagcagcacgtcttagacgaggtggaccggaacagagagattcgatgggacaatgacacgaacccttcacggcaactgtacctttcaggtccagcctaggagtgtcccggctacgaggacgaacgttgggcgctcctgggtgaagccctgtctagattccacgctacaacgttgcaccgacaaggtttgccctaatgcccatgcgcaaaaacgggggcttgcattttgcacgtaagccatccaatgtcggaaacacaggcgtagaggggaacgcttccccggaagacgcactccggcacacagcgtttaaacaacgtaagatgccatggcgagaaattcccatgcttgggaagaactttggagggggtttccccaggcgcttcaagggtcagcgcacccgtcctttgttatacaccgaacagggttgactcgccagcccagcctaaaattcactcgcacgatn

SEQ ID NO: 652491 - DNA, 113 bp, Homo sapiens
agaacatatacaatcgagctgatacccctggtgcaggcggcgctgcccggcatgcaggaacgcaagttcggccgcatcgtcatgatgtctcgcgcggcgcgctgggcctgccc

SEQ ID NO: 652492 - DNA, 244 bp, Homo sapiens
tcaatgtaaagcaaattagttcatcactttattacatcttagggctttcttaaaataaatacagtactatcatatcaaacttactgtgagaaataaagcccatgtgtgaaagtatggtaacagaaagcttactcaggactgtgtaactgagcacttgagaaatcatacagcctttatttccctatttacaggacagagagcggctgtgttcaacaccatttatacaaaatcccaagagactgta

SEQ ID NO: 652493 - DNA, 324 bp, Homo sapiens
acgacatatcaacactgagggacccactgtacagatcgtccggtagtaataaagctatacaagaaccgaaaggagtattcatcacagagatggatgcagactttcggcaaacaggtcacatctgtgctgcagacacagggcaaacctggaaattcgatatgccagacgtacttcatagagctggtgcgcgtgctgaaacaagcattacagaacacgagaaaaagttgtgttagcagtgcctgggcctgggcctcagagggaatgaaatccacagcggacctgcatcaaaaacttggcaaagcaattgaaatggtcgccaatccg

SEQ ID NO: 652494 - DNA, 120 bp, Homo sapiens
aattgagtaattccagaatgcagagtgcccaagtttcatcagctctgaaaccaaccatgccgtcgtaacggtctcgaggtctccctcttctgtcataggccatgaggtctccccctctaa

SEQ ID NO: 652495 - DNA, 113 bp, Homo sapiens
ccaaataggatctcccgaatcaacctgtacccctctccttcataaattattcatgcttcctagcactattaacatgtttaccacaaccaccaccccatcatactctttcaccc

SEQ ID NO: 652496 - DNA, 319 bp, Homo sapiens
cacgagggctgccggcgaacgcgctcgtactcggcccggacctcggccaggtatggttcccgcagctcgtcggagaggagattgctgcacaccgccaccgagcgggaagcgtccggcacccagatgaccgggcccgagtagttgggcgcgatcttgagcaccgtgtgcacgcgggaggtggtggccccgccgatgagcaacggaagcttgaagccctcccgctccatctcccgggccacgtggcacatctcctccagagacggcgtgatcagccccgagagcccgatcaggtcgggcttttcctcccgcgccgtctgca

SEQ ID NO: 652497 - DNA, 155 bp, Homo sapiens
gttgcccccagcatgggttttgctgtctgcatcatgtgctatagtctaaaatgttctgttgccctcggtattttctgtaaattgtagtaatgtccaggcttgatcaaaatcaagttttaagtttttttgcccagataaatttaatgattttggca

SEQ ID NO: 652498 - DNA, 364 bp, Homo sapiens
gacaaaattggtgctagatgggagacaaaattagatgaagaaagactaagcccctcataccagagatgtgttttatatatagtgaagaaaatatagaatattctccacccaatgccttcctagtctccttatttcctgtgcaaagtgctgcgtacgggttcatagcaagttgttattggtatttccttctcatagagaatctgtgatggtgcaaaagaaatgcgtggacagcagaatgctgtctctgcaatttgagaggaggtgctcttaagcaaacgaagaacaataggtgggccgcggtcccagaagttcgattcactaatgtcccagaaaggacacaaatagatgtaggcagaataccttt

SEQ ID NO: 652499 - DNA, 377 bp, Homo sapiens
gtcggagcagggccacctccgagcagtaatgctaagagttcaccagtcaaggcgaacgactatactcaatcgatccattaacttgaccaccggtacaagtgaccctatggataacagggcaatcctattctagagtccatatcaacaatagaggtgaggagctcgatgtaggatcaggacatcccaatggtgcaggcgctatgagatggtgcgtttgtacagcgataaacgtcctacgtgatcagagttcagaccggagtcctcgaggtcggtgtctatctacttcaaattcctccctgtacgagcgtgcccgcgaaataaggcctatttcacaaagcgcttatccccgtagattgatatcagtctcaagcttagta

SEQ ID NO: 652500 - DNA, 178 bp, Homo sapiens
gcaggagcatactgtttgtctaactggcttaacagtgaggccgatgtcagatgcctcagctaagccagggaattcttttgccttgagtctcgtatccagaacgttatgggtttgcagctgctacaggtttctttaggaatgctacattatgtgttagctctgagagaatgtttccttt

SEQ ID NO: 652501 - DNA, 169 bp, Homo sapiens
agcgctactttgtattttattccttggcgaaaccaaaaaggatgtacctaagtagactcttctgtcccggctccttcgcacaagtgagggagagatcagaccacgagatatatcatctctccaccctgctctcggtttcgcctggattaaaagccaaggtgaagcgggt

SEQ ID NO: 652502 - DNA, 421 bp, Homo sapiens
ggaagtgaaaaaaaaaaaaaaaaaaaatttataaaaaaaaaaaaaaaaaaaaaaaaaaaaaaagaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttgggcccccctttcccccatctttttttaactcacaacatttttttcccccccccccaatttggccccttttggaaaatccccccttatggggggcgtttaaaaatatttggcccccttttttaaaaaccctaacctggaaaaacccggggtttccccaaattaaacccttttgaaaaaaacccccttttcccgggggggaaaaatccaaaaagcccccccccctggcctcttttcaa

SEQ ID NO: 652503 - DNA, 338 bp, Homo sapiens
ctcgagtctgtgagctcgctcatgaaccagaagatgatacgtcctgctccggtaacttgcccacattccctacaagagtaagagtcttgccccagctgtgaacgctctctggctgtcagtgaggtgggatcgtgtaacctaaaatgatttcccacattccttgcactcatagggcctttctccagtatgacctcgctgatggtgaacgaggtagccctttagaacaaaagatttcccacattctccacacttgtaaggcctttctccagtgtgaacacgctgatggttaataaagcagaacttctgacgaaaagatttcccacattccccacagtgat

SEQ ID NO: 652504 - DNA, 1307 bp, Homo sapiens
tggggcttaatgtggcttaaattaacgcgtgaatttataatttagccaccacaaattaagtgagaaggtttatagtttttgttttcctgtggctctcactctccaaatctcagccggtgttagaggtattatttcccttctctatacgaggcctttcccgtgtatttggcatgtggtcctctcaattctcccaaagagtgtagttctatacgctttgagtttacacccactctcaaagagggtgacgccactgtgtgtgtggcagaacttcacgtgtgcacaagaaacacgaggctgtgcgaagaggcgtgcgcaccagaggggaaaagtcgtgtgtgtccctctctgtggtgtctgtggagaataaagatactcagagtgtgtcgccacacaacacacagagaaacactcgcaaacatattttttgctgtggagacacatatataaatgcttcctccatatgtatatagagagacacgcggtgtgtggatatctcccacactccactattgaggaagagtcttcaataatcccacactttctctcagaatattctccctgctctatacactatgtgaggcgggtgtatatgcagtatgacgaggagggtctctgtgcttttgtggcccacccacgagctgtgggggcagagtgctgtggggggacagacagtggcgagtgcggcctacacaaggagggccctgtggcgttgagacaacccctcgctggtgaacagtgtgggggccaccaactttcctcggtgggggctgtgaggcgcggtggagtgagcctccgctttgggggaaagaaaaaagtcttcggtcggggcgccgcggtgggggaccaaacaagagaggggggagggcggagagtgttataaaactcctggggagacaacccacctccccgttttggtggctccaccggagggccttcccacccggagggggggtgcagtggcctttagagagaggggggacaggggggataaggaaccttattaaaacagcgggggaatattcccagagaggggcggggtggggcaaaaaacactgtcgtgcagacaagctttcacacaaaaacgcgtgttgggactgtggtcggcgccacacaaaagggcttacccgccagcaacaaatgggggtcttccacacgccggggggagagcgcaataccaccgactactggggggggcgtctctccacggagaagcgcgggtgtcacacaactggtgttgcaaacagaaagaaacaaggcagccaactcagagggagacaacaggagggtgtttccccccacatgtccca

SEQ ID NO: 652505 - DNA, 351 bp, Homo sapiens
ccgggcgatcggacgtgtagtccaggggtgagaaccgtgtcactcacttgctcttatcctgacactcccggcagcgccagagaaagctgccacatacaccacaaaaaccaagcatcccccaatgacgttagccccattgctcgattcactcccaggtgagaattcaggcaaacgtccacaaaggtcacaggcagcgtagcataacggttactgtaataccccattatattaccccttgcaggtcctaaacgaagacatattctcttacgagattgtacatttaacgtgtatctctagaagaaaaatcgggtgtaaacttggcctccgatctagtgactggcggtgaggaca

SEQ ID NO: 652506 - DNA, 1094 bp, Homo sapiens
  misc_feature (281)..(281): n is a, c, g, or t
tgggctccactgtctgttctcctctgccagttttcagttaaaatgcgttgtggcgtgacggactcttggcgatagaggtcccaaggtgtcattgcctgatacagagtacctccacaggtccggatcatgctctgggctgagaccatcatggtgcagttccagcggctggatattgtgtggcttgtgacactggtgctgctgggactgattctggtggcagatgtggaagttctctacgtgcaaaggtcaagtggtaagatctcgccagggacctggtacangaatagaccacgtgcatgcttgaccccttcctacgtacatgacgaaaaaggccccctggattaagcacgtgtcgggtttgcgcgtatacatagatcttcctgaacgcgtaatatttcattgcagagaaagcttgttccaaggggcacatgatccattgatacaacacatggtaggtgcgggcaccggcattcaacattggtgtctgactactccgtctgtggaatcgtagaataagtgagcagtgtggtccgcatgtgactgtgggcaccggatgcgctctatccccgagatgctctttgttgcccggttccctgatcctcctggtggtctcgactccccggagcgctttactggtcgtgtgggtgggccgagagtcctattccaatcagtcgtgtggtttatggcctggtgtctgtccgcagtcatttgccctctgcagtcttagggcgatgggttgacattgccgtcccgtgtcccagtttggtctggttttacggctggggttgtggcgcatctttagcatcatgacgtcttaagggcgggctgcagtgaaccacgtaagccccgtttcctggagatcaggtgacgcgctgaatgctccagaaatatgggtatggggctggcgactttccaatagccctgtaggaagcgttagactcgtctcatgggtacacttaagactgggtcctaaaggtggcgtgcagaaaaaaaacaggcgcgcgcgctctaagtttccgggaggccaaactatacggtctaccagttcttcaaccggcctctaggagaccaaataaacacgcgtggcgaaatgc

SEQ ID NO: 652507 - DNA, 979 bp, Homo sapiens
  misc_feature (305)..(305): n is a, c, g, or t
  misc_feature (314)..(314): n is a, c, g, or t
agcgaattctctgtgcgttgagagtccgtgagacccgtgggctgtgtccaaccgaggaccctctgccttatatcctcctgtcgaaccctaagttctttgtcgctctggcatggaattgacgcccgttgcagtacatttgccaagtggcaccttctttcaatttatgttatattttgctatggtggtgattcatttagtttagctggttgtcttttctcacacatctttctctcgtgtcgtctactacattgttacctgcctcgatttgcttctattcttgtccccaagaaaataagccctgaganctttccgantaaaccagaaagacaaaggaattgaaatgaggctttaacccatgtaacaaaagccgttccaaaatatgttgtctaccactataccacaacacgaaggctttttgttactaggcactaagggcaaaaacattccagaacattagtaacaacaattatatcgttaccaaaatccggcaatctgtccgttgtttttaccaagggactattttactaatgtcttaaaacgccaatgtttagtttactccaaacctttttggataatcttccatttttgaccgcggaaccggctgttgtataggttccgttccggggttttccgttctattgagtacagagtaactttgtggaacttgggcaacttgggaaacaaacgaagtttttttggcaatttaacacattgggaacaacttgggctttttaccatttgtggcgttaagttaaggtttctccaaggggaacttcaacacactgggacaacaacacaagatgaagaattatgaagaatgtctccgaaaagaaagaaggaaataatgctgccgggtggtgcctccgttggaagcaagtgtttttttaaaattttatagggtgtggggttatatataaatttaggaatttttaaggacgaaaaataatgtttttgtgtagaagaataagatggttggaac

SEQ ID NO: 652508 - DNA, 225 bp, Homo sapiens
catgttcgtggcatctgccgacgacaaaggcttcgacctgaagctgtccagcgaagtgcaggacatcacccgcaacaaggacggcttctggcacgtcgagtacaagaacctgaaggacggtaccgagtcggccaccgacgccaagttcctgttcatcggtgctggcggtggcgcactgaagctgttgcagaagtcggccattccggaagccaaggaatacgcagt

SEQ ID NO: 652509 - DNA, 699 bp, Homo sapiens
ctccgggaagagagggtccccccgggtttcgtggcctcgcgggacccccaggccctccgggaagagaggggcccccaggaaggactgggcagaaaggcagcctgggtgaagcaggcgccccaggacactaaggtggcgcaagggagcccccggtcctgctggtgctcgtggggagagcggcctggcaggagcccccggacctgctggacctaccaggccacgccgcgtgggcccccatgggccccctaggaccatggactcgcccgctggatttgatgacgatggaaggctccggggggcccttctggtcaacagcccgaagcgctgatgggccacagggacctcccgcgctgcgcgcgacttacacgggggatcctggcgtgcctgggctgccgggggcgacagggagaagttggacgcagatggaatccccggggttccccggcctccctggcagagagggcattgctgggccccaggggccaaagggagacagaggcagccggggagaaaagggagatccaggaaggacggagtcgggcagcgggctcctggcccccggaccccgggacctgtggtctacgtgtcggagcaggacggatcgtcctgagcgtgcggcactgagggcggcgggttcgcaggcttcccggactgcggaccagggcaactgggcttagggcgaacgagctcccggacaag

SEQ ID NO: 652510 - DNA, 604 bp, Homo sapiens
  misc_feature (589)..(589): n is a, c, g, or t
  misc_feature (592)..(592): n is a, c, g, or t
aattcgcggccgcgtcgacctgcagaagacgacagaagggagggaagtaagggatgagaacaagagtctctgcctggtaatccaggaattcttctggaagttacccaagaccaccacggtggtatctgtacaagcctgcaatagccacagtgttattgggcttggggcacccctaaagtagaaacgggtaaagtgaccaaaaacttagatgactacacccatgtcccttcaaatacctggaaagccttcccaaggataggcagaaacaagcccagactgaaaagactacagtgaatacctaactcttcaaaacccagacactgacaaacacccaaagcatcaagaccttccaggaaaacatgacctcaccaaactaagtcacctgtagccatcctggagagagagagagattgtgagcttcagaagggattcaaatagctgttttgagagctcgtggatccaggtaacacagagagggttcaggtgtattgacaatctatgaagaaggagtataaggatcaagcagggatctggagtgaaaatgcagctggctactgagatgctcaagtctgttatgcgaatagtaaanagnaaaaaagggcgc

SEQ ID NO: 652511 - DNA, 120 bp, Homo sapiens
aattagttagaggataatgtcaggcaacaatctggtcttatcccaaattaagggctgcaagatatgtgacccattagtataaagtgcttatgtccagtgcaaaaaaggcagactcagaag

SEQ ID NO: 652512 - DNA, 300 bp, Homo sapiens
atcatcttgacactcagtatttcaccatcacagatggagtcttgctatgttgcccaggctggtctcaaatccctgtccttaagcaatcctccccccgtcacgctcccaaagtgctgggattaacaggcctgagccactgtacctggcttgttttaatcttttatactgcatttttactgtacttattattattattattattatttttgagacagagtcttgctctgtcccccaggcaggagaatcgcttgaacctgagaggcggaggtggcagtgagccgagatggtaccactgcactc

SEQ ID NO: 652513 - DNA, 143 bp, Homo sapiens
  misc_feature (108)..(108): n is a, c, g, or t
  misc_feature (116)..(116): n is a, c, g, or t
  misc_feature (136)..(136): n is a, c, g, or t
aaacatcctatcatctgtaggctcattcatttggtgtatgcatcggggtagtccgagtaacgtctcggcctatccggaatgccccgacgttactcggactacccgatnataacacnactgaaacaatccatatcantcatttt

SEQ ID NO: 652514 - DNA, 193 bp, Homo sapiens
ataatcaacatccaaccatttaaaatataattgatgcatgcccagatgatcttccacaacctgtgatttaaggaaaaaaattttttaattcctagagactttttttttttcttgggaaatgtagggatgtttctattaaaaatttccctgggcgggttgcgacaacaggaacagagataaagatttgcggccg

SEQ ID NO: 652515 - DNA, 335 bp, Homo sapiens
gaggccctacactgaggcgatacacatgaggtcatacgacatgaggcatccgtacagatgaagctccccaggctccttctgcggcgaggatctgcgcttccactcgtcagcaatgccatcaaggatgcactcgctgcaacgtagccctcggtgctgcacacagcacggggggcaaggatgccccgtcgccctctggctccagctggccgggagcctgatcgaccatgccctggtgagtcccaggctgagcctcagtctccctcccttggggcctatgcagaggtccacaacacacagatttgagctcagccctggtgggcagagaggtagggatg

SEQ ID NO: 652516 - DNA, 317 bp, Homo sapiens
  misc_feature (32)..(33): n is a, c, g, or t
atccctcccccacacacaaagaggaaaaccgnngcttatggaagatatatttgccctccacagaccgcaactgtaccaagcgcaggtttgttttgaaattgtccatgtccttcctgaagcagtatagcagcccgtaggtcttgagcagtgcgtcatgtttgcgcgagcttgtgacaaacttgctgcaggtctgcttgaggatctgcccagcccggcggctgccgacttccaacctccccatcagcgtttggatgccttcctctagcgcctttaggaggagatagtcatcgctgtccgagttgttatacaccagtgtg

SEQ ID NO: 652517 - DNA, 1342 bp, Homo sapiens
ggacggaactggagtgatggaggacagcgagaagaaaggcaagagaaatgcacaagtgtgggcagccgccacgagtgaaaatagagggaagtgtcatgcaagtgctggacagaaggcggcagcgtgggacgagcccacagagcccccatcctcaaaaaacgaccacctccaggactcaggtgatccctggggggcaggcgtctgaccagacccatcggaccaacacgatgggctccggcaacccatggtcccagtgccttggatggagacggccagtatctggcaggcacagatgtggtgctctggaatccagtacccattaccattcctggccacgcctgtccagacggccatcttacagaccgaaattcaggcccatacatatacctgggagaccccaggattgaaggcacgagcagtaccacggggctggtaggagcccaaaagggatcaaggggaaagccatctggccatgagagggtatggaggcacgcattccccaaaggtgctggaacccggcacgggaggaaggcccaggagctggagtccatgacagacacaggaaactggggccatgacaacacaaggccgaggctcaagaacattgtacatgggaccaatggagcattaattgaccgcttgtgacctttggagcagaaccatgaggcactgcaacaatggtgcagagaggaagacgcatgggcgcgaacacaccagaagccaaaacgacaagatgacacaagacacacaaaccgcacagaaggaattgacacaaaagaatttcaatgcaccacagaacaacaacatacataaaaaacacaaaaacatacaaccaacccaccaaactaacatatccacaaacaatcaaacacaccaaaacatacacaaacagacacaacaacaacaccacacacacttcaacacaacacaacagccctacaacacaacatacacaacaaccactacataaatacaacacacctcactaccaacaccaccaccacaaattcacacaaaaacgagataataatattataagtaaactctatattctaatacatacaatcactaccataccttaccacaaccacattaaatcataatcgcgaatatactacgaaacaccgatacacagcaatagactaacaactcaagccaacgcatacaactaacaaacatagtacaactcacaacaaaatacaaccacacagaaacacaacaatacagcacacagtatcaacacacacacacacctaccacaacgaaccatcacatccacatcctacatcgtcgtaatcagtactccacaatctgatacctacactaaccataatcgcataag

SEQ ID NO: 652518 - DNA, 202 bp, Homo sapiens
gcaagatgagagtaccagcctacacgagctataggagatacgtggcaaccgtactgtgcatccccgctacccaccttagcatacctgttcctggccactactcttgggatcagcatcagaacccagagccaggctctatactgagagtaaagagtgtgcaggcacccaggttgacctgcaggtgatagggggaaaactacca

SEQ ID NO: 652519 - DNA, 110 bp, Homo sapiens
agacagaagcatagcccctctccaccagccctactcctgcggctgactgccccccagttctccctcatctccacccatgttatgttatgtaaaaataaataatagaaatg

SEQ ID NO: 652520 - DNA, 801 bp, Homo sapiens
  misc_feature (801)..(801): n is a, c, g, or t
ctcaccataaaggctccgccgacgccgagcctaccgcacacccccactcgagtagtcacatgaaaaccctgttataagatgtggccctcctctctgttagttttgaggacactgaagctctcccaggtgtaccccacgctgtacttgtcacctcgaattgagcatgcacttggaggctcctcagctcttcatatcccagcttttccagccaggaagatgtcccatcgattacgttcctcaagtatgccaccagctcaccaccaccgtgtcgtacgtgatacaacggtatcacacaattaagagatgttcacgctgctctcctcacacacattcgaacccggtgctagccccatgtgatcccccccgctcaaccacccaaaccctcatccccccctgtccccatttctgctttacccttcccacttaccacgctacctcctatatcagacacaactaccccctctcatccccttccgcgattaaccttcgccccccgtaccttctaacccacggcccacgaccaactccctgccatccactcccccctctatccgccattaccactcccgctccgccccatcccaccaccctttctcatcatcctaccaatatataaatcgactgcgacgcgtcgaaaccccacccccaatctccctccctattccacttatcgacgatagaccctgaaaccacccccacatattaccaatagttccccctgccattgccatcaaatcgccctctttcctactccaccccaccacgccggaagcccacacacaacttacctcgcacccccgn

SEQ ID NO: 652521 - DNA, 750 bp, Homo sapiens
  misc_feature (25)..(25): n is a, c, g, or t
  misc_feature (131)..(131): n is a, c, g, or t
  misc_feature (141)..(143): n is a, c, g, or t
  misc_feature (146)..(146): n is a, c, g, or t
  misc_feature (148)..(148): n is a, c, g, or t
  misc_feature (150)..(153): n is a, c, g, or t
  misc_feature (155)..(156): n is a, c, g, or t
  misc_feature (158)..(158): n is a, c, g, or t
  misc_feature (162)..(162): n is a, c, g, or t
  misc_feature (165)..(166): n is a, c, g, or t
  misc_feature (170)..(171): n is a, c, g, or t
  misc_feature (176)..(177): n is a, c, g, or t
  misc_feature (181)..(181): n is a, c, g, or t
  misc_feature (184)..(184): n is a, c, g, or t
  misc_feature (188)..(188): n is a, c, g, or t
  misc_feature (192)..(192): n is a, c, g, or t
  misc_feature (227)..(227): n is a, c, g, or t
  misc_feature (234)..(234): n is a, c, g, or t
  misc_feature (242)..(242): n is a, c, g, or t
  misc_feature (252)..(254): n is a, c, g, or t
  misc_feature (256)..(257): n is a, c, g, or t
  misc_feature (260)..(261): n is a, c, g, or t
  misc_feature (263)..(263): n is a, c, g, or t
  misc_feature (268)..(268): n is a, c, g, or t
  misc_feature (270)..(270): n is a, c, g, or t
  misc_feature (275)..(276): n is a, c, g, or t
  misc_feature (279)..(279): n is a, c, g, or t
  misc_feature (283)..(283): n is a, c, g, or t
  misc_feature (287)..(287): n is a, c, g, or t
  misc_feature (291)..(292): n is a, c, g, or t
  misc_feature (294)..(296): n is a, c, g, or t
  misc_feature (299)..(300): n is a, c, g, or t
  misc_feature (305)..(305): n is a, c, g, or t
  misc_feature (311)..(312): n is a, c, g, or t
  misc_feature (316)..(316): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (330)..(330): n is a, c, g, or t
  misc_feature (333)..(333): n is a, c, g, or t
  misc_feature (341)..(341): n is a, c, g, or t
  misc_feature (358)..(358): n is a, c, g, or t
  misc_feature (360)..(360): n is a, c, g, or t
  misc_feature (363)..(364): n is a, c, g, or t
  misc_feature (366)..(366): n is a, c, g, or t
  misc_feature (368)..(371): n is a, c, g, or t
  misc_feature (381)..(381): n is a, c, g, or t
  misc_feature (390)..(391): n is a, c, g, or t
  misc_feature (397)..(397): n is a, c, g, or t
  misc_feature (400)..(400): n is a, c, g, or t
  misc_feature (404)..(404): n is a, c, g, or t
  misc_feature (429)..(429): n is a, c, g, or t
  misc_feature (438)..(438): n is a, c, g, or t
  misc_feature (444)..(445): n is a, c, g, or t
  misc_feature (510)..(511): n is a, c, g, or t
  misc_feature (639)..(639): n is a, c, g, or t
  misc_feature (657)..(657): n is a, c, g, or t
  misc_feature (659)..(659): n is a, c, g, or t
  misc_feature (735)..(735): n is a, c, g, or t
gggaatgtgtatatattatcaatcnaggggggcttgggtttaaaataaaatttctttattgcaagtgtccaagtccttaggatttgtccttaaaggtactagaagatgagtaagaccacacacaccaggantatgtttagnnnttngngnnnncnngnaaanggnnggtnngttcnngggnggnttgnatcngacatcacagtacatgaagaaaatctgctttttgngaaaagncaccaggnattttagatnnngnntannanggggngnggggnnggngggnacgngggnnannnggnnggggngagggnngagngggngggngngggnttngggggggngggggagggggggaaananaanngngnnnngggaatagangggaggggnnatttanaanagtntgtttggtaggggggctggggagangtgggagcnacttcnngggcatccctcccctctcccaccaaaacaaacaaacaaaaaacaacaacaacaaaaacactgccnnttatcttgaaagtcaagttaaaactatgtggtgaaaaagagagtgcttgttccaggtaaaggacttcaagataatttacaggcagatttatttttattagtaaaagtcacaaataggaaaagacttantggctgactttgagctgngngcttttaaaaatgtctctattattacgttaacaagaaaaaaaaatcaagcaagtttttgcttccagttttgaatcntccagcaacagttgg

SEQ ID NO: 652522 - DNA, 474 bp, Homo sapiens
  misc_feature (9)..(9): n is a, c, g, or t
  misc_feature (16)..(16): n is a, c, g, or t
  misc_feature (44)..(44): n is a, c, g, or t
  misc_feature (47)..(47): n is a, c, g, or t
cactaagcnaagcccnaaaccccaatagttaaatcaacaaaacngcncgccagaacacgaggagggccaggttaaaacacaaaggaccggccccccccccatatccctctagaggagcccgctctgaaatcgaaaaaccccgatcaacctcaccacctcttgctcagcctatataccgccatcttcagcaaaccctgatgaaggctacaaagtaagcgcaagtaccgaaaaaaaaaaaaaaagagaaaaaaaaaaccttgtcggccgccccggcccaaacaactctaaactcgagcaagctaatgcatgcggcccaaattcgagcccacttggccaaatcccccaatagggagccgcattacaaacaaccggcccgccgcaaaacaaacgccggactgggaaaaccccggcggtacccaaacaaaaacgccttgcagaaaaacccccttccgccaaccggccgaaaaccaagag

SEQ ID NO: 652523 - DNA, 344 bp, Homo sapiens
gtaaacgaggaggtgtttactataagcgcctgccaacacgcccagtctaatttaaaagtattgtggagtagggataggggtaaatcattaatggccaggatggtatcgatactcttgagctcgtgatctgaccgcctcagactcccaaagtgctgggattacaggtgtgagccaccgtgtcccgccctggatttgatatcttgaaaataaccctggaaaagttaagactttttattttattttaatagggatgggaatatcgctattagtagtccaggctggaagtgctatggcgcaatctcgggtcaccacaaactactgctccccgggttcaggtaactctt

SEQ ID NO: 652524 - DNA, 224 bp, Homo sapiens
ccccttttagcccggcccccgaaaaaaggggctttttccccccctcatttgcccaaggggccctttttaagttaagggggttttttaaaggggcccaccccctgttttttttttttaattggggggcccagggcgggggaacttttttggggtttttgtttttttaaagcccccccccccggatttttttgggggtttaaaaaggtttttttttttttcccata

SEQ ID NO: 652525 - DNA, 133 bp, Homo sapiens
cgttggcgatcactgtactaacctcaaatatcagctatttctaaacaatttgggcttatatttttcttttttcttttcttttttgagatagtcttgctcctgttgcctaggcaggagtacagtgatcgaccaa

SEQ ID NO: 652526 - DNA, 182 bp, Homo sapiens
  misc_feature (7)..(7): n is a, c, g, or t
atctgcnagaagatggttggggatagcaccccttttaccactgactggttgcagaagcgcccatagagcactgggctccggaaggacacagcattgtagctttcgccatgtactattttacctatgacccgtggatctggcaggttgttgtatctcgaggtcttctccgcgatgagtgatca

SEQ ID NO: 652527 - DNA, 100 bp, Homo sapiens
atgatatgcacagatgtctgtctgcagattggctacccaactgatatgcatcagataccccatactatcatcaacgggatacaaaaagagtccatggact

SEQ ID NO: 652528 - DNA, 708 bp, Homo sapiens
  misc_feature (15)..(15): n is a, c, g, or t
  misc_feature (87)..(87): n is a, c, g, or t
  misc_feature (119)..(119): n is a, c, g, or t
  misc_feature (128)..(128): n is a, c, g, or t
  misc_feature (137)..(137): n is a, c, g, or t
  misc_feature (141)..(141): n is a, c, g, or t
  misc_feature (181)..(181): n is a, c, g, or t
  misc_feature (206)..(206): n is a, c, g, or t
  misc_feature (217)..(217): n is a, c, g, or t
  misc_feature (237)..(237): n is a, c, g, or t
  misc_feature (260)..(260): n is a, c, g, or t
  misc_feature (276)..(276): n is a, c, g, or t
  misc_feature (283)..(283): n is a, c, g, or t
  misc_feature (287)..(287): n is a, c, g, or t
  misc_feature (304)..(304): n is a, c, g, or t
  misc_feature (328)..(328): n is a, c, g, or t
  misc_feature (332)..(332): n is a, c, g, or t
  misc_feature (346)..(346): n is a, c, g, or t
  misc_feature (375)..(375): n is a, c, g, or t
  misc_feature (378)..(378): n is a, c, g, or t
  misc_feature (394)..(400): n is a, c, g, or t
  misc_feature (658)..(658): n is a, c, g, or t
  misc_feature (681)..(681): n is a, c, g, or t
aaaaacttcgttttnatcttctgccttcattattctttcaatatctacgtaaaaagaaatcgtttctcccaataaaatatgtggttnaaacctcagcaaggacgcacaggccctaaaanaacccagcnctccaacangganacctggaccctcccatttaaatgcagccttgtatgtatgnaccggggctctgccctggtcctgtnacccctgaaangtccgtaaggaaggaatgcnaaaaaggatctgtatgatgtgtnaactctgagtaaatanaagaagntgcnaggagcccccagctgangattaaaaggaaggctgtgtctgnatcnatttaaaaaaatgnagtaatgaattaacagcgtctgcaatggnaanaaccattaaaagcacnnnnnnngggggttttgggaaacgggctcagaaaggagcaaggtgtgttcgttccatttttgccttaggtggctgttccgttacccaggctatgctgtttcagtggccaggtggctgaggaggaagtttgaaggccgcatagttgcaagttgcttccctagggcctgcaggggacagcataggcccaaagctagaggaagcttggaagggcgcccacactgggtcctgcggggctctgcatactgcaggccaccatggcgctacnccttaccctctggagtttgtttnatccaggagaagacagctggctggcct

SEQ ID NO: 652529 - DNA, 570 bp, Homo sapiens
gaatgattaaagtgtcagtcggtgtctgtggtgtatatggacacatactgactacttttattttggtaagcttgatactctacgtacggtttagcaacttccttaatatgtcaagaaatacctttccaagagcttatatatttacatattatgtaatttctaatggttgctttcaaccaaatgactgtatcgtaatatatatagccagtttccttgttagacagctgcattggtgaccatcttagtagttatacctgatcatctgtgactgaatagctgttcaggtacctggcacagaattagtaactgcctgctcatcttccaagctaaaaggaaaaacacttctcttctgactttgttacttttttaattactaatgagttaaactttttgtttatgaccattcctattctgtaaggatattcctgtttatgtcctttgcccatttttttcctcttgagatattcatcttttgttaatttctaaaagctctttttgccaacagtgagattcctgtatctgtggagatttttcctcagttttacttttggttttgtttctggtgtttta

SEQ ID NO: 652530 - DNA, 316 bp, Homo sapiens
acaagaggacccctcttctcctaaaaggcaacgatggagtagagacctgaaggacacgtgtagagagagagagaaagccacgtgtatatctgcacaatagaggcttcttggactgcagggtatattttgaaggtagagagccagcccgacttgttaatggatcagatttgaagtgtgagagatgtgggagtgggggcctgtttaaggctaaggcccatcgtgcatgagccccggctgacggtggctccggagagctttccagtgttaggactcagtaagtgcggcgagtcttttcaatgttgcctttcggagaaga

SEQ ID NO: 652531 - DNA, 384 bp, Homo sapiens
taccaccatcatcgtgctgtctttctcttcacagcgtgtacaccgatgagcttctgttatacacctatgttcttattgtttacttgtatgtccccctgactggaatgtaaagccccccgagggcagagaggtggcttactattcagagatgggccctacacatcacaggacagacccattgaggagggagggacaggctgggctgcctggaaccttatacttcagactaaatcttgcgcaccacagtgccctgggcagtcctaacatccctttgtttgtgtgcccagagcattcagactcgagccagccattatctccggcgactttatctctctaagtatctgttctgctcctacgtcagctactttgaattcccaggcacca

SEQ ID NO: 652532 - DNA, 283 bp, Homo sapiens
aggcccctttttggggggattgcccccccatggtgaagtaatgggtttttaataaagccctatccggccccccggttttccccctgaaaaacccccttttttggggggtttttttttttttttttttggtttgccccgggcggggggggcccccccgtgccgggtccccccggggggggggcaaatgtttttaaattttggttgatggggtgggttttcccctttttttaaataaccggggaaaatgttttccaaaaaaaatttaattaattaattccgggga

SEQ ID NO: 652533 - DNA, 1023 bp, Homo sapiens
acctgcagtcccagctactgggcagcctgaagcagcaggatggtgtgaacccaggaggtggagcttgcagtgagccgaggtcgcgccaccgcactccagcctgggccacacagcgagattccgtcagaatcagttacttttcgggcacagccccaggccacttactgtgagcctttttctttctcaacaccacattccccacagggaaaacacatttctcacctcaaaagaagacaagacaacgagcaaacaagaaggagcagcaggaggggttctgagccgaggatgccgggcagacatgagggagacacgcacccccgaatccaaccagtgcctcggcacaacgacaaatgtcttcacgtcacagacctttagaagctcctgggcagacctgaaccaaggctcctgactggtctgtttggctcacatggtgttgagattttgccatcactcaatattcagatttcttataaatatccagatttccagcttctcttggaaaatcagaaaaaaacagcactgaactcctaggcccacaaggcactccccagtgaacagatgaaactgtcctctgctgcggggcaggagtctccaggtcacccccatccctccccacctgcctggaccctgaagaagccttctgagtctgtggctcaacgtgcgatgtgcagtgcaagggcctgccccgtagcctgccccgtaggctgccccgcagcctgccccgtaggctgccccatagcctgccccgtaagctgccccgtagcctgccccgtaggctgccccgtaggctccatggccactgccccacaaggcctgtctccacaggaatgggaagcggacagggagacgggcagcagctcacatgctgggacaacgcagtgttcaatccattctccatccagcagctccagacatctttccagaacacaaacctgaccccatcacctctctgcttagccactggcttaaactgccaatggtttgcctgcatgtaaaataaagccattctttaccattaaaaaa

SEQ ID NO: 652534 - DNA, 102 bp, Homo sapiens
tacagaagccactaaatcccctagtaaatgaaactgtgagtccaaagaggaacagctcttaggacactaggaaaaaaccttgtagagagagggggatcctcc

SEQ ID NO: 652535 - DNA, 366 bp, Homo sapiens
cgtcactagaggatcccaagcacaccctgaaaagaaccaagcacaccctagatgaaaattaagtaacttaactttcaaagtcacgttgaacctaaggtacctctaagatactatttccttaggaaaagatcattgatgattgtttaaatgttttcccttctacactgtcccatctgctcattgtacactggccctctagagaatttcactaatccccacagcttgggcaagccccataaagcagagattcccaagcctacaactctaatgcacagctttccctgggatcccaagccatatatcccttctactgtagaaatacactcaggtgtccctaggtgaacaacttccaacatggggtgtgct

SEQ ID NO: 652536 - DNA, 160 bp, Homo sapiens
cgacggaaggtagctgtactgtatggtgaaggataaaatccgttctgtatagccgtagttgggtcgtaaggtaagtgtcattccagcaagtctcacctctccttctctatgctatggtcttccattagggatgtatttgtttgggttctgtctctatttt

SEQ ID NO: 652537 - DNA, 707 bp, Homo sapiens
taaacttgggcccattgatctatctaaaccggggggggaaaattatccccacatggtgctcagggaaaggactcaattggcaactggtgccctccacactatccttacttctggtgctccactctggataccagagtgcagccatgcagagggttatccagctcgggtcacccgattcctttacaccaaatggcgtcctaacgggaagatctcattttcccctggtggggtaggaaccgatgccagtggggagggatgtgcccctgaccattaacgacggttgttttttttttttttttaaacacgaagggcaattcagtgaggcgcgcagagaattgccacccatgggtgaaaccccgagcacaaaagtgtgcgtttataaaccctgtggaacggtgcacaaggtggcgccccataagagaatctccctatagtggttttagaacggcgtgcggcgaaacggacggggtcgtcgacagtttccgcaccaacgaaaaaggggggggccaactatgtgagacagacaaagaccaaggggagcacacccatttccccctctgggaacacatttgggagcggtcgtaaaaccccctgtttgtgtgttggtgtgtttaaaaaaaaaaagaaaacaacttaggtggcttctactcttatggagtattcaaaacatattaaaaaaaagtgtctccccacgtgagaaaacaaaa

SEQ ID NO: 652538 - DNA, 363 bp, Homo sapiens
  misc_feature (30)..(30): n is a, c, g, or t
ccagcacccaagctttccttgcccccgtgngggccccccgacctaggcgatggaagctccacccctggcagggtgggcagtccggatcagttgcccctggcctgttccccccatgatttaaggccctgcttcctccccgccgacgcccgcccggattgctcccccagccccggggcccctttggacctcgggacctggaccccgtcctggctgcccaggaggggcccctggcatgggttaaaaaatccttccccccaaaagggcccctccctttttctggcagggcaacaggggggcttaaggctggaacggagggcctttctgggggttggattgggggtaataaacccgggcggaaacgga

SEQ ID NO: 652539 - DNA, 1540 bp, Homo sapiens
  misc_feature (452)..(452): n is a, c, g, or t
gtctggacccggagcaccctgtacgatgtgccccgctagaactggtgtgtctatcctcctgacggtgtgctgactggtggcgttgtgtcgacagtggctgtggtatgcgtgtgccgtcccccagcatgacacggtgaagcccctagcagagggtcaatgcgccttgatcggctcttccagcaccgtgcaggactacggcatgcagccagtatcttgctgttcctcctgtgtgacggttgagcaggcggtcctaggagtccagtgagaacactcctaggaggcttggacacgttagctcagtggagcggctcctagaggctgcagtggttggctacacatgcgtgttgtagaagccgtccaccccgtattgccacatctctttactcggacccctgggactggaggcaaggcgcacgagatgacggaacgtcggcgtaggcatgggtctgatnagacgacccccgcctgtagtcgcatcacgtgcacgtgcgtcttggatgtctggggcatgcatggctacgtgccctgacattggttggacgcggggcgtctcacataaatgtgtagccggctctcggcgatgtacttggatctagggaatggcatttgccccaccgttacagaccggcgggtgtgagggcgcgagagtgtgcctgggccccaaccaagcatctcgtgtaaccaccggttggcactcttggcagttgtcccaatagggctctataagggccgcagggaccaaggcactggcgaaccgaataggggattcgcgtcggtggaacgcgtgtttggccaaacgcgatgtagccggggctttgggggttggtgtgcgacctactatgggtctccatggcgtctcccattgccggctaccggcttcgtgtcccgggggggggaatgtggcgttccttcggtgtgccacgcccgtcggccctttctggacgcaggcactccgttggcggatcccccgtgtcttgtgggttggtgcgccgatggcgtccctgcctggggggccttggtttgccacccctggaggggatctgggcccacactgcacagctgcattcgtgttccctcactccttttgacacattgggcgcagctgtggctacacttagctgccttccatgctgtgaggcgttccgttctcccgcgggaccaggtggatcccacatggtggcccctccctctgaccgcttctcgggaggggtccttgcgacgtgtggggcggcttggggttccccctcctttggaagcccccagaatacgccccccctactgggggaccccacttagaccaaaacgactgcattattccaaggataaagagaaacccccacttgggcgcggccaaagcccaccttgaaagctcacagcagttctcccatgccacatcgtcgactacagtgggggcagataacagaggcacctcgagagaagagagcggcatgggattgaaaggcaaactgagagccaacctaatcagccacgcttggacacaggtaggaaattgcgtgcgaccatgagaggcacgtggagg

SEQ ID NO: 652540 - DNA, 100 bp, Homo sapiens
taataagccggccctcatccatgtcacaacaacaacttctgtgacaaaaaccaagagcaggatgatgacaaacgtggcaagtcacagcgactttcccgga

SEQ ID NO: 652541 - DNA, 131 bp, Homo sapiens
tgtgtggatacctccagccccaaggccgggaaagcggccctggagaccggggcccacgtgccccgcccccgcgcgtggcatgccctgcgcaccctgcgccactccatccgggaacctcggctcccgccatt

SEQ ID NO: 652542 - DNA, 909 bp, Homo sapiens
ctgataaaaagaggggccccctccctgtgtgcgcacttatggagacacggtagaaataaggagcgtgcccctcggagagcccgggcccccggcaaagcgggcttctaatacggaaaccccttgggcccgcgggccccaaactaagggcccacaaaatgaggggaggccccgcaccccgaggcagtcctgtatcgcggaaatccgagctcatacttgcgccgcgggaagcaggtagccgtcccaggtgccgggagacacaggcgtacttgaaaaccgccccgtaaacgtaagataaagtggcgctcccacacgcgctgctgtcagccgaccgtcactagtatccatggaggattttaagaattggtggaagcaacaaaaaaacccttgtaatttaccccccccaagttttgcaaaaaacgtggggttataccccacccttactgtgggacacccaacggtgggagaaaaatcctccccgtgctttcctcgacgaggataattagatccccctcgttcaccaccggagcatatggaagatttcccccccgggtgactgacaatgctgggacaaagcgtgaaggaagagattctttagaaagatgttttcccacccctctgcctcattaagaatacacttcaatgtataatatgaacaaaagactcctcacatatggtattgtcattaccaccccccacgcatttctacccaccaagccactcccacgcctggcacaaaaacattgtcttcgaggagatagtctaaagcagctaactcccactcggaattatttccttcatcaacttatttaaaagagattgattccaaaacagatctctctggccattttacccacctggctctttcaacccctaaatgcactattagaaaaaccccggcccacaaaaaca

SEQ ID NO: 652543 - DNA, 390 bp, Homo sapiens
  misc_feature (371)..(371): n is a, c, g, or t
ctctacaggatccctgagggtgaaggtcaaatattgagatgctagcatatggcaagagccttcttgcagcctcctcacatggcacaaaggcaaagagagtgagtgagtgtgtgtgcacgcacactggtgaggggggctagtccgcttctgtgataacaagcctactctcgctataatggccttagttcatccatgagggcagagtcctcatgacctaaacatctcttaaaaatcccaccttccaatactgtcacaatggcaattaaatttcaatatgagttttggaggggacaaacattcaaaccatagcaggatggctgccactttttcatgtaaattcaaaagcttctgggtgccaagcctggtatgtncttgaatatgctgttttca

SEQ ID NO: 652544 - DNA, 772 bp, Homo sapiens
  misc_feature (209)..(209): n is a, c, g, or t
  misc_feature (250)..(250): n is a, c, g, or t
  misc_feature (397)..(398): n is a, c, g, or t
  misc_feature (462)..(462): n is a, c, g, or t
  misc_feature (532)..(532): n is a, c, g, or t
  misc_feature (584)..(584): n is a, c, g, or t
  misc_feature (587)..(587): n is a, c, g, or t
  misc_feature (589)..(589): n is a, c, g, or t
  misc_feature (596)..(596): n is a, c, g, or t
  misc_feature (603)..(603): n is a, c, g, or t
  misc_feature (676)..(676): n is a, c, g, or t
  misc_feature (678)..(678): n is a, c, g, or t
  misc_feature (680)..(680): n is a, c, g, or t
  misc_feature (689)..(690): n is a, c, g, or t
  misc_feature (698)..(698): n is a, c, g, or t
gtcagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttanttcccattttacatcaaaaagcaaagaggggtactccacancaagcaaaacaggctgtgcactgtatacacgccatattcacaaataaagaagtccagcttgcacagattttgagccactcagtaggagtctgaatgctgatgtgccagaacaacttataactccattagtttcattgggccacattnnctatgttagcaccagatcagtttgcttccccaatgaaatctgtagtagcaaattttattgtganagatctgctaatgaatgacaggtcaacaggtgaaaagaatggaaaactgtggtctccagatgaagaggtncccctgaagtactagcaaaggtacaggcaattaaacttctggtaaggtggcngtngngtatganaaacaancagtctaaatctgccaattcaacccttcgggttattatcagcgatgtggttagctgagggtgacctgacagancnanagaggatcnntcacctcngatattttctcgctgggaatagccggggttagtgcctaatgcagctgtctcacgaaccctggttccgacaactc

SEQ ID NO: 652545 - DNA, 269 bp, Homo sapiens
ttgcaatgtcattaacggagagaggaacgagaagtaagcagagggcgtcttatgattgtgtagatacgggtggaatgtgattttatctggaatgggacggctgattcctacggggttgtatgatcccgtctcgtgcaagaataggaggtggagtgctagctaggggctgcaataatgaagggtaagatgaagtgaaaggtaaagaatcgtgtgagggtgggactggccgtcgagtaacatcctcagattcattgcaacacggtctctca

SEQ ID NO: 652546 - DNA, 384 bp, Homo sapiens
ggtcgaccctccctcttcacctcctgccatgattggaaatttcttgaggcttcctcagccatgcttcttgttcagcctgcagaatcatgatccaattaaaccacttttctttataaaattacccagtctcaggtagttcttcatagcagtgcaagaacagactaatacagaaaattggtactgggaagtagagcattgtatgaagatacctgaaaatgtggaagcagctttggaagtgggtaatgggcagaggttggaacagtttggagagcttagaagaagacaggaaggcctgggccagtggctcatgcctgtaatcccagcactttgggagtctgaggtgggcagatctcaaggtcaggagattgaggccatgctggctag

SEQ ID NO: 652547 - DNA, 1309 bp, Homo sapiens
  misc_feature (481)..(481): n is a, c, g, or t
ggggtaggccttgggaatcgagagaggcaggattcgctgctccgcagcgacggccggaggctggttcgggtcacgagtcgggattagtggggatgacggttgtaccgacgaggtctacatggagagaggtctgttagagaaagacgggtgattcaatctcccggttgcgggctcccgcgcgtggtcccaattcttcgtagcccgcatccatgcgcaaggaaatgaatctgctgggctgatatattgagagtccagtgactcgtggatggtagcacaggatggcgtacacgtgttgggcatggagggccctgaggcatacgatagggacatagggggatggaggtagtctgccataggatggtccaacgggaggaggagtcatacgcagccgcatcaacgggttgtgtgcgaacagttgtagcatcagaaggatcatgggatagtagtcgaacgtggtggggcaagcacgtgcaaccccatnggagccttcgctaacgtctccattcgaagaaaggaccagatggatagacacaaagtagcacacccaggtaggggatatatagcttagaggtagaagtcgcttgacgcacatagtcacggattaacactatgggtgctccacagatggttcaatcaggaggactccacgtgtgcattgttgcattaccttagagtggaaccgaaaggggagggcaagcgaaatggggtagacacgatagtgaactgtcggagcaccgtgtgggcaacgtcacccatggagagaacaggggggccacaggcttggttggccgtcggtcggaattacaagacacactcaatccatagcgaagcggagagaaaggagcggtaagcattgccctattccactggttgaagtgtgggcgttgtggcgtagggacttgctggataactatgcctagaaagacccacagggatacgccttgagttggggatggtcgaatgggatgggaaactcgcttattcatagaagccggtgggaaggaccaggcatggcctccaagcaagaagtttagtgaagctcacggccgggtggttgcaatggcggcctaggggcgaggaggcaaaccaaacgtgaaagcagtgggccacactctgggggggggcaaacttagacgagggcaaggacccattaagcgggcgggttcaacgggacaccaaagggccatgaaatcccaggaagagacggcgtggtggccgagaccggcgaacctttcgcccgtgggccacatttccaatccgaccccactggaatgaaagggcagaggaggaagacctcgggggggaaacc

SEQ ID NO: 652548 - DNA, 551 bp, Homo sapiens
tggagggggagtctcgctctgtcacccaggttggagtgcagtgacgcaatctgagctcactgagaacctccgcctccgtgggttcaagcgattcttctgcctcagcctcccgagttagctcggactacaagtgtggtgttgccaccagtgcccagcataattttggtattttatagtagacagtggggtttcaccatatgggccaggcgtggttcacgaactcttgaccttgtgatcagcccacctgggcctctcaaaggtgctaggacttatagggcattgagccacgcgacacccgaaccctcttataaatttcttaaattgaggtacattgcggactccgtggtcacctcccctttcattcaaaccattccaacaggtttcccattgtgcccgtgagaatataaaaacccaaaaaccctatatgtgtgtggggcccaacaagggccccgtggggtgtgactccaggccccctgtgtactatattcccccagagcctctctattctttctctctcaccacctgtgtgaaactctgtgggggctccacat

SEQ ID NO: 652549 - DNA, 240 bp, Homo sapiens
aatctattttccttggtctcatactaagttttttatgtagtcacttagtaaataacctaacccgcttgttttttccacactaatactagggcgaattcctcattttatttttaagatcatggggcgagggagatgatcgcgagcacgaggacctaagacatcagatgaaaaacaatgcctctattccttcaagtataataaatgatacccgagagtaaagagctacacttcgcacctcta

SEQ ID NO: 652550 - DNA, 629 bp, Homo sapiens
agtgtacctatgtctagggaacagaggctgacagtgactgtaatgctaaggaggccatagaatgagacatgtggaacctgcgtggatgtattatggatgctgaaaggcatcatttagagagaagctggctgagacagaggctgcatcgagctgcaactcgttttcagtcgtggagaacccataggcactcgagctcaccagtgaattgtggcacgagtactatatccagctgtcatacccatagactagcatgtgatactgctagctgctacaggacaccagatgcaccgtgagcactactacctgcgtcacaccttcatgctagtggactcagtgaggatagcatcagtagaagtgtcatacagcctgataacacgcacagcggtgcagactatgcgtgatgctgctagctggacagtgagtactacatagaccgtgtaggatcagacacttctaggtctaggctagaccatgcagacatgaagaggattcgtacagaccacatatccaccagtctggccaagcttgagcatgatggggtgcctttgctgcagacacgcacgtgtacaagccaactacataatatcaagcttgattcctactgccgcattcttacagaccgaccgtgc

SEQ ID NO: 652551 - DNA, 140 bp, Homo sapiens
ggacaggtgcttgccttagtttgtgaaaaacaactcttgcgagcagaacggtggtgactaatgaatgtaatttgttaggttgtcagtgaaggtcaagtcccagcatgcagtggcaaggcattagctttttggaaaatgga

SEQ ID NO: 652552 - DNA, 1026 bp, Homo sapiens
  misc_feature (1005)..(1006): n is a, c, g, or t
tgtcactcctatcggcgtctttacgccgctgggatgggccccgctgcatttgccgaggtgggcgatactactctaggtacttctggtgtgtatgtgtcctcgaccatggtacggctcgtttgttccgcgcccactgtggaacgttctcagctcctctttacgtcgtgtgggtgcctgcgtgttcaatgatcctctccaaaatactgccggggtctatcctaccctcttcggttaatgagcgagagtgccttgtgctgatgccggggacgatacaattctgtgtttgcttttggtcgggggcaagtcggcccattgccgcctgctcgaggttcccaatctagcgtggcacgcgatgagatcagccataacggggaagggatacagttcagtgtcacgtaccgcgcatgttgccaatgcggccctgttgtgtctcggctgacaaccttgcgggtcaactaccgtgggaatcactggcttgagtcatggtaagggtctgccaagcgagggtcgccagtctgtcccccgtattcttcacatgtcaatctggattaccggtctctgacagaggcagggcacttacctgatggccaggcatttggaggagaatgactcgcggtgactagagcatggactctgtccggcggcttacgacgcggggacgcgaccagtgccccgaggatgacatcccattgggctggtgccaaagggaacggacgccttggatctgcagcggcgctcagacgcctatatgagcatccactcacgctgttctccctcccgcaaggaccttctgggaacaggacggcttcgtgacattcggagctaccctgacacgagcaggtcaaccaggatctgcccaaagaggtgttggctgagcttgaggccctggagagaccgtgtgcacaaaatgtgacctgaggccctagttctagcaatgagtactatagcaccctcatctgggaataccgggaaggcaccttgcagaaaatatgagcaatttgatanntaccacatcggcaatgtgca

SEQ ID NO: 652553 - DNA, 346 bp, Homo sapiens
cagcatttgatcttggacggcgcgcacaggtgagcacaccatgttatcccgagtccataccgagagagacagggggcgaggaatacgcagggaacgggaggtgggcccggaaagtgcgcgtccgaggttacacaggagattggaagaagagttgggatttgccggattaggcagagaaatgcctcttgacccccggagggaacagacccgtgtggcgggaggaagagcaacgggaagaggtccgcagtgcgccgaagcctggcgggagcgcagccgcaccgcagaagttcattcgtgcgcccatacggtccaagggcacccctctctcaccgattttgtgcggccg

SEQ ID NO: 652554 - DNA, 973 bp, Homo sapiens
cttcgggaattctgaatccgcgaaacttttcctccggtctatagtggaacattctatgctatgcgagggaattggctgcaatggcgtttgcagagcgatccaaattggctgggaattgccaaactcccatttctgttgcaaaatgcccatcctggggctcggcaaacacgggcaataccggggctcctacacataggtgaaagaaacatatgccaggtaagggctaagtatctatcattcagaggcctgtactcacgataggcctcgctagctgaactgtctgtctagtgaaaagctttgaaggctctaacagacatcctggaggctgctgacagaccgagactttgagcttctacttcaaggcaatatagttgctgcagtacaaggaccttctgttgaagatgagcaggatgatgtgagattgaccggccatcttctcatctgaggacctggcacccttacaaggaagaaggtggaagatatgtggtcctgctgaagaaactatagtaaagagcctgatttcattccttcgcacctttgggatcccaaccccaagattggagttgcttgaccgtcgatgtctgaatggtcatgcatttcccttgtgtggggcctaccaggagctctatggggtattagaccgtctccttgatcaggatctaccaagggccagggatttctactaggcaattccatgtgtgaaactggccaagtaccaaccaggaaattctgtggatctctccacacacactccttcaccttcttcaccagcacctgggaggtgatcaggagtgcagctgtcaaactcacagatgccgttgttctcaatttgaccagccaatatgtggagttactagacagagaacaactgaccacacgacctccaagcacttcgtcaagatccatgtattagttgtccagagagccagcctgaggcttggctttgcagacctaacctgcgagggtgtaaaca

SEQ ID NO: 652555 - DNA, 750 bp, Homo sapiens
  misc_feature (11)..(11): n is a, c, g, or t
  misc_feature (67)..(67): n is a, c, g, or t
  misc_feature (80)..(80): n is a, c, g, or t
  misc_feature (93)..(93): n is a, c, g, or t
  misc_feature (96)..(96): n is a, c, g, or t
  misc_feature (98)..(99): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (111)..(112): n is a, c, g, or t
  misc_feature (116)..(116): n is a, c, g, or t
  misc_feature (129)..(129): n is a, c, g, or t
  misc_feature (139)..(139): n is a, c, g, or t
  misc_feature (146)..(147): n is a, c, g, or t
  misc_feature (149)..(149): n is a, c, g, or t
  misc_feature (167)..(167): n is a, c, g, or t
  misc_feature (173)..(173): n is a, c, g, or t
  misc_feature (190)..(190): n is a, c, g, or t
  misc_feature (195)..(195): n is a, c, g, or t
  misc_feature (207)..(207): n is a, c, g, or t
  misc_feature (209)..(210): n is a, c, g, or t
  misc_feature (212)..(212): n is a, c, g, or t
  misc_feature (224)..(224): n is a, c, g, or t
  misc_feature (228)..(228): n is a, c, g, or t
  misc_feature (230)..(230): n is a, c, g, or t
  misc_feature (256)..(256): n is a, c, g, or t
  misc_feature (304)..(304): n is a, c, g, or t
  misc_feature (422)..(422): n is a, c, g, or t
  misc_feature (691)..(691): n is a, c, g, or t
tcacagcctgnacttcatggtattggttacagattctttacaaaggtgtttacctctctcatgaggncttcttgtttggnttcttcctcaganatntnntntttnanatcnnacancagcactggtttnttcatcagancctcatnntngagcttcgttgttttgtnattttnctaggtttcgtgttggncatgnagctgctctatntnngncagctcaatttntttntnctcctccctggccctctggtacagtntcttcaaacaaaccttgggagaagcctggaggtagatgaagccatgtnatgtgatccggctggcaaactcccacaggagaaaagaatgccagtactgatagatatgccactcgatgtcactgagggaaccattttcaaaaagattctttgcaaagatatacctgtnactgtacacagacctctcaaagatctgtactggcttcctggcctgtaagagtttctcagggaaggggtccagctgtactttcaggcggctcaaaaaggaaaatgtctggaatgtgtaggaccatcgtgctggctcccggtacatcatatccagcaagtttccaagactttgggcagtgcaggctttttgggtgccagcagcctggatattctgccatgttgctacaggttctgtagctacgtgccattctgggtaagttttcgtgagtnacttcacaaacgtggactttcccacagcaatgttgccttcgatggagagccttcggggc

SEQ ID NO: 652556 - DNA, 497 bp, Homo sapiens
taactagaggatccccgtcgccctcctgcactcttactgatttagtagattctaatataggcaaaaataacatgaaattgagaacagtgatcttacataggtactgactgtaagcggatccatgaagctctgggacaaggcagtatctcgaccaggggcgcgctcaaagatcaactgaatgcgagcagtgatcgccaattttcatctcaaaatcgatatatgcttgatattctgccagccttggtgcctctgccatgcaatcagtgcttcttcatagggtttatatttctccagctgctgtagtgcttagtgatagttctgaattactggctctggtataggatcttctgtctattcttcatactactgcaaatgtggcctccatatcatatagtgggatcgccaactgtcgccggatcagactgtggactttctcaagccgatcagtttccacaatcgcactttcaaactctcggtaagcctcccagagggcgagt

SEQ ID NO: 652557 - DNA, 307 bp, Homo sapiens
ttatcatggtgtctggggccaagttttatgggcatggcgtgccatctcttatacagaagaactcgagcccaagaccctagaagtgtagaccttgggaacagaggagaagtgtgctccgttaagcaagctacacagtgccgggggcagactcctagggaagggagcagaaactgggccaggggttccaacccaaaagaaaaggcggctgtaaattactcaaagtgggcgcaatactggggcgcagacactggcggctggcggcaaaacggaggggaaagatggcctccggctaaacctaaggaaatac

SEQ ID NO: 652558 - DNA, 825 bp, Homo sapiens
  misc_feature (264)..(264): n is a, c, g, or t
  misc_feature (732)..(732): n is a, c, g, or t
gacccattctaatcgcaatggcattcctatatgcttaccgagcgattaaattctaggctatatacaattacgctgaggccccaacgttgtaggcccctacgggctactacaacccttcgctgacgcctatataaactcttgcaccaaggagccccgtaacaagcccgccgacatctaccatcacccgtctgacatcacacgcccccgcgaccgtattaagctctcaacctactccgtcttccttctcgttatcttatttgatanccttcgcccacgtgcgcgccgataagcaactccaaaaaccccttccatgggttccaaagccccttcttaaaccgcgtgtagagcgccttcccctggaatctctttagtggtgcctttagggatcccgaacccccatgctttaaaaggcccttaaaaaagatctgggtgttggttgaggccttccccaataatcccccattgcgttaatggaatccccaaaaggtggggtatggaaagggcgcattcccttaaaaacaagtcttcccctaaaaacattctttgagaacccgaggccccgacatgggaattcaacagggtgtcgtggccgaaaccccttgcgcgaaatcgccaatggggtaaagctccgcaagaagcacccaagaacctcccattcctaagtgacgattggaaagccccgggctcttaaacttccgccctcaaaaaggcttccgagatttcgaacccttnttcggttgaagccctttaaccttccaaaaagcgcctaggattttaagcctttgaaaacactttaataccgggtttgtggggcccttcgcgctg

SEQ ID NO: 652559 - DNA, 290 bp, Homo sapiens
tgtgtacgatctagaggatccctgctcatttcatactggcgagcagttttgttgatttaaccgcttgaggtgaagggctaagcatagtggggtatctaatcccagttggggtctagactatggtgtgctcagatagtttaaagccacttacgtagtctatttcgtgtcaccgggagttttttacaactcaggtgagttttagctttatcggggagggggtgatctacaacactctttacgccggcttctattgggaactgatctgagccgggtaccgtgctccgatttcg

SEQ ID NO: 652560 - DNA, 141 bp, Homo sapiens
aatagagtgtcacgtcaatgactagagtgctgatatatagtgacggatcagacgccgaggggcgtttgtcatagagttattgcaggcagtcacatattgataattgtagtgatgccatagatggcccctacgatagaagag

SEQ ID NO: 652561 - DNA, 194 bp, Homo sapiens
ctgctatttctggccagtcaacagaggatgattggctggtttcttctcagtgacaggtcgaacttgacgtgcgggccttacttgcaccatggtgaactcctcctttacaccttcaaattcaagctccaagacaacatcagaggtatcataattcccaggtggagcaatgtaagttacagttcctctgtttcgtg

SEQ ID NO: 652562 - DNA, 556 bp, Homo sapiens
gtggctccaaaggtgtgagccacgagactggcagactgccaacttctgttagcttctgacactgcagcctgaccaatgtcttgagagacccaaagctaaactaactacttaagcgggcccttgcaaccttaactaaagagaattttaacaataaatgtctgttgttttaagccactaagttttggggtagtttgctatatggcaatggataatgcagcgtggctctggaccaggtgttctcaccctgcctctggcaatacagcttgtcctcctgtgaaacaacttcctactactgctgtctttggatgtctcaatgtcccctgttgacttcctttatcctgtcctcaaccctttactaaactctcttcaaacttcacaatggaatatgtcgcctgcttcctgcctggtgcaggttggaattatgaacaagacagacacccttcccttcagagtttatattctagtggggaaaacagacaataaattagccaacaaataaataagcaaggtaatttcagagaccagtaagtaaaacagagaaaccgtcgaattcgag

SEQ ID NO: 652563 - DNA, 628 bp, Homo sapiens
caacccggggttttacccttaaagccttacggccccgtatttgtggttgaattgttagggggatatcaattttcgccccggggaacaagttattacattattacgaattttaaaacggctcacaaataggaattttggccctggaggccaagaattgggcccaaggaatggttggtaagcaggccgtttcagcatcaggcaagtggcttgatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggccctgaacttgaagcatcagatcttgcctaaagagcagtggaccaaatatgaagagggaaatttctaccctgacccggttctgaaaaagggtttttcgggaaaaaaaagaaaaagaagaatgggccaaaaagtaatcatgtagttgaagtctgtggatgccgctgttatgaaaatggttaaacttgaacccacccattttaagaattatttggtctgaaaatgttttcctttaaataaatgtctattgtaatggctgga

SEQ ID NO: 652564 - DNA, 251 bp, Homo sapiens
gcgtagtgcttcagtcatctccaccacacaggtagtgcagacgctctggtagtcgcccttagtgtcttgcatggatactatagtacagtgtacttgccgtatttgctcttgagttcagacctcattttcaagcatgtccacttcactgcgggagaccatgattctgatcaggacctttactcgcgtccccttgcctttcatggagtcatacagccgatcagcaaaatacaggggcttgttctgcatgcact

SEQ ID NO: 652565 - DNA, 866 bp, Homo sapiens
ggggcgccacctaggctaggtacgaggccggtggtgaaaactccgggcccaggttgacgatagtccatgaaaaagctccaccgtggagctcacggaaagctgtctgggacatgatggctcgatacgtgttctccaagttcacggctgtcccgaagaggtctcctgtgggcgagttcctcctagcggggtggcaggaccaaaacctggctggttgggaacaagcttgtcagtgtgacgacaagcgtgggaaccgggagccggtcgttgactaggcctggagctcgggggagctgcgttccggcccggagtgcgagtctccagccccggggtgcatgtgagacagcaccatgtaggcttgccggctggctggtagtcccaggctgggcagccaggtgtcccgtggtgcccggggatcggggtccgttccgatgtcgtggggggcgcattggtcttcgaggttgcggcccgtggagcgtgcctgagtctcccagttcgctgtgagcatgtgctagcttctccaggaccactggactgcgaccagtgcgcgaaatctgagaaggcctcagctggcacccgggttcctgtgcaggagacgacgaatctggtggcctatgtgcccctgctgacccgggtctgggcggagatcctggtccgggaggtgcacagggaagcgccaggtgtggtgatgagcctggatgaaccgcttcagccctttgctcctcggacatcaacaacatgcccctgcaggagctgtctaacgccctcatggcggctgaagcgctttcaaggagccccgggacacagccctgtttccaagttcactgtcggtgccggcagaccaggaaggcaaaacccctctctgctcg

SEQ ID NO: 652566 - DNA, 325 bp, Homo sapiens
  misc_feature (91)..(91): n is a, c, g, or t
tcaactttatacttctgctgctatctaaacaacactggagacagtgaaaaatacttcggtttttcttttccatgcataatgcccttccttngtaggcaaaactgatgccttgttctgcgtaactatggaaaagcctgcgcatcacattcaaaagtcaaggggaaaagacaccttgtactccgagatgggggaaaaaaaaaatccagtcatctcacttagttttaaagtcccccaaattcccaaattaacaaaaccttgagctgttcctttaactactgactccctatgtccttgacttctgcaaaggtgttatctgaagatacat

SEQ ID NO: 652567 - DNA, 134 bp, Homo sapiens
gttggtctcgcccatcctccagacttctcaagttccaccctcaggtctcctggagttggcagcatagaaaagacaaaccttacatctttacacatatatttatttcaattatagattaggaagagataaattag

SEQ ID NO: 652568 - DNA, 354 bp, Homo sapiens
tcaagaggtgaatgtgacactgacactgaggagaaggaaacgtgtttttttgagacggagtctcattctgtcacccaggctggagtgcagtggcacgatctccgctcactgcagcctccacctcccgggttcaagtgattcccctgcctcagcctccccagtggctgggatcacaggtgtgtgccaccacacctggctaatttttgtttattcattcgtgtgttaatggacacaggttgcttccacctcttggctgttgtgaattgtactgctgtgaacatgggtgtacaatgtctgagcccgtgcctccagttctttctgggtgtatagccagaagtggaattgctggatcag

SEQ ID NO: 652569 - DNA, 1601 bp, Homo sapiens
  misc_feature (132)..(132): n is a, c, g, or t
  misc_feature (327)..(327): n is a, c, g, or t
atcaatgtctgagtgatcgctggtctgtgggcctggtgcgcccatctcctagtggcaggagcgggtggaggatcgttccccatggtctgtgaccctctggaatgctcgtacccaggtggggtcctagacagnctcgtatgggcatccgcacgagtggaactacatgttgtggggttaattgggacgactcagcaccatccatgagatgatcatgacgtgtaaggagcggggaagcagggtcctcgcttgcataggcaaggaaagtccggctagggttcactccttccggacgcatatgcgaaggcgattgtatacataactcgaagnacgcgtcagggcgagctcagagacgtaggcgcccgaaagcctcgcgtgctcgtgtcgcgcaatcgaggcatgtggacacagcgactacagcgcaagtcacaggtcgttcctgtaacaccttattggaagtcaccagaacacgcgaagtagaggctcgataccatattccaggcaaccgagtctcgtagcctgtaggaaccttccatctcgcgggtcttgacaatggcacctcgagctaatactatgcctttgacggtacgtttggagctcgttgatatccccagaggagcctcaactcggggacggatactgcgaaactcgcgtcaacagggatttgtgtgctccatccagacgtcagtcgtaaattttttggaccaaaaagtacttctccgaagggatttccttagggggccagaaggcgagattcgaccttatacggcgtccataggggatgcaaagccttctgcttatcgtgggcctttaaccggtaattcctcggagaacacaataccagaaagccaggtgcaaacattgggtcagtaacgaatgggttgtggctgcgatgtaccaagtctcccctatctaaaggtggcagaggaaactttggcagggaaccccgcccaaagctaccagcattcctggggcctagggtaaaggcccatggggcagcatttttgaacccatgttccttggcccggtcaaacatggcgttcctttgagtccaagccggaaagtcccacctagtcctaattccaacaccggtttatcagacactgtggctgcgctaggcttttgcacagtaaaggggaaccccataaggaggtgcggaaaagaaaaaaggttcacagccatttgggcctaagaccgttggggctgcccattctggggcgggttacccgggttaggtccgcccccttgtgggtgggcccaagggcccttccccggaatgaatcgttgagcccttgtgtcaccccggcggcacagagaaggagattaaagagggagattagggggccccaaatcttatgggttgtggtctttttcggggcccagagggaagaattcttggacgaaggggggcgattgggggctaatttttgggacgaccgccagaggaattaagttcacaacaccgaagaaaacatataaagcggaggacggaaaaacggtggctgtgtttgggtgaacagagaaggaggttgtggtccaaaaaaagggggaggaacatatgagacgagaacaaaagagaggtgtgccacgataaggggagaata

SEQ ID NO: 652570 - DNA, 532 bp, Homo sapiens
  misc_feature (246)..(246): n is a, c, g, or t
  misc_feature (249)..(249): n is a, c, g, or t
  misc_feature (260)..(261): n is a, c, g, or t
  misc_feature (267)..(267): n is a, c, g, or t
  misc_feature (271)..(271): n is a, c, g, or t
  misc_feature (284)..(284): n is a, c, g, or t
  misc_feature (497)..(497): n is a, c, g, or t
  misc_feature (523)..(523): n is a, c, g, or t
tggtcggtactgcttactgggcgtatgctcacagcgtgtcctccgtatgcctcacagtttgctccgtacacccgcgtttcctccgtatgccccagtttcctccatatgcctcaatttcctccatacgccccacagtttcctccgtatgccccagtttcctccatacgccccggtttcctccatacaccccacagtttcctccatacgccccacagtttcctccatacgcccagtttcctccatacnccncaatttcctcnntatgcntcantttcctccatacnccccagtttcctccatacgcctcagtttcctctgtatgcttcagtttcctccatacacctcagtttcctccgtctgccttcacagtttcctctataaggcctcagttttcctcagtacaaccccacagttttccttccttacaacttccggtttggcttggtttttggcaaaaatggaattggacaaacaggaacaattgtgggggtgtgggnagggaagtttggggttttggaaggtngttttttaa

SEQ ID NO: 652571 - DNA, 423 bp, Homo sapiens
  misc_feature (25)..(25): n is a, c, g, or t
  misc_feature (47)..(47): n is a, c, g, or t
  misc_feature (207)..(207): n is a, c, g, or t
  misc_feature (239)..(239): n is a, c, g, or t
ctgcccactccagctaactgagagncagtcagagtcagcatctgagnataagccaagaagccatcacggatccccatgatgcagaggactgaagaaggagcaggacaccagcgcccacctggagcgcatgaagaagaacatggaacagaccattaaggacctgcagcaccggctggacgaagccgagcagatcgccctcaaggggcnaagaagcagctgcagaagctggaagccgggtncgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaaggtcaaggccttacaaagc

SEQ ID NO: 652572 - DNA, 393 bp, Homo sapiens
ttaaacccatgagtatgggatatgaatgtcttttttaaatggtaaaatgtgttggctatttaataagttaattaaaatgcagatcaaagcaccaccatgtgctttttccacagatcattaacatttccttaaagaatggaagtacctttgcaaatgcaaatgtactagtaattttcacttaagctgtggagaccgaattccattccaccagtgatcacttagccacgggaaattaaaaaacaaacaaaccaaacaaaaacggtctggggagagggcggtaattagactcaacatgtactgcctttttgcaggctattatgacaggggcttttagcacaaataatagagctaaaaaatgtcctgccacttccattataagaaaacgggattcat

SEQ ID NO: 652573 - DNA, 148 bp, Homo sapiens
caccgctgtgcttgtctgctggcatactcgcgggctcatgtggtggcggcgaccccaagagccatcacgggcaacggctggagtttgattacgtcagatctgtgtcttgtgttgttgcgtgtgttgtgtgtgtgagagatatgtgcgg

SEQ ID NO: 652574 - DNA, 132 bp, Homo sapiens
ggtaccatgctcctacctccactgctccaaaaatattcatctgtttgcaaaagtaaatagaacctcaatcacgagttcagtctgggggctgggaagtagttagcaggaaaaaaattatttggttttaattgt

SEQ ID NO: 652575 - DNA, 828 bp, Homo sapiens
aaggggcttcgttggggggggtttctttgggttgggttgtccgggcggatttgttgttgtgcggcgggggtttttgtgggctcgctttgtatcgacttcggggtgttgggcgctgtttcccggccccctttttttgggcgtggtggtctggggcccgcgctctagcgcgggggcttatccctttgctggtgtgtcccccctccggtggtggtgccccccctttcgctctttcccttcgttcccgtttggttgtttctgcgggtccaggggggtgtgtcccctgaacccccgcgtggtgggtccccctcggagttgtgggattaggtggtatccctaccccgcgcgagcccgccacgttgattctctcgggcctctcgctggtggtgccccgatgttcttctctgggtgtgttttatttggtccccctcgctcttgcccatcgccctctcggtggccctcttgggggttctctcctcgtcgcccccgcatgtctcgggcgcgcgtgtttgtctcgcggcggtcgccaccacttgttgtgtgtttaccccgcggggtcttccccggggctttctcccctctctttttttgcgcgctccccattttctcctcctgccttcttggtctctcgccgcccccccttcgtatttcttctcccttgttccactccccccaccctccacgcggtgggttgtggagaactccccccctctgttattctcggcgctctttgtgtgagagagatagtggggtgtgcacgttagtttttgtagattgtgtcccctcgtctatttgagtgagagggtgtcttcaaaaaacattatgaaaaca

SEQ ID NO: 652576 - DNA, 174 bp, Homo sapiens
  misc_feature (159)..(159): n is a, c, g, or t
tgatatcacatatatcgttcttgcacctttttcatttgatcttcgttgtaacggataactgggttttcaggcgtgtgaatcatagttgtataattcacagtgggaaagtatccatcaatgacgatcaaattcatattaaacgaagcattagtggaccanaattgtcttttaatt

SEQ ID NO: 652577 - DNA, 205 bp, Homo sapiens
ttcggagagtgctcccgaaggccaggccaacaacgccggacctaccgcaggcgaaggtcccaccttactacatgcggagaacccggtgagcgtcgaccacagtattccaaccctcctgtgcaggcagaagttgaaggagggtgcttgacaaccagggtagcaggagaccaaggtaaacccagtgaggcagaaatatgtatccggg

SEQ ID NO: 652578 - DNA, 466 bp, Homo sapiens
ttccatttgttaataattgaagcgcagaaagaaaaggccctttgacaagagagctttaattgtctttgacggggtgttgaacctaccccaacgggcaaaaacaacggttgaataaacttgggatcctcattgtctcactaatatcctaaagcctggccttacaggccgctaaacgagaagttacaagcctcttggagttggggttgaccccacaagtgttttaccattctgggcaaagcagggctccttatcgttagccttgcaggccttcattacagaagttgaaaacccatccataacagctatgaaatggtcagatgccaccctgctctcgggtttgacaagctgaacacgggcacttgggtattcgatgtgcctatacttctgaaaaagtgagcctatacacgtatggaaagtgaatggttttacattaaacattatgctaccaggtgttgtaatcagcctc

SEQ ID NO: 652579 - DNA, 138 bp, Homo sapiens
acgcgtcaacgtaaccaagtatgttatacattgctggtgattgacgttataaaaacccctgcaaactgtctaaacattataaataaacaaaaacacatcaagagttggactagctgggcaaggagttactttgacgcg

SEQ ID NO: 652580 - DNA, 367 bp, Homo sapiens
  misc_feature (27)..(27): n is a, c, g, or t
  misc_feature (237)..(237): n is a, c, g, or t
  misc_feature (319)..(319): n is a, c, g, or t
  misc_feature (323)..(323): n is a, c, g, or t
attctagaacctggcataatagccacnttgtcatcccagtgtaaaagagatgtgtggccagatggggtggctcacatatgtaatcccagcactttgggaagccgaggcaggaggatgacttgagcccaggagttcaagaccagcctgggcaatgttttgtttgtctcacgaaacattttttaaaaaatgagtgtggcatggtgttgtgtgcctatagtcccagctcctcgggaggcntgaggtgggaggatctcttgagcccatgatcatgccattgcactctagcctgggccacagagcaagactctgtcttcaaaanaatnataaaaaggagctgtgattatcccaaggtggggattgtgaatgt

SEQ ID NO: 652581 - DNA, 741 bp, Homo sapiens
  misc_feature (1)..(1): n is a, c, g, or t
  misc_feature (18)..(18): n is a, c, g, or t
  misc_feature (434)..(434): n is a, c, g, or t
  misc_feature (455)..(455): n is a, c, g, or t
  misc_feature (465)..(465): n is a, c, g, or t
  misc_feature (472)..(472): n is a, c, g, or t
  misc_feature (487)..(487): n is a, c, g, or t
  misc_feature (491)..(492): n is a, c, g, or t
  misc_feature (498)..(498): n is a, c, g, or t
  misc_feature (500)..(500): n is a, c, g, or t
  misc_feature (512)..(512): n is a, c, g, or t
  misc_feature (532)..(532): n is a, c, g, or t
  misc_feature (534)..(534): n is a, c, g, or t
  misc_feature (546)..(546): n is a, c, g, or t
  misc_feature (610)..(610): n is a, c, g, or t
  misc_feature (612)..(612): n is a, c, g, or t
  misc_feature (728)..(728): n is a, c, g, or t
ntggctcttctgaggggnaggagaaaaactggtgcagatgttcttttatacagatgaaacatgggttcagaaattacacgtcacttctaaagcaaccagaagagggacacgaaagcaaacctgtacattcactaggaatttgcagtcatttcagatttccactaggtaagaaaatacaattttgcgttagtttttccgtgctcgggtgtatgaaaaaaaaaacccagccgacatgcagcaacgtctccagcgcttaggtccgtaaaaatgttctaagcacatacatgtggaagaattctctcatcattttttgtaaaacaaagcgttctaatattttacagaacaagataggacagtttttttttttcttttaaagaagttgaagtttgaaggtgtgtttcttctaattttaattaccaaatccattttccttntaacttaacacaacaagcctncggttttcanctctctngctcataagctcaanagtnncatcanantcctctttttanagcgaacccaccaccatctntnaagggggaaaanggatgagagatggggaatgtccccagaccagtgccaaaatacgcctttaggttgctatttacanancagggcgttggatgcctctagcaggcctgagaaaagcaggtatcatcatgtgaaccaaagcaaaagatatggctggtgctcagcccctcctgggcattgagtaaccaaactgagancagccacagcctt

SEQ ID NO: 652582 - DNA, 191 bp, Homo sapiens
  misc_feature (24)..(24): n is a, c, g, or t
ttactgcctgcaacgctgaaaagnggcaccggcatttctcaagccgaatgtcatagtcaggtagcagaaagctccaaagggtgtgatgaaggcagtcttcaggcggtcagctgggtccaacttaatctgatggtaccctgagtacgcatccaaaaaaacttaacagctcgggtgttgcaggcgtttgaagg

SEQ ID NO: 652583 - DNA, 845 bp, Homo sapiens
  misc_feature (1)..(1): n is a, c, g, or t
  misc_feature (18)..(18): n is a, c, g, or t
  misc_feature (295)..(295): n is a, c, g, or t
  misc_feature (319)..(319): n is a, c, g, or t
  misc_feature (323)..(323): n is a, c, g, or t
  misc_feature (349)..(349): n is a, c, g, or t
  misc_feature (356)..(356): n is a, c, g, or t
  misc_feature (538)..(538): n is a, c, g, or t
  misc_feature (559)..(559): n is a, c, g, or t
  misc_feature (569)..(569): n is a, c, g, or t
  misc_feature (576)..(576): n is a, c, g, or t
  misc_feature (591)..(591): n is a, c, g, or t
  misc_feature (595)..(596): n is a, c, g, or t
  misc_feature (602)..(602): n is a, c, g, or t
  misc_feature (604)..(604): n is a, c, g, or t
  misc_feature (616)..(616): n is a, c, g, or t
  misc_feature (636)..(636): n is a, c, g, or t
  misc_feature (638)..(638): n is a, c, g, or t
  misc_feature (650)..(650): n is a, c, g, or t
  misc_feature (714)..(714): n is a, c, g, or t
  misc_feature (716)..(716): n is a, c, g, or t
  misc_feature (832)..(832): n is a, c, g, or t
ntggctcttctgaggggnaggagaaaaactggtgcagatgttcttttatacagatgaaacatgggttcagaaattacacgtcacttctaaagcaaccagaagagggacacgaaagcaaacctgtacattcactaggaatttgcagtcatttcagatttccactaggtaagaaaatacaattttgcgttagtttttccgtgctcgggtgtatgaaaaaaaaaacccagccgacatgcagcaacgtctccagcgcttaggtccgtaaaaatgttctaagcacagaagtacatgtggnagaattctctcatcattttttgtnaaanccagccgacatgcagcaacgtctccngcgcttnggtccgtaaaaatgttctaagcacagaagtacatgtggaagaattctctcatcattttttgtaaaacaaagcgttctaatattttacagaacaagataggacagtttttttttttcttttaaagaagttgaagtttgaaggtgtgtttcttctaattttaattaccaaatccattttccttntaacttaacacaacaagcctncggttttcanctctctngctcataagctcaanagtnncatcanantcctctttttanagcgaacccaccaccatctntnaagggggaaaanggatgagagatggggaatgtccccagaccagtgccaaaatacgcctttaggttgctatttacanancagggcgttggatgcctctagcaggcctgagaaaagcaggtatcatcatgtgaaccaaagcaaaagatatggctggtgctcagcccctcctgggcattgagtaaccaaactgagancagccacagcctt

SEQ ID NO: 652584 - DNA, 657 bp, Homo sapiens
  misc_feature (350)..(350): n is a, c, g, or t
  misc_feature (371)..(371): n is a, c, g, or t
  misc_feature (381)..(381): n is a, c, g, or t
  misc_feature (388)..(388): n is a, c, g, or t
  misc_feature (403)..(403): n is a, c, g, or t
  misc_feature (407)..(408): n is a, c, g, or t
  misc_feature (414)..(414): n is a, c, g, or t
  misc_feature (416)..(416): n is a, c, g, or t
  misc_feature (428)..(428): n is a, c, g, or t
  misc_feature (448)..(448): n is a, c, g, or t
  misc_feature (450)..(450): n is a, c, g, or t
  misc_feature (462)..(462): n is a, c, g, or t
  misc_feature (526)..(526): n is a, c, g, or t
  misc_feature (528)..(528): n is a, c, g, or t
  misc_feature (644)..(644): n is a, c, g, or t
gcagagaattgcttgagcccaggaatttgaggctgctttgagctatgatcatgctactgcactatagcctgggcaacagagcaagaccctgcttcaaaacgaaatcaaaaaacaaaaaggaaatcaaacctcccctcacccagccgacatgcagcaacgtctccagcgcttaggtccgtaaaaatgttctaagcacatacatgtggaagaattctctcatcattttttgtaaaacaaagcgttctaatattttacagaacaagataggacagtttttttttttcttttaaagaagttgaagtttgaaggtgtgtttcttctaattttaattaccaaatccattttccttntaacttaacacaacaagcctncggttttcanctctctngctcataagctcaanagtnncatcanantcctctttttanagcgaacccaccaccatctntnaagggggaaaanggatgagagatggggaatgtccccagaccagtgccaaaatacgcctttaggttgctatttacanancagggcgttggatgcctctagcaggcctgagaaaagcaggtatcatcatgtgaaccaaagcaaaagatatggctggtgctcagcccctcctgggcattgagtaaccaaactgagancagccacagcctt

SEQ ID NO: 652585 - DNA, 736 bp, Homo sapiens
  misc_feature (67)..(67): n is a, c, g, or t
ataagaaaatagttgaactgggcacagtgtttcatgcctgtaattccagcacttgggaggccaaggntgggcagattgcttgagctcaggagttctttcagaccagccagggcaacgtggcaggaccttatctctaccaaaaatacaaatagctggtcatggtatgtgcctgtagtcccagctactcgggagactgaggcaggagaatcgctcgaacccgggaggtggaggttgcagtgagctgagatcacgctactgcactgcagcctgggtgacagagtaagattctgtctcgaaaaaaaaaaagacgttaaaaggaacacttttcagtatctttaatttcacatagtgaatctatttgggatcaaatgcttttgatgcggggactgttaaagatattaaaatttttagctgttagtactatgtctcatcttttgatttataggatggtcaccagacctgagatctatggagcagattcggagaattatgagagctactgatgtccctgatacaggtaagtgtagagagaagttaatcggttcggtgtaaagtgtttgcatatttgaactgtgattacatttaggtggaagtaggatggggttatgtacataaagtaaaagagctttttcatagtcaataagccagttacagattactttatttgcagtaatacacaatttttcacttgtgcaatgttcctcaaaatggggaaccttttatttatagtcatatg

SEQ ID NO: 652586 - DNA, 403 bp, Homo sapiens
taggaagggcggtccttttttatttattattcagggtccccttaaaaaggtccccccgttttccatagggaaattttttttaaaaaggggtcaatcctccccttatgcagaggcagctttttcctttgcttttccatgcccagggtggttttggaatatggaggggctgggtagtgccataactagaaaccccccccctttggggtttgccagtccccggtttaaattttgattttatcaaatactggacttcctttgtggacctgagaaatttctccttcccttattttgccgactcccggtcatggggggtcataacttcttttttgcgatagttataaatgtttaataaagtggtttttgtaaagttggagcccaataataaagggtccttcttttttca

SEQ ID NO: 652587 - DNA, 628 bp, Homo sapiens
gtctgcgagaagaagttcgcccgctccgacgagtctgggccgccaccaccggacgcacacgggcgagaagcgcttctcctgccctcggtgctccaagcgcttcacccgcagtgaccacctggccaagcacgcccgccgtcagcccgggcttccaccgcggtaagcctgctccggtgccctggtgcccgcagtactctcccccagcgactcgtctgccctgcatgctggccgggagccctgtgccctggtctccgtgcccagctcagccccgcaggcctgtagggccctcgtgcagccagcctgaccgcaggatgcttctgccatccagggtgtagtgaggagccaacggggggcctggggcccttccagccgtgggcatagccccgtgaagacatcccgtgccccctccagagagtgaggcggggggcctgagagtggagctgggtctgctgacctcgaggtggtctcaggatgggtgacggggggctgtgtctgtaaatagccatgatactacctttcttcccatctgtgcaccggggcccccccaggggcagctcggaggttctccctgctctcttcaccacccggtgttgccccctcccgggtggggtttgcggggtggcgttgc

SEQ ID NO: 652588 - DNA, 518 bp, Homo sapiens
cgtgtgcgtctctattttcaagattgctttggatattcaaggttgcttgagattttcttttttttcttttttgagacagagttttgctgttgttgcccagactggagagcagtggcatgatcttggctcactgcaacctccaccttctggtttcaagcaattctcccacctctggccctcattctctcaacattcaaaagcttgtcacttcatccagttccgaattaacattttactctggctgatgatgaacgtcggggagaaagagacatttgtgctgcatacgggtttattggttataaaatggttatacaattttgattgctggaaactttgctgacatgtaaggtcacatgagatgtgaggctgttcaactttgatcatctgatttctttttagcactgtgtctgaaagtgcctatgtgccgtttttggtgagacatatgtagcatggcttctgtaaaggcacgttgctttttattatagtaatattgtgggcacagaaagggtgaggagtta

SEQ ID NO: 652589 - DNA, 346 bp, Homo sapiens
tcagcaccactggaggaggtacaaaaaaattatttacacaaccttggaaatattaggcataatacacgcagatttaccttttggaacgttccatcttttaaatttggccagtgtttccttcatgctattctaaatgctgtggctgattacttgcccagtgatctcctgtggcagcctctgcttgttctctggcttgcgagtgcatagtgcacgcctccagctcctgtgtaagtaatgcaatagtgctggacaggtaacacagagagggaggcttccagtaagatcggtgtgttacgccccgccatcatgtttggaatggcattaggcagcagaggacgcctgcgag

SEQ ID NO: 652590 - DNA, 264 bp, Homo sapiens
cctattctgaaataaacactttatgctagcactatattagaccagttcgaagtgtaattaatagacagcaagtaaattttttacctaaaggttagttattagtgaagtctacatatttagagagttattcagtaggcagatagtatataggtaggtaactacaatcaaacaatacttttatacatatttgcattatagtagctaacatgtgatagtcagtaacaattctacaaaaacctgtacattatgtcagtatgacgttgc

SEQ ID NO: 652591 - DNA, 142 bp, Homo sapiens
  misc_feature (25)..(25): n is a, c, g, or t
  misc_feature (32)..(32): n is a, c, g, or t
accccacatgcccagatgtccacgngcttgcnatacgcctctttgcaaaggacctcaggggacaggtacctggtgtgccagcgaaaccaaaccatgcctgctggttcccctgacctcgatagctaggccaagtttgccagct

SEQ ID NO: 652592 - DNA, 250 bp, Homo sapiens
  misc_feature (23)..(23): n is a, c, g, or t
  misc_feature (89)..(89): n is a, c, g, or t
  misc_feature (143)..(143): n is a, c, g, or t
atgtcggatatccatcactcccnagccgctgacttagccagtaattttacatttctatagcatacctgctgtgatctattcttgaatgntagccttatatgctcaaatagattacatgttgtctgaaagcaacaaatggaatntacactgcttggcattccacacaacatgtagcacaaacgagcaggctcttaaaaaagatccacaaaagtactgatgaaatttaacattgccccgtggggtaggaggt

SEQ ID NO: 652593 - DNA, 667 bp, Homo sapiens
  misc_feature (19)..(19): n is a, c, g, or t
gggtgtgaagaaaattacntttttttggatgctacttgaacttgatcagcagtggcgacagtggagagtgagacgaaatttcacagcgagctctcagggattcctctgcacaggtgacaccagcccaagccagagctatgcggagctcatgcgctcccagaggtcatcacggaaacattaaagacagtgacagagtcaagatagatgaggatggcagaagtttcaagattgttccgcaccttcaggattgagaccggaaggcttcaaaggctgtcgcaaggaggaagaactggaagaagttcgggaactcagagtttgaccccccggaccatgtggcaccacactgtcagtgacgatgtctctatgacgttcatcaccagcaaagaggactgaactggcaaggaggaggaggaccctatgaacaaactcaaggggcagaagaatcgtgtcctgcgcatctgcaaggcgacactggaccacccgtgccctacaatgatacgctggggcccatgcagaaaagagctgggccgagccagtggggcctgttctactgggaaaaggagaaagctgccgggagagctagaggcggtgcaggcacgcagaacagacggaagtatgtgccgcgagctggcgaggggccagcgcgcgggagtcatgcagccacgaa

SEQ ID NO: 652594 - DNA, 246 bp, Homo sapiens
acttcagcattatgacagcagtagcaaggtcatgcccgggtggctgcgaaactgaaacattcacatgtctattggtaaccaaagccttgcaaaatcttaaagggttggaattgggatattctttatatcattcaaattaacttccaccagatgagcatcgtgttctttagttctcttcaaacctctcttctaccttggttggattgggtggctcatcatataccggaagaatctcgtttagaagct

SEQ ID NO: 652595 - DNA, 124 bp, Homo sapiens
gaacaacttatagatctagacactaaaggattagctggatcagtaaatgagtttcctacattcgtgagactagttgccgatgtgctgtactccctaataaaacaggagtctgatcagtcaattc

SEQ ID NO: 652596 - DNA, 292 bp, Homo sapiens
gcgatgtcggaagaaaccgaaatcctgaccaagaacgagctgtttcttgccgtgacgcgccccgcactttgggcgggcatcccgatcgaggcggcggagatattgctgatctcaagcgcgtcggtgctgatctggagcaacagcccggtatatgatgcgctggtggtcgctttcggctattccatctcacggctgatcgtccgccacaatgtcaacgccttccgcctgctgttcctgtggggccgcaccaagctcggcaatcgcaaccgcacattctggggcggaagcagct

SEQ ID NO: 652597 - DNA, 701 bp, Homo sapiens
tgttgttttcatcaccccctctcttaaacccccccccccccccccccccccaatccccggagggagagggggggagggagaggaggcgaggggaccgcgcccctccccacacacaacaaaaaataaaaagtagggagggggcgcaccctcctctctctcttcctctgcgctctcattataataaataatcaccgccagtgggcgtctctcttcacgtcgatctcctcgcggtagcaaccaacacaacaaaacaagaagacgaggcgcgcgccacgcgagagatgggcgctcagccgatctctctctcgttctcatcgcgcgcggtgagagaggaagtgcgacacacccacctcgtcccgcccccctctcctccgcggtggaggccccgccccccccggcgaggcgggaacaccccagagtgcgcgcggccgcgcgggggcagcccagaacgcacaggagtgcgggcgcgcgacacacacagaggagactcgcgagcgggagagtggcaaacaaacgagctacccagtgcggtgggtcgtgtccctcctctctgcggtgggtggcgtggtggcgcgtccccctctcggcgagcgacgtcgcgcagctaacataagaagcgtgttttcctccacacgacggcgaagcacccccacctccctctatctagaatgttcacgagctctaatctcaaccacccctcc

SEQ ID NO: 652598 - DNA, 1128 bp, Homo sapiens
attttggctccttgagcctgtctgagcgaggggtggcagtgcctggtgccccagaatccgggacatgaagggtcccaagagtctgcgcttgcgtgagagaaatcccagatcctgtgatggtgggacaccagtgagtgatgcctcgatccatctgattggaaggacactgatctggacttgtcaggtatggctggtcttatttagcaagtccaaaagtgctggccagcgagcagcatagtcttcaaggctcctgctccccgcccttacattacttgggacttggacttgctggcttccctgaaacggagcagagcgcagcaggcagaagtgactgcttgcgcggcagtgaccaagcacagacagtccaacagtactctctccctacactggccactgtgtgcagcagagccacacggattgaccacgacaggcatgctagagcgaagcaggcgctgtgtgaccaggcttggcccacacacatatacctggacaatgacatggacatatatacggttcctggctccgtgcgtacgacgaacgtccaattacaccatacccgtggtgttgggtgttgcagctgaaaagaagtacctcgtgggcgcacacctgccgatccgagcacagaagcacgaagcccgtgtgacgctcggctgcgtgacacaccattgcgatagtatcgtagtttgcccctcatgcgtcccgcaacaagcaccacgaacagaacgcgcaattagcggccactgcacagcgggaccacaccattcccgctgctcgccactcctgacgaaaccctaccatggaccaccgggcgaaacgtcaaaggagggtcaccaactccacgcgacaatgcaacggcacccgggcgggcaacttcaggcaacacgcttcaagccgtccacaccaagtgccacaccgaccacggaaatttacagaagggagggcccgcacgccacatgtggggaaaagaggaggatcatccgcggacagcggggatttaacccacatggtgacaggatcaaagcacaatctcttgcacaccgccccccgcatgcaaatgacacccgacagcgcgcaaacaagttgcgaaagcaccatttgctcacatgcaacacctggcacacagcgcca

SEQ ID NO: 652599 - DNA, 176 bp, Homo sapiens
ggcacgaggcagagttgaaggtgaagcgcctgaggaagaagtttgccctgaagacacttcgaaaggcaaggaggaagctcatctatgagaaggcaaagcactatcacaaggagtacaggcagatgtaccgcaatgagaattcgggatggccagtatgaaaggtaaagcttggcaac

SEQ ID NO: 652600 - DNA, 336 bp, Homo sapiens
ggcagataaaaataatagtcccatactcagatctggaaagcgtgtctggggctgtctgatgtcgctatcctgttgtagtgaacacaagtagcagaaaatactgcctgggtccatctgctataaagtctgggtagaacagcattactatgaagaggatgaactcacctaccttcagatggaggaagagtgaagaggacttaggctttagttcctccatgacttttctgtaggcagctacctacctgtaataaagctgagtgcaataggatgccgaagaaaatctgcagccagaagctgttagaaagcactgcagagaacagggtatgaagcagatag

SEQ ID NO: 652601 - DNA, 132 bp, Homo sapiens
cgatcctatgccgttgtcagtgcgcgttgcggattggatgggtttgggtacccgccatggctgcatcaatgcacgcaagatgacatttgctctgcttaaaggcgtccttcagatgagcgagggctcaacgag

SEQ ID NO: 652602 - DNA, 391 bp, Homo sapiens
  misc_feature (244)..(244): n is a, c, g, or t
tgatcagtcatgtgatcagaatgcgtaacagcattgctattggtaccggaacgcatgcctcagatctgctgagaatgtgtgtgtggcgtggctttgcctgggtgtgctgtcatcatcgtgcgcattgttctcatcatctacttccggaagccttgctccaggtgactgattcttccagaccagagtttgatgccagcagcttcggccatccaaacagaggatgctcagatttctcaaatcctgnccaggatctcctcttagggtagaagaagtctctgggacatccctggggtgtgtgtgtagatttcccacctggtgactctgctgtccctgggcttgcatctcagggatcccagagtggcctgcctatcacaaccacaatccttccccc

SEQ ID NO: 652603 - DNA, 100 bp, Homo sapiens
aaaagtgcactcttctatatctactaaaataacaagcattaacacacaaaaggattcatgacagcttaaaaagacacattacatgttcctttacccaagg

SEQ ID NO: 652604 - DNA, 252 bp, Homo sapiens
tggggagtctataattttaaataaatttaaaactagctacaaaatggtcaatcacttcacaaccggacagaggaaacaggaggaatttaatataccttgctataatgattattaatctcacagttaatattccatccatttatataattttttaaaagggttcctttatcagctactaaacttctcagcaattgggtgtgcatagctctagattaagcaacaaagattggtcctgttaacaaaccacggggg

SEQ ID NO: 652605 - DNA, 81 bp, Homo sapiens
  misc_feature (23)..(23): n is a, c, g, or t
  misc_feature (78)..(78): n is a, c, g, or t
tcaccagtcattggccgcgcaanggaggtaagccgagctccagctgcatgtgcccgctcaggtggcacggcatggccntgg

SEQ ID NO: 652606 - DNA, 145 bp, Homo sapiens
gtgctggaccgttgaccaaggtttctcagaagctgctgtttcagactcaatcgaagttagcaggttctgggttccttgacatgtcttcatcgtgcttgtttaacttgccttctcgtgctgcgaccatgggccattttcttgcttc

SEQ ID NO: 652607 - DNA, 1436 bp, Homo sapiens
agttcaatgctgtttcaaacagggcaacaacttcttacttgtggcgggctgggcagcttacgactgtacttaacaaaaacgaacactacaacaactccctcttctaacgcaaacgtaactacccacactctctacgaccctcctagccttctgctgcttacgcacgcgctactctccttctcaacacttctttcttctaacacacgcccaaccctaccctgcgtccactctacacgacacactacacctctctctacgcactcttgctgcttcactagcacagcacacacactaaccctccgtgctaccccaaatccaaacctcctctacctgtggccccaaccaattctcacaaataacccaagcctggcctacgcgacacacgcactactttcctccaactctctatctctctctcacctctggcaccaacgccaacgaaccaccttctctctctaacttaccaaaccatctcaccctgtgaaccttctggcaacctattctgtgctaccccacttctcacctggcggcacttaccttatcaccatactcacttttggaacacacctctcgtctggaccccattagtgcctaaaatttctccccttctctaccacacctttttgcaccaccagacacatcaccaccgcttcccccaatacaataacttcttccccaccgaaagcctacatcctctctaacgccataacggctctcaaaacccattctccccctctaatttctcccttatctcccttttaaacacatctctgtggcacctggggcacgtacacggggggcacaaacaaccttcaaaccaactttggggcccaggaccttctaatttgcggcgaacttactcctcttgtggtgctcccatcttcccctctctgcgtcatcttcactcctcccttgctccacaccaccgccaccacaacctcccttcaattggccccaacttcttctcaaacacggcgcgaacttacaaacaaaagccttctaaagcagggccccacttaattgggcggggcctctcttaaccaaccttgggtaccacaccccccacttccaccggcgtacatctggcgtacacttcttcaccttcgggggtcgccccactttctggccgaactttcctcacatcttcccccggtccgacattacattaaacccttggttcgggccctcacatttccttccccttattatccctttacactggtattctcccatagttccatgtggacgggtttaaggacccattggatctcaaaccatctctcaacaaccacaaccggcaaatacggaaccaaccgcgctcattcaccccacttgggcacgggcatataccggttcacaattctcaacccccatgtaaaccatattgtggggcgcccacagtcttacatgcgcacagctatcacttccataagtcg

SEQ ID NO: 652608 - DNA, 205 bp, Homo sapiens
atatgcgttcccgataacacatagctctgactcttactcctctctctactctgctcgcattgctatagtggaggcggagcagacaggtgacagtctacctcccttagagggactatccacctggagctcgtagactacattctcttaactacagtgttctctattaggggctcattctcacatatatataaacccctgcataacc

SEQ ID NO: 652609 - DNA, 959 bp, Homo sapiens
catagatgacgttggcatcctgatttcacagaaaagtgaatggatatattaatgtttagcaatttgtccgaggatacagagatacaggttgagcatccctaatccaaaaattcaaaatctaaaatgttccaaaatctgaaatttttgaaagcccacatgataccacaagtagaaaattccacacctgactacatgtgatgggtctcagtcaaaatacaggtgcacaacagttttttcagcgtccccaagggaaaaataaagttaccttcatttatttagttcttctttaataccttccttaatatagtgtatatgacacataaatgaatttcctgtttacacatgggtctcgtccccaagatatctcattatgtatatgcaaatattccaaaacctgaaaaaatcctgaatccaaaacacttctggtcccaagcgtttgggatgagggatagtcaacctgtagtaatttgaattcggctcagtctgactccatggggctgaaatcttaaccaatatattgattttgtctaataaacataatatcgtcatgtccgtaattcttttgttgaaatgaaatgcaaattcccatgaactaagctattgccaattccctaaggctgcttgctattctgtttacagtgacaagtacttgataagtgggcttatatactacaatcactttataacaactctttatgagtgccaagtctcttcattcaaggttctcccttattattttcaacacttactttgttttctggacgggtgcgcgggcaccggggggggcggcaggtctcgcggactcggcctggtgggggtctgtgtccccccgtggttgggatgggccccaccccttgtttggtaccggcggcacggggtgccactgttccgccccgtggaagacccgccttgtgcacaccatcttgggtgcgcgtctccgtgcgttcttttttttgtta

SEQ ID NO: 652610 - DNA, 264 bp, Homo sapiens
cagcacagccagagcaatatgcgcaccctcaatgagcctggagcccagaggacgaggtggaggacgaccccaaggtgacagctggaggccaaggagctgtggagaccagttccacaagctaggcacaggagatggtcatcaccaaagtccgggacggcggatgttcccccccgttcaagtgtgcgagtcagcaggcctaggacaagcaaggccaagtaatatcctagctagatgtgacatttgtagccagctcgacgatttgcc

SEQ ID NO: 652611 - DNA, 249 bp, Homo sapiens
  misc_feature (39)..(39): n is a, c, g, or t
  misc_feature (138)..(138): n is a, c, g, or t
ggccgtcctagaccagcggggcctcaggagatggtgcanagtcctggaccagacaaacggcactgggaaagcaggagcccaaaggaaggctggaattcagggaagagccacgtgccaggctgtgacgaaggcgacaanatgaaacagtaggggggcgggggaggcatccaaactctatgtgctgtctttgcactactctgtaaatctaacattattcggaagtgaaagttaaaaatcaaaaaaaaaaaa

SEQ ID NO: 652612 - DNA, 327 bp, Homo sapiens
tctgccatgccagggaagaagacatcatgagcaaaaattaaaatataggttgaggacagagggaagcagctgtatggcttccaactgcaagcccaaggacacagtgacttttgggagggcacaggaggtgctaagcagagccctaaagaggcaactgtcagtgttcatctcacgctaaacttatttaggtcctcactctgttgcccaggctggagtgcagtggcccgatcatggccactgcagcctccacctcccaggctcaagcaatcctcccacctcagcctctcgagtagctgagattacaggcatgtgccaccaaaaaaaaaa

SEQ ID NO: 652613 - DNA, 100 bp, Homo sapiens
ctgcggagcttatactgtggtgggtaaagacagaactatttaattttatccctaaatatagttttgattgtttgttatgatgcaccgtttcagtcaagac

SEQ ID NO: 652614 - DNA, 208 bp, Homo sapiens
gagtagtgcaccaatcacctcctccatctccagaactcttttcatctggcaaaacagaaactctgtctccattaaccactcattcccccttctccagctcctggcctccaccatttgacataaagtctctctaagatatgatagacaccaggtcataaaagcagaatcatacaacatttgtctttagagtgactggcttatttcactt

SEQ ID NO: 652615 - DNA, 130 bp, Homo sapiens
tgctgagatatcagcccgttttcattgctagattacattgatagtgaatttgggaggtcgaggtgggtggatcacctcaggtctggagtttgagaccagcctggccaacatggtgaaccctctctgtact

SEQ ID NO: 652616 - DNA, 397 bp, Homo sapiens
gtaccagggattgctctggtggaagaacttggttctgattgtgccagatagcattgggttctgtcacatatgatcttctgctctcttctggccatctggttcactctggtgttaattggcccaggtgtctctgattgtaactggtctccttggaggcagagagctctgtaatctgagttagggctgatctctttggagacatgcagtgttgtctctgattagagtgggcctccaatgtctctagttagggtagaccttctgtgtctctggttacttcagaaatcctgtaacccttttactgaagatgtcctgtgtccttggttactatggaactcctgaaagacctgcaggctgtagtatttgggcaggaattgggccactgatctggcgtcgacgc

SEQ ID NO: 652617 - DNA, 169 bp, Homo sapiens
gtgggagagtggtccagggtgtgcatactacaaaggtaggtgaaaggtgtatttttttttttcctttaataaggagagtggtatgcttgggcaaacagggtatggctaacacacaaaacaaccagggagacagatttcttggcaaggaatgagcttcgggaaaaaaaaa

SEQ ID NO: 652618 - DNA, 253 bp, Homo sapiens
ctcaacacaagactcatttaaagcaattattatgcactgaatattagaatgacgatgtattctactccttaagatgaaaaaagctgatactatattgtaatagatacaatttgtataccactagtagaaaatgatttgcaattatgtgttaggactttacatattccatcattgaaacatcagtgcattctgtagcatggccatccagctgtacccatgacttacacctgcacatggcctgcgagcgggcatc

SEQ ID NO: 652619 - DNA, 161 bp, Homo sapiens
ccagggcattagacctgttccacaattccaatatccaaaaagctttaaaaagtaaaaagttttctcataacacactgggaagcttaaccccaaccaaagggaggctatttatagtatttaccctaactaagggagggattttcttttcttgaaaaacactt

SEQ ID NO: 652620 - DNA, 154 bp, Homo sapiens
ctgcgcagtatgtggagtaggttatacttagtggaatggttatttcatggaagagaagtcattggaggtaggattgacagtatattgtgaagtgtgatttgaacagcacatatgctctggtttgctcaacataactagcagtttattgcttaca

SEQ ID NO: 652621 - DNA, 377 bp, Homo sapiens
acgaatgcctaatccaaggattcccaaaatcagcccgcacatccacggttttgcggagtggggggctagtaactaatcgcttagcgtgggttgccgatactaaccgaagctttgagagccgtttggtccggtactcttgttttgcgagaatacgactaggcacctggaagaatagtgtagtttcctgcgcgttcgtacgccttcatacgcgtccgttggggcttttgttgggataaggcccgctgtccgtgctccggttgactgaataccttttttcccccgtctgatggtttgcggttggttaagaagctttttgtgattgtgtttgagaagggaagacgtattttgctctgtgtcggctttcttttcctacttgg

SEQ ID NO: 652622 - DNA, 597 bp, Homo sapiens
gggggtccctggcggctggtagctggctgtgctggctgtgtgcgatgcatgtctgtgtgctcttcgtgcgttaacaatggtgccccaatggtgtgaatgtgctgctggtggcctgccgccgcctttgcctgccctgcgcatgccctgtgttgcctgatgtgtgctgtgctgtgtgttgacctgctgtgtttttggagatgacctggcctgtgctgcccaatggacagaattgtgatgcacacttctgaccaccacctgtgccatggatgctgctgcctgccgaatggctgtgctggctgctgatgcttggatgcactctgctgttactgccaatggtgatgtgccctgagatcgttggctgcaagattgcatgtgatgcatgactgcattgcaatgttagtgagcaaaacaattgtccaaatggctccaaaatgaatgttattgatgtgccttgcctgttgtgatgcatgcttccaaatgatgctgatgccatgaagtccctgtgggctgcaatgtgctttgatgtgatgatgtgagtgaaagaacccatgatgctgatgtgaagaaccccgggaatgcaccatggccagtggccaa

SEQ ID NO: 652623 - DNA, 1115 bp, Homo sapiens
ctattatgtaggaggtgcttcatgtacgggggattcttttttgtataccacctattagttggcggtcgtgtcgtcttcttgtgaacccgttcattgttttataccgtgcaaaattaggcccagtgatcatccgtcgcaatcacgtagtataattatggtttttgtctgaccagatgttgaacttgttatgtgagagtatttctgttattatgtccaagtgcttgaccgggacacacttgggatggatggtgtagaatattgtggactttccatgttacaactagtcggaaattggaatggacgagtgtattatgctaaagagggcccaagaattggatccctcccttgatttgaatggctttgaagcataggacaatttgttttgcacgtttggttgttgagagttttacccaagtgactgtatctaggcaattcattatgctttgaactttagtttgcctgcagtttcttgtgtagatttgaaaattgtatacccatgtgtgtttctgtagactctaagataccctgcacttgtggtttaggaaaaaatactgaagatggaatatatattgtaaagaagggatattaagaatcttagataactttcttgaaaaagatggcttaagtcatcagtaaagtacctttatgttatgaggatataaatgtgtgctttattgaattagaaaattagtgaccacttagtttaccacggtggacacaaatgttgaagttgtcctgttaaacttataggcgttttttggggaatttggaggtagttgggtagaaaaattattagagacacttgcacctctttgttaacacgtattttcttcttttatttctgttatatagtggatgatatacacccgtggccaataccaaagtacacttggcttaaaatatatagtgagaaaatgtcacctatatcttcccactttaacacttgtttttgtataattgggtgtagagttttctgacactccaaacttggaacccttggaaaacacaaagcttttacattaaacaaaaatccttgtgacttacaatttgcacaatatttcttttgttgtaccttatatcttgtttaccataaagaattccctttggtatatgga

SEQ ID NO: 652624 - DNA, 160 bp, Homo sapiens
catggagagtatggattaggtgctgtagctgatggggtctcgtgcaaccccatcgtcacagtcttcctctgagtaacatatgacgcactctcccctgaactctacacaacatattttgtcaccaagaccttagcaagccaggagaccttagcaagccagg

SEQ ID NO: 652625 - DNA, 188 bp, Homo sapiens
tcggtacctattacacggtcatgtttttcgagttcttttgtggcctcttacagttttctaatcttcctcgtcattgactaatatttctccattccgatgtgttaaatgaccttacctactcctctccttttggatgcctctaatctgctgaggacttcaaaaccagaaatacgcagaacgcgcctaat

SEQ ID NO: 652626 - DNA, 113 bp, Homo sapiens
tcggatagccttggcgcgaccaggttatgcccttctgagattataggcgagtgcgtcagactgactctggccgcacttgtcgagccgcgcatcaggaaggcccttgtttcatc

SEQ ID NO: 652627 - DNA, 366 bp, Homo sapiens
gtcgttatgaggtcgggcacttattatcctcagtagaagttttcttggccagtgtaggatttgtgacttatacatcttactgtacttccccatcagttatcatatttaagtatacggtttttccattatactcatacttcttccttagaatggctattccgtcagccatctcacataccttcctgcgttactcctttccttcaagcgtttaataagtggtataggaatattaacctattttccattcgcattcacatctctgtttctacttaggtcccgacttacccatggttgacaaacattgccatgggatccttggacttccggccagaaggtttctcaccttctttctcgctactcattcct

SEQ ID NO: 652628 - DNA, 833 bp, Homo sapiens
tagctctttaattcatcagtattaatacagaattatcattgcgtttctggtactttttattcaatgtaatcagaagctgtgatgtttgccttgtagtcctgtgcttgttactgtaattttttttttttttaacgaagcaggtgactgggactaatgtaagggcagatgacgtgatcttaagacggcctatatatatcagtctcttactctatagggtttaaattagaataagcttttatcaaatagataatggaggcaatttaggattcacgcaagtttcagtgtcaaaggggggtcttatagttcaattctgaaaatagcaaattaataaacagccactttaaactggttctggaaaccagacccggggtagatatagtctaaaggtagttaaccatataagccttttcaactcttaatgcctccaatgaatcagcagttaagaaggttctagaacccatgaaagcttgtgtatgtatcactaggttgggtctttatgtggggtgatttacagttctgactaaagctgacctaaatggatcagttatgtgtaatatactagtgtgtaagactctttttgcttgggaggggggtaacattattggggcgatgcgaaaggactgttgtgggtcagacaacctttggagtaagggagggttttacctgtgacatttttaatgctttttggaattcggaattttttcgtgcgacaagggttgtaacggttcctttatgggagcttttttgtttggagtggcgcaactgggggggaaaaaaaaaaaatggcggggaaataaaaggggggaaggagtgaggagtgaagagaaatagaa

SEQ ID NO: 652629 - DNA, 217 bp, Homo sapiens
gggaaaaaccccccttggtgttttgggggcccctttttaaaattttttccccatcctaaaacttattcgggggggtggggtttccccccttgccccctggttttttttcttggggggggcccctttttttttgccctttggcctttttttagctgcttttcccccccaaaaaaaaattccttttatgggtttcccctgggtttttaatgttttttta

SEQ ID NO: 652630 - DNA, 1169 bp, Homo sapiens
ggtgattgggcctttcctctcatggagacaccagtgaagttagagatggcttcgcgggacagcgagagacgcgacaggaactgcctcgggacgggatggggcgaccactggctgtatccctaggggcagggccgcgcgcattgtttgagtcctgggtcctattgtttcggcagcatgccaccgtgcggagatgcgaagggaagattcagctgtcttgaaccggaggagtgacccggtcctcgactcaggagcgagctccggagcatgcactctgcagacagagcatcagttgtagcctgccatcacaggaaagctggtggcatgtgtcatgagcaggtcaccggagctaggacccttggcctcggggaactgtcccctgggatcctaagggtagccatagtggaccacaatgcccgtgcgcgagtcgagagcctagtgcccagggcttggggttggtgccttgcgcgcaggagggcaccatattgaccgtcggggcctatgtcccttttgaaactcccacttcggaggcggctctcggtttgtcgtcctagttcgacccatgcgttgttacgtcggtcgcccaacgccagggggggcgtgctagggccgacatgggttggtaagccggtccttcggagggcgtacgctttacggacgcgccattggtgtgacaattgtttggtagcgcgtgcttcattggcctttttgttcccgaggcggcccccattttggggggggccccctttggacctccaatcgaaattctcaaaaccttatgggtagaccccgcgctttgaggtcagctttggacacggtggcgcccccttggggatctttttaggcttgggctcccctggttgagcgtttgtccccgccttggtggtgtggggggggctttaaccgagccagtgtggcttaggtttcgcggttaccggcgcgcggtttcgctcgagagcccgagagggctttgttgcggcgccggttacgactttccgattccacagcgcctggtggccgcccccgtgtccgcgacacggccgaaagtgttggccgtttccccgggcttttccccagagggggcgcaaccttttcttgggggcagtttgggggccaagggggcttttgggtgtttaggcgccccgggcgcccttaacggtgtggggtagtta

SEQ ID NO: 652631 - DNA, 523 bp, Homo sapiens
ggaggatcccagggtgcatgtatacagacagctaagaagcatatgagaaaaggcttaatatcactaatagagaatagcaaatcaattctctaggaatggctattattaaaaagtcaaagaatcacagatgtgggcaaggttgtggagaaaagggaacacttatacactgctggcgggactgtaaattagtttagctattatgaaaagcagttggaagatttctcaaataactgaaaatagaactaccattcaccctagcaaccccattattctatatgtacctaaaggaatacaaatggttctaccataaagacacagtgcatgtgtatgttcatcacagcactattcatgataacaaagacagggaatcaacctaaatgcctatcaagggtagactggataaagaaaatgtgatacatatacaccatggaatactatgcagccataaaaaccagatggagctagaggtcattatcctaagtgaactaatccaggaacagaaaaccaactaccgcatgttctc

SEQ ID NO: 652632 - DNA, 675 bp, Homo sapiens
  misc_feature (675)..(675): n is a, c, g, or t
cgtggaaaaagagcctatccccaaggattttcccaaactatgaagtcctacaggccgctatcttaccgaggactgcgtgcggaggctaggtgcatagcttgcatgtggatgcctgtgctgcctgtgtgcctgatggcttctggcttgcatgtgcctgtccattgtgctgtgtggcccttgccttgctttgccatccatgtgaatttgccatgtggtgtgctgttgctttgtgatcttcatgtctttgtgtgtaccttcatccatttttgatttgtgtgtgatttgtgtgcatgtgaagcattagacagccatcacttgtgaccttgtgattcgtgtgcaatctgtgctgttcatttatcttatgtgctgaccaaaatgatgtgacaacatgtgaatgttacatgtggctacacatgggtcatgtctttgcccatatggcttccttcaaatatgccaactggggaatctacaagtgggtatttaaattgtgacccctttcctagtttttctccaatgctgccttccagaatttatgtggctatattatcccccccgagagtggctctcctattgttggtcccattgttgccccatggcctttggaattgccgcccccttggctgggtctatcttggcctttggtttgaatggcttttggccctttgtgccccttan

SEQ ID NO: 652633 - DNA, 101 bp, Homo sapiens
gtttcgcagggtcgcaaactcacatgaaggggaatgagtgtgggcaagactcactttccacgtggtctgctgttctgacaatcatctgattggctttctga

SEQ ID NO: 652634 - DNA, 338 bp, Homo sapiens
ccaggtttaacactgggatgacttgggttgttttcctgtagttttgaagtgggccttcccgctttttttgggggaaatctgactgttttgaacacttatcttggattagttgggttgttttgtattgtggatccctaaatagacaaaagagtcttggaaaggatttgctggctctgtcttgaacgttcgcccctattcaccagtgtgagtccttggggaagtctttctctcaagtggggttcatgttctgtaattttcctgcctgttcttagtttgttctgagttattttggattttgttcttttgccaattataggcagtttggttttacctgaaaa

SEQ ID NO: 652635 - DNA, 179 bp, Homo sapiens
acgggaggtgcctggggttctaaggactgaattacccaagcttgtcacacaggggatgtgaaacaagtcatgtatcttttcttgtaaatccttagttttcacacctatacctcatattgttttttatgacagatggcatccagacaaaagtaggtacttagaacatatttatgcatgca

SEQ ID NO: 652636 - DNA, 251 bp, Homo sapiens
ccctaccctccactcagtcttgtgatgagaaagtctggtgtctcatagttgccggtggtggaggtgatgatctcatcgccatgcttgttgacagtgcgagtctgtgttgccgtcagcgtgcgattgttcctctggtctgcttctcgactctcagcagatcttgcgtgccgccgcgtgtgactggtgccgacgatctccagtacccagtgatgaatgtctcgacatttctcgattgtgtcaagggggatcct

SEQ ID NO: 652637 - DNA, 221 bp, Homo sapiens
ccgggcgcaggaggcgggcggccgggcccacgggcccgatggacgccccagcgggagcgctgagacccccgcgtcgctgccagccggtccggcgcgccacgccgagggatctctggacatggacaagactccgaagctactcccccagcacacagccgggacccacaaacccagcttgccaccccgccccgtttcctctctcacctcctacctcaccaccc

SEQ ID NO: 652638 - DNA, 143 bp, Homo sapiens
ttgtccattagaggtttagagaatccttataaagaaaaattgacttgcttgcctaaaatctacagtgcccccttagcctccattacttgagtatctcttacagtttgctctggctctcaaataatattacgatcgagaacaag

SEQ ID NO: 652639 - DNA, 146 bp, Homo sapiens
cgtaggtgccagatagatgctaattgtcattcagcttgattgaccacctacggacggaaaacaagacagtacaggacctcctccctctaggaaccacaacattttcctgaaaccacatctgtcgaatcatacatggggatcctcta

SEQ ID NO: 652640 - DNA, 192 bp, Homo sapiens
aacgggttcgagttcattcccacttatccagtgattatcttgccacatgatgattcctaggcctgtcaaaattagttcaaagttccagctcttcctctctgcaaacactcccagcctcaccatgaggtaacaccttgtgcagcgatctgtagcaaacatttccatccctacctttaagatttataggaacat

SEQ ID NO: 652641 - DNA, 420 bp, Homo sapiens
  misc_feature (48)..(48): n is a, c, g, or t
ttagtaaatatatacttatagttagtaaatatattttatatctatttngtaaatatactaaatgtcaggcctctgagccccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaaatttcctttaccaacccaaatcctgtaaaatggtcccaaccctatctcccttcactgactgtcttttcggactcagccagcctgcacccaggtgattaaaaagctttattgctc

SEQ ID NO: 652642 - DNA, 128 bp, Homo sapiens
atgattagagatccttttgggtgctttctgagagtccaagtcaacctgtggcccctgttggttgggctggcctgcctggcccagccttcaatgctgctgacgtcctcattttcctttttatggtcccc

SEQ ID NO: 652643 - DNA, 378 bp, Homo sapiens
agaaagaggaggttcaggccctagagctggtgcatataggctgacttcgtgaactgctccttgtactcaaagtagtagcatcttatctaggccatgtagcgcttgaagcaggggatgcccttccgtaggatgctccattgggcgccgatctccagtatgtcacgggccagaattagctgctgtttggtcagcttggtcactgtggttgacaataagttgagttccagacgtactagcttgagtcgactcagctcttctccgctcgtgctaagattggggctgtctccggctccatctcgcccttgttagcacagcccgttgctcttaacagcctcgagatagtttaccagatgcgttagctttcattcgtcatgttcc

SEQ ID NO: 652644 - DNA, 462 bp, Homo sapiens
cgcatagtataatactaggtactagaatctcatgatagtaaactagtagaggacttgtcttaaagagaatcattgtatatgtaaggagtagattaagtccaaatggaaaagaaatctggtgctgagagacattaacagcaataactgcagtttcttttcgacaccaatcttctgcaacatcatcctgttcaacattagttcaacataagtgcatatattcactccttgaaattatgcaaaacatacatgcaaaattgtcatgacagcaatttttcacatacagtcatgcatagcttaatgatggaaatacattctagagaaatcttgtgacagcaatcatcgtagcagtgcacacttataccaaaccatagcataatatagctagtctgtacacctaagggtatcatggtataagacctataggctcctacgattaaaagacctttcacagcatgtatgctt

SEQ ID NO: 652645 - DNA, 716 bp, Homo sapiens
cgaattcctcgccgcagcaaggagctggttaccattatccccaacttcagtctggacaagatctacctcatcggggtggtgacctgggtgccttttaaccctgtgtttacccgtggaagtgcccctgctggctggcgattaacctgcaacacaacagcacagacaatgctcgcctgctccctccagcagctggactggactgctagacaacacgcttggcagaacgatgagcggatcactcgaacgcacaatggacaccgaacactttatacccccacatggcccccagcacccttaacctaaccacttggaaacctttaccgaaagcctctcctgtgtctcaacatctcatgtgcctctcgaaaaacaacaacactccccagacagcgccaaggaccgcaagcaactcccgtgcaaccccctgtggtcaaacgggactactggttgagggacccacactccgctcattcacgcccacaaaaccttcccgagacagttggttcctcgggcttgggaaccagactcacaagggcagcaggaaacacaggcccagggtgaacgtgccccccaatttggccccaacacgccctacgggcaattacaccctcttggaaccccctatgtggactcggggcaaggcatctccaagccaccccaagcccgggcgcaccctatatacacttcaaacaaccaaaggccgcccttcccacaaccca

SEQ ID NO: 652646 - DNA, 132 bp, Homo sapiens
cacgaggacgatccggagtctctcggtaagcggtcggctgtcctgtcgttgtctgtttttggtcggggaatctggtaatattaccagtatggtcgggtcactaccctctacgccgtcgtcagcagaggagga

SEQ ID NO: 652647 - DNA, 124 bp, Homo sapiens
ttaagatccgtcagccctgcatctcctttcctccagcctgtttcacacactgaatgaacccatccttgtcctgtgggttgagcaggatcctgccccttccaaaggctggggccctcttccccag

SEQ ID NO: 652648 - DNA, 102 bp, Homo sapiens
gccagcaccaaccagacatctatgtacctctgtgccagcagttcccttcgggcggtcgagcctacgagcagtacttcgggccgggcaccaggctcacggtca

SEQ ID NO: 652649 - DNA, 139 bp, Homo sapiens
ggtgctgacagtgctaggtaaagggtgataggacagtgatcactgccgaggctctggaaacgggatcttgctgtcacacaatgcaggtaacagagagtgggacaacaaaaagtgatcaaggcgccaacacaacattctt

SEQ ID NO: 652650 - DNA, 944 bp, Homo sapiens
caggctgttacgctccggggttaacgggctgtacgctcagagcatcaggacatatgtgctcgggacgacggacatagtgctgatgagtagccagtggagctctggatgggagactagacgtcctgtgtgggcaggtgttccctgcctctgctgctcctgctcatcatgggaggcatggctcaggactccccgtcccagatcttagtccaccgcccaggaccagctgttccagaggacccttggccctggctaggattagctgcctgagactcagtgccagccagctcgccaccatccgcatggttgctgaatgggcagcccctgagcatggtgcccccagacccacaccacctcctgcctgatgggacccattctgcatagctacatgccccctgaccacggggacatgccacacatatgtgccagtgcctgtaccacagacctgggatgtctacacatgtgaaggccagacaaaacaggccttggcacggcagatcagacagatggcagcatcggctagtactgtagactagtcccatccagagtggagggacttttccaagaatctcagccatctggagaaccatggttgagctgctgaggatggggtgaggcagaatttactctggggaaatgtgcgggaccagcccattggagagccaaaccctataagccgctactaggtacatcaatggtggcacaatgcattggagaaaacccattgacaccatcccaaggacccagggaaaggggcacaaccagtaggaccagtgagggattatccgcattgcttggagtgagcaaaagctgaccagatgacatcaagttgaccagaatgggacccctccaatgttggtgatgggccatcacaaacaatgaaacaggggacaatagtggagcagccgaggtcacacgcatggataaccagtgcaaggatggccaca

SEQ ID NO: 652651 - DNA, 171 bp, Homo sapiens
tctttgatgactctgaggatcccaccataggtaggagtcgtgaccacgagctcggagtcgtgaccactagctcaggagtcttgacgataggacagcagtctttaccataggtcagcagtcgttaccataggtcagcagtcgttaccataggtcagcagtcgtgaccacaag

SEQ ID NO: 652652 - DNA, 261 bp, Homo sapiens
cccccctgggaattgaggaagaggtgatttgatttatctaagagaatacagatgttacattttccttgcaccgcacactttggaaactgtaagtactcaccagataatgactctgggcaaattgctgctaggtgttgatgagagtaccaaggcatgggagatctgtcctagacctagacaggtttgatacacttggagaagatggacttggtgcctgcctgtgtacaagtcccagatgagggttacggaaggcaagaacca

SEQ ID NO: 652653 - DNA, 871 bp, Homo sapiens
  misc_feature (2)..(2): n is a, c, g, or t
  misc_feature (13)..(13): n is a, c, g, or t
  misc_feature (20)..(20): n is a, c, g, or t
  misc_feature (72)..(72): n is a, c, g, or t
  misc_feature (101)..(101): n is a, c, g, or t
  misc_feature (132)..(132): n is a, c, g, or t
  misc_feature (152)..(152): n is a, c, g, or t
  misc_feature (164)..(164): n is a, c, g, or t
  misc_feature (177)..(177): n is a, c, g, or t
  misc_feature (210)..(211): n is a, c, g, or t
  misc_feature (296)..(296): n is a, c, g, or t
  misc_feature (311)..(311): n is a, c, g, or t
  misc_feature (365)..(365): n is a, c, g, or t
  misc_feature (374)..(374): n is a, c, g, or t
  misc_feature (395)..(396): n is a, c, g, or t
  misc_feature (400)..(400): n is a, c, g, or t
  misc_feature (527)..(527): n is a, c, g, or t
  misc_feature (540)..(540): n is a, c, g, or t
  misc_feature (613)..(613): n is a, c, g, or t
  misc_feature (646)..(646): n is a, c, g, or t
  misc_feature (663)..(663): n is a, c, g, or t
  misc_feature (689)..(689): n is a, c, g, or t
  misc_feature (861)..(861): n is a, c, g, or t
gnagagctcgagncccggcncagaacacagatagggaccatagaactccgcgacacagactatcagccaganccacacatgcggcgcctcctatccatggngccggaggtggctggaggccggcccaggagnttccccagggctcccaccgnccatggcggtgnggggggagcacgnatctgccctgtccgttcagccacgcggagctgnncaccccctggagggtcttgggggttctgggaggaagcagccccctactaggcggaaatgggaaggccaccatgcagaatctcaangaccgcctggcctcntacgctggagaaggttcgcgccctggaggagcgccaacatgaagctggaaagcngcatcctgnaatggcaccagcagagagatnntggnagtaagcaaagcattactgtccgcagtatgaggaaaacatcacacgacgctgcaggagcagatagtggatggtaagagtgagcaatgctcagattattcttctcattgacaatgccaggatggcagnggatgacttcaanctcaagtatgaaaatgaacactcctttaagaaagacttggaaatatgaagtcagagggcctccgcaagacctntagacaacctgaccattgtcacaacagacctanaacaggaggtggaaggnatgaggaaagagctcattctcatgangaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataanaacagtctgc

SEQ ID NO: 652654 - DNA, 404 bp, Homo sapiens
agacagtatacgattctgagctcggtaccgtctcatctacttgaatcccaagtcttgaagaacttcagagcagtgctaccataacttttcaaattctccataagcaatcatgcatcattttcctagtgcccagatactattgagtatttgataactcgagtctcttgtaattgcctccaccaaacgcaatgccctctgaataggatattctgtgtttcggatctttctcaattgtgtgataaatggcaacaagcgcctgtcttattttgtcctagctctcgtggcagacagcacatcattcagagggcaaatctatcatcagaggattgtactcgttcacagtttcctaagcctgtcttagacctgtgtcagattctttcccgcaagtggcatggaagcgcttg

SEQ ID NO: 652655 - DNA, 100 bp, Homo sapiens
tgtgctcatgcgaagcatttctcatcatcatcatctctgctacagtcatgtttctgcagttcagcgagcgacgactgtccctgcctcaggttggagtgtt

SEQ ID NO: 652656 - DNA, 398 bp, Homo sapiens
tttgatctctggtggccattggacaagtctcaacgtaccgaggccatcccggaacagcccctcggtcttcgccgctgagcctctgcagcacctagccagataggaacgtggtcgtcgcctgccttgtccagggcttcttcccccaggagccactcagtgtgcacgcgtggcgcgaaagcgtacagggcgtgagcggggggaacatcgttcccacacatccaggatgcctccggggccctgtacaaccacgagcagcctgctgaccctgccggcgacacagtgccctagcctgccagttcgtgatatgcgacgttaagcactaaacgaatcccagccaagatgtgactgtgccctgcccagtttccctcaactcgaactatgccatctcgctcaaatcc

SEQ ID NO: 652657 - DNA, 313 bp, Homo sapiens
gtgtagttcacaccacctgtgtccgtgtgttctcattgttcaactcccacttattagtaagaactatgtggtgttaggttatactgttacctgtatatagatttagctgaggcatgatggcttccagcttcatccatatccctgcaaaggacatgatctcattccttttaatggctacatagtgtccataatgtatatataccacaattactttatccattctatcactgatgggaattagggttggttccatgtctttgctcttgtatacagtgtagcaataaacatatgtgtgtgtacggttgagcggaga

SEQ ID NO: 652658 - DNA, 150 bp, Homo sapiens
tagctgttcttgatgaaccttgtcatcagcaatagcatgtaaggatgtaggcatcgacgtgtatacaccattgcgttgcatgcctccctgtacaagttccgtcgacacagtgagcactgtgtgacctccaaatatcgtaagctggagcct

SEQ ID NO: 652659 - DNA, 581 bp, Homo sapiens
cggcagtacggatgtggcaggactataggtatggtggccagagggtcagcaggaaaacatgtgagcaaaggactctgtgtcataaataagtttaaggaaaggtgctgtgccttggatgtgcacataggccaggtttatgtttgactttacacagacatctcagtgcagtaaagagcagtatttgcgccagcaggtctcacttccagccataaggcagttttctcctatctcagtaaatagaatatatgatcaggttttacactgagacattccattcccagggacaagcaggagacagatgccttcctcttgtctcagctgcaaagaggccttcctctttcactaatcctcctcagcacggaccctttatgggtgtcgggctgggggatggaggtctttcctttcctacaaggccatatctcaggctatctcagtggcgggaaaacttagacaataaccaggctttcttgggcagaggtccctgtgggcttccacagtgcattgtgtcccctcggtacctcagaacggagaacggggtgactttaacaagcaaacggctggaacattttaacaaggcaatc

SEQ ID NO: 652660 - DNA, 241 bp, Homo sapiens
atcgggtaccaggagcacaggtgagtgagattttcagcaccatgtgcgccatcgccgccccgagtgtcgccccacgcatatcccgcagcaccctctgccgaggtcaggtaaattcgggccaattcgcctaaatcagggtccgacttcacaccgggaagcagcgacttgagacctagagatgtcaacggtgcatcaccgcacgcccctgggtagctgccgcggaatattacgccgatgcggg

SEQ ID NO: 652661 - DNA, 173 bp, Homo sapiens
cagccaagatcagatccttgagcagcacctcgaccttgatccattcttcgtcagtacagagtgggccacatgtggtgtggttctgtaatagtagtcttgtctaggcttcagagatcacttattgcccgcatcgttgtacacatgatagggcacgcagtaacgcgacctaatgc

SEQ ID NO: 652662 - DNA, 333 bp, Homo sapiens
  misc_feature (2)..(2): n is a, c, g, or t
  misc_feature (94)..(94): n is a, c, g, or t
anattcggcatgagatttgacactttatttgtaaaaggtgctttatgtttgtcatctagaaaatgctaatgtgcagtaggcattggcatcagangtggatgctgtggctaaacacaaggggagatttcccatgaaaaattgataaatgtgtatttcatgaaaatgattgccagcactatcttaagtgggtaatgctgcccttggtaagaagaatatagaataaataccagtttttatttcttttatgccacagtttgtatgttaaaaagttagggttaattaccctggattatatggattaatgctggaaattgacttagggcaacactaggt

SEQ ID NO: 652663 - DNA, 943 bp, Homo sapiens
acccagacgagtgcgaggcaggagtagagcaaagaaagaaaagcaatgtagaacgagagcgcaggggacacgtcttcctacgacagcacgggttacgcacccacaaaccttggggcgacttcgccttggcagccccaagatccggctgcacgggggaaaggtagccccccccggcctgggccacatcacagtgagatggtccccacacaagcctgcaagcccccagagcagtacccggcttagacggctacgcagcaacccggccgtgctatgcgtgggtaaaaagggagcgcgctgcctgtaataatccagcgagcttctgtccttactttctggcggtcctagagccacccgtagcaccggttcggcgccgcccctcactggggcttaccgtgtgtccccgacccgggcggacacaacaaaagtgtctcccaaggaagagagcggccgcagcttgggtgacccaacgcgcaaaaattcggggcattcttgttgagcccaggatagtgaggggaaccccacacaggtttcacaaaaaaaggcgcggcatgtaatccccgggcgctcaccaccgttgcaaatcttataagcgacaagttaaagggtcccccacgcggggggaccccaaaagcaaacacccgtcgtggatatgataaatgtggcgaaaaaaattagactagaaggaccctggggccccgtacaatttcactctcccccaatcttgcgaccgcagagaggccttctctgggggagaagaaacattcaccagtgcttctccgctctcttgtcacgcgaagaaattccgctagaagctcgagaacactaagtgggatcctataagacccgcctgaataatgaggatagctagtctcaagatagaatcctacctcaatcataaaacctattttaaaatctaaaaaaatactgtcttggaaacaagaca

SEQ ID NO: 652664 - DNA, 853 bp, Homo sapiens
tgtcccctgttcggcggcttggcaggttggacatccccggattgttgttcattagagaaacactcacctgtccttgcttgctgtataagtactccccatacatgcagaaccttgatttgctctgtagaggaagcagaagcaccataacgcttttaatacagttccacgttcgagctcgttcaccgccggacccctcaaatctcttagtatccatgccatagaaagaggggtttttatcacccagtcctctgctcactatctggtgctgatctcactgcataatgactttctatttgtttggtattcgaagctttccgaagctttggaagagcccataccttgggctaggcccaggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcattttttttttagctggagcagctaaggagagatcacagatgaattctcaaactggaagatcatgccttggcacctgtgaggaaacactattcaacgtcccaagacaaaccttttgaattcagaggagttgggataacttaaggcagatttacaacgaaaaccccggaaagcccgttccgaaccgtggttcctttcacagatggctggtggccaagccctataaatgtggtaaatctctgcggctggttgcgcccaaattatggttgtacgttcgcttccgggcacattggtttccgggttcacatcggcttcacgttgtgttgca

SEQ ID NO: 652665 - DNA, 173 bp, Homo sapiens
  misc_feature (145)..(145): n is a, c, g, or t
acagcagagagatttagactggacctccatcaggaagaactcttcaacatatgatactaactgaaaatcctggggcggtgaacattgattctgcctcaagaattctgaaatcctggttccaagacgcgctcaccataccgccaantaaagtgcaacaggcgtaataagaacac

SEQ ID NO: 652666 - DNA, 444 bp, Homo sapiens
  misc_feature (125)..(125): n is a, c, g, or t
  misc_feature (440)..(440): n is a, c, g, or t
tgatctccttctgcaaaggtggcagaccgagagctctacaagcctgcagcccctaagtgcagacacagcaggggtccagaagacgtggtctagaccagtggctgctctttccactggcccggtgntctttccccagtgggcatgactggtcgccacacgcctcgtgtgtactttgtgtgcagagcagcacaggctacaaatgcagagatcgacagacagccaggtagtgggaactttctgttccctatggagaggcttccctacacagggccggctattgcagaatgaagccatttagagggtgaaggagaaatagccatgtaatttctctgagtttaagtgggtctttccatctatcactgcattatctggctcattcttcagttctctactccctcttgtcagggtagacacaggtcaccattatgcgggggtatgtnaatc

SEQ ID NO: 652667 - DNA, 435 bp, Homo sapiens
taacgtttacgatcatcaggtatataatgtcgagaccataacctaagagttatcttgaccccttctcctctcacactcttgctcgtcccattaatcaaattgtttcaatgccacttcctaaactgttcttaaattcatcatttttttctgctgacacttcccaattttgtgctagtatcatttctcgcctgaattacagcaagagcctaaatcaggggttggaaaactacagtctgcaagtccaatgtggctcatcactatttttcttaatcaaattttattagaacacagctatacccatttgttcacagatgggctatacctatttttgagctgtaatgacagaatagtgatgagagagaccattcagtctgcaaagctgaaaatacttactatctgggtcctttaaagacaaaatatgccagactcaatgat

SEQ ID NO: 652668 - DNA, 105 bp, Homo sapiens
atacagggaaattcttttacagatttttgctctaagggagaatattgacatagctttatgctttaccaagatcaagtgcatatgagggggcagttttgttttcct

SEQ ID NO: 652669 - DNA, 103 bp, Homo sapiens
cagcctgccaaggagcccgtgttaggagcgggtcggggagaaatcaggctctcggaaggcctcattaaacacttcaacggtgagggaaagcaatgttacaatg

SEQ ID NO: 652670 - DNA, 798 bp, Homo sapiens
gccctccctagcatcccaggtgccctggacccaggacccaacatggtctagggatgcaggatccccgccctggggtctggtcctcgcccatcctgcagggatgcccaccgtcttccagacaccccacctgaggggggcaccaggtttagtgctgctgctttcactgctgcacccgcgccctcggccggccccccaagcagccttgtactctgcttggcgggaggggtgggagaaccttcagaggcactatccacacctctcccactgtggtgccggtggttgtatgctatatgctactaataaaaaaaaacgcttgtttttccagacaaaaaaaaaaaaaacaaaaaaaaccccggggtttttttcttgtttttggggggaaaaccctttttttagattccccacttacaacggggtgggggacagtggggaaaaaccgagaactattggcggtaataaaccccccgcaaaaatgataccctcggggaggcggcacatctgcggtcatgggggacacagccgcggcacggggagcaaaactagcatgtgctcaacaaaagcgggcgggctttcttgtgtgtgacccaccccacagcaccgaggtgcgcgattatctccccaagggacccacagacgaatacacagtgttgaggcccccccctgttgggttaaacaacacggcacaaagaccccctgtggtgtggataaaccacgggttttctcggcagggacacctgtgacacaccgtggacatggccgcgcaccatggtcgccacgggaaccgggggtggaacaaca

SEQ ID NO: 652671 - DNA, 287 bp, Homo sapiens
actctagatatcgactgtcgtcccaccccagttcttccaccccactttcttccttcaccaacatgtcgagttctttccttccctgtcagccagatagatagacagatgggaaaggcgggcgcggcctccgtggtcagtagtgctctgatgtgaaaggggcggcacagtcatttaaacttgatccaacctctttgcatcttacaaagtgaaacagctcaaagaagtgtaataagaaggcgatgcttgtggaaagtacagggcatattgggtgcgccctgggggatccc

SEQ ID NO: 652672 - DNA, 212 bp, Homo sapiens
  misc_feature (1)..(1): n is a, c, g, or t
  misc_feature (107)..(107): n is a, c, g, or t
  misc_feature (120)..(120): n is a, c, g, or t
  misc_feature (122)..(122): n is a, c, g, or t
naacgcctcgttcctcccgtccgagagcgaccttatggctacagtaaccccaagatcctgaaactgagcctacagatgactctttctggcctgccttcgttaactgngtatgtacatatntntattttttaatttgatgaaagctgattactgcaataaacagcttcatgcctttgaagttatttcttgtttgtttggttgggtatcctgcc

SEQ ID NO: 652673 - DNA, 412 bp, Homo sapiens
  misc_feature (132)..(132): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (156)..(156): n is a, c, g, or t
  misc_feature (164)..(164): n is a, c, g, or t
  misc_feature (199)..(199): n is a, c, g, or t
  misc_feature (208)..(208): n is a, c, g, or t
  misc_feature (323)..(323): n is a, c, g, or t
  misc_feature (396)..(396): n is a, c, g, or t
  misc_feature (401)..(401): n is a, c, g, or t
ttgagggaccttgtagccagaatgagatgcttatactaaggaaagtctagcacagagagtctggcagataggtcctgggaacgcctttactctagtaccttccttgggtgaggagacacgcatgcctttatntgtactactgtnattncnagaaantggggctnacttatgaagaaatggattcattaacatggaagtngccccaggntgaacttttggtcagctgttcagagcacaatgtttctctagttaagtgccatttatttgaggagaataaaaggaacttgtctggacccagacaaggaactgatctggaagaatangataaatcccagatgaggtaccctagcttacattccccagatgtggaaagtataagggcctcggctctgcccnaagantactctgtctc

SEQ ID NO: 652674 - DNA, 1638 bp, Homo sapiens
gcgttggatgcgcgggatagtgtgagacggaggtagcgtgtagggcggagtggggtgagcgcgtagatgatgcgaggatgaggatgagcgggttggtgggaggcgtgagggtgtcgggtgtggcgttgtgtggtgcgaggtggcggagcggtggaggtgaggatgcgcggtgtgagggaggtggctagtgtgtggcgaggtggaggcgttggtgtggggggagcggtcgggcgtggacgtggtgagggcgggtgcgtgatgaggcgtgtgtggcggagcgtgtgagtgtcgtgggtgtgtgagcgttgcggaggtgcgtgtgtgccgtggaggcgtgtggtggactagtagtggggtaggaggtgcctgggagtgtggagctggggtgagcagtgaggtgcggcaggtgagtgtttagagatcggtgagggctgagaggtcgtcggtgtggtgccgacgtctgcgtgctgcgtttcgtcgcgcgtctcgcttgtcgggctcgtcgtgtgcgtgctgggcgcctcgctcgtgcgcgcggcgcgtcgcgcggcgtggcgtgtggggcgtcgcgctcctcttggcgtctggtgccgcgcgtgccgtgtgccgcgccgcgcggcgcgccggctcgcgttagctggtgcgtctgtgtgtgccggctgcctctgtcgcgggtgccgctgcgcgcctctgcctgcgctgctgcgccgtgtcgtgctgctctccctccgcatcccgctctctgcaccagcccggcgcgccggccgcgcgccgcccgccgcggccgtcgcattcacatggctgcccccgccggccgcggcgagcgtcgccgcgccgctcgttctgtgcgctccccgcgcggtcgccgcggtctctgcggcggtctccgcgcgcgacctgcgcgccgctcttctctctccgctctcgcggtcctcgacccggcgccgcctcggccctcttccgcctccttgtatcgttgtgttttttttgatgtggtgttactgctatagtgttgttggattatgtctttgccactgtctctggttatagttgcagatgtgatattagttttagtatgttatagatagtgacttgtcgtaacattgttgtcttcttttcctctatttctttactttcatgatgcaatcgagtgggcgctgtgctgtataattccgtcatctcgccgtcgctcctcgtctcctccgcctccctcctttctttcttctcttctttccgcctcccgctcctccccccgctgtgcccacgcatccgcgtctcttcctccttctcccctctccactcccgtcttcccaccctcgctcggtggccacctgcgaggcgcccgcttcggtgtcatgtcccgtccttcgtttctctctgttttgtctctttgtgtgttgttttttcttgtttttttcttttttttgtttgtgattcctctcgttgtttttttttttttttttttttttcttttttttttttttttttttttttttttaaaatcacatagccacacaatgtggtaaattttttatatttttgttatatggggtttctttttatttgaatgggcacacaccacacgtgggggttatacttgtgagaaatggcccaatttttttttaaaaatttttggga

SEQ ID NO: 652675 - DNA, 522 bp, Homo sapiens
ctgtgttatgttatatacatactagtgtaaggaacatggctgtgctttggtcaaggataggccaaagtacgatgtttacatcttgcatgactcagcgagtctagagcacaggtgtataactccacttgtcatcacagccatgcagacataacatagagaagctcaccaccatagccataacatagggaaggccatcacttggctctaagccactattgtctataaaaggtataattccctgttgacactgtgcaggtgctggcgcccaaagagaaagccaaagctgtccgtctttgcagacagacagagaggaaccaggacacagctcaggccactcgtgcctagagagagagaaagagttaagctgctgaccctgaaggcagggaagagccggctgcacagctgtgtggggggctgccaggctaagcagccaagacaaggcagacagtgtagacagctagtgtgagaaagctgttaagagctggtgctgaataaaatcatattcacctgcaaaaaaaaaaa

SEQ ID NO: 652676 - DNA, 533 bp, Homo sapiens
  misc_feature (97)..(97): n is a, c, g, or t
ctcaaggatcccggactcttcggatgaactctcagagctcagagtcaagggtgcatggcatgcttgtcatgtggatcctgggaaagtccttgctttntgtggggtcacggaccagtggtgggagatgggaaagtgggttaagctaagtaagaaagaggcagcagaagacagtgaacagttcatacagagttggcttcagtgtattgcttgcagcttgttgccaaggctgtaaaagatcttcccatccttaggttcacaaatgccactaaaatagttgttaactctcaggcaggtgtgactgtgccccttgggacatttgcactgtctggagacattttttgctgtccccacttgggggggattggggtgcgtcctgctggcacctagctgggtggagcccaggggtgtcgtccacacctgccgtgcagtgttggcccccccatagagagtgagctgccctgagtcagcagagctggggctcttggctcacacctgctccagtgcatccaagcagttgccgcggtaccgagctc

SEQ ID NO: 652677 - DNA, 100 bp, Homo sapiens
gcggccgcctactactactactactgctcgaattcaagcttctaacgatgtacggggacatggtggggtggagagaaggggttattaaagaggttaaaaa

SEQ ID NO: 652678 - DNA, 771 bp, Homo sapiens
tgccatgtttgtcacaagagcaagtcagtctgctggacaggtacactggacggatgccaagaggctgtatggctcacgaggcctattgccactgactttcaggactcagctgcagttaagaagctcatcaagcgactacgtgaagaatggaactagcggggcaaaatcacagatctgatcaaggagcttgagtcgcatactaagtgatgtgtcctgggtgaattgcatcttctttaaatgccaagatgggagatgccctttgacccccaagatactcatcgagtacaaggttcgactatgagcagagaaaaaggtgaggtaataggtgcccatgatgcgtttcgcatgcacctgactataccttacttcctggggacgaggagctgtccgtgcgaccgtggtggatgctgaagtacagcaggtcggatgccagcgcgactcttcatcctcccggatctattatcgagatggcggcaagctggaagccatggctgcctctcctgaagcacccttggcaacgccggcggacagactctcttgcgtagcgtccagacgcgcactaggttagccctcacctgccagagtctcaccatctcccagggactactaacctgaacgacatacttctccaggctgccgccttgacggaacccttacaccagccaaggctgaccctgtccagggatcacagccggccaggaacctagcagtcctcccaggtggtccactaaggctgtgcttcgcacgtattagaggagggcacagagcata

SEQ ID NO: 652679 - DNA, 153 bp, Homo sapiens
gcggtcgttaaggtaggtacttggttttggattagggatttttttttcacttaccttctttaaaagaggatgttgcccatagccttcggttcttggcatggattagggatggcttattccaactcttcaacatgatttcccagtccctatctt

SEQ ID NO: 652680 - DNA, 305 bp, Homo sapiens
ctgaactgattatatttgtcttcctttacggctctttctctgtctcttttttattggagatggactcttccggtatcgcctaggggggagtgctcactgcaacctcttgcctcctacggttcggtgtgattctccgtgcctcaggctccttacaggcatgcgccaccacacccagctaattctggtatttttaagtagacatggggttttaccatgtgggccagggtggtggcaggcaccgggtaatcccagctcatcaggaggattacgtgaactcaggatgcttctggaggggtcacgagctc

SEQ ID NO: 652681 - DNA, 1504 bp, Homo sapiens
ggggctgccaacatgccatccagactgaggaagatcacggaaacttcggggctcacgtgagccgacgtgccacggatcagcataggcaagcatcgcggatagcgaccccggacggtgcgcggataggtgctggatggatctgcagtcacccaccggtatcaaactttcgaccagaataccacccagggcgtatcttcgtggacaagtatggctatgaatggcaattatccactgttacaagacggaagcctacgagcttctggcgcgcgaactgtcacatcgcttggatcaaactctgtaggaccttatggtactagtgaaccagacatcggcgtgaaatgcatgcttaacaactaatgactggggtctgcttcccgatcattgcatggtggctgcgaatcgggcctactagcaatagtctctggggaaacggggaaaagactcgccaaaggcagccatgtcaatcgttgaaggcccataattccttcaggctagaacgcagctagacggcgaagaattgaacgagctagttctgggcggggacctggtgtccctgtgatcggacttgcaaggccgaccatggcacgcggcagtccgtccagttttacagacctggcattagaccgttcaccttatttcacaagcagcacacacaatcaaacatccagcaacaaacaacacaaacttctctacgagaggcaactactactacattgtcacaggcgtacgcccggaaaaacaacggcgcacgcgtcagaaggaaccacgtgggcccgccatggggacacccacaaaagagcggtcaattcaccccgctgaccacaccccacgagaacaactacgcggggcaagccagccgcagaggggagcacacacagcacgacggcccggacaccccccacgcccaataatactcgccagcagcagcccacccgatcattacacacacctctagcgcagagaaatagcagaccgcagggcgacttacaaccacgtggccccagttagaacgaagacacaactatgaggacgacacacaacaacggaccgaaggccagctgcacaacagcacacggaccacccacggccacaccccacgagcgcagaacaaccccagcaccaccccacggcgagaacaccccccgacagcaaacactacggacgaccgcacaccaacacgaaaaaccaccgagccacgccagcccgccacagcccccccaccagtgacccacacacaacacacccgcaccccacaccccacccccacccaaacgacgcgaacgacaacccacccagccacaaacaaaggaaaccacagacacccgccaagcagcacccatcacagccaaggccacgagataacacaacagagggcagaagagcgggccggcgccagcgacacgcgaaggcaacacacaaggccctacaacaccacacaagaacacgaccagagcggcacagcaaccaccacaccgataagcagcgcgccaagacgagcacagca

SEQ ID NO: 652682 - DNA, 1245 bp, Homo sapiens
  misc_feature (536)..(536): n is a, c, g, or t
  misc_feature (564)..(564): n is a, c, g, or t
tgagtatcggctttcttctttcactattggacgtcttaacgattatcgagctcaacttccacattaatgaaagtggatcatctatttatttccaaatgaaaaagaaggccaaactctataccaggatctagtgacctgtgatcgtcagtattagttcaggtattaagtgcttggttcctgaggcgatacaccttcataacgagtgaacatatgtcaagcgtgtcttgaacgttgctaccgtgcaggcgcagcagcctacctcatgtacctactagattgcgacgtcgtgggttgtggcatatgtcgctaggctagtggatgtaggatagctagtcccacatcattctaacagactctttcttattattaatggatatagtgttgcctgagtctatatccgttcacacatgtacgcctgtcgcacatgtgtactgctttattatcatatggggagcttggccctgtcagtttcgtgatactgttgatgtgctaccaaagtacattccttgtcattagagacgtagggacccctccangtgttgtagtaggtcgtgtaaaccgagnagctgtacagcgaaagtgccactgtgagtagttgttcagatagagctcgatttgtacacgcggcactccgccgtgccaagggaaagggtgtgggcctgaccctacgcttatatgtaaagtatgctaatctactattgtctaggacttgttcggatctattcctccagtagtttaaaggaaagggtcgaagggtgcccatggttcgggtagcccctctcagaaagctttagcacgtaataccgattggcttcttccccgggtttgacgagcaaattgcacaatcaggaaggggcccctattgaggggatagctgcaaagtttagtaacgcaggttttaggtgccttttgtttagccaaattttttcccttggtttgatccttacaacggtattcattcgcctttccgtatcaagtgccaaaaaccggtagggggaacacatcccctatttttggcactcccattccttgccggcagactctgtgggagccaaagaatgtgggtggccctgggatttgagccacaaaagcactccttttcatccttctctctgtcagccccctgcgaacgggtcccttacgcaccgcgggtttggtgttccaaccccccggagggccgcttggggcagacttcgtccgcacgctgtcgacccggttgtggatcactccgcggggctatcacac

SEQ ID NO: 652683 - DNA, 146 bp, Homo sapiens
cccggatggattatgtcatggatgggatgatccacgtatgccaaccgtctgtgggtatgcgtcgtcgtgattggaaccacaccaatggcgtacgtgacttctgtaagcgtgttggtgtatcgaagtcagatggtattgttgatgtt

SEQ ID NO: 652684 - DNA, 682 bp, Homo sapiens
  misc_feature (38)..(38): n is a, c, g, or t
  misc_feature (114)..(114): n is a, c, g, or t
  misc_feature (130)..(130): n is a, c, g, or t
  misc_feature (133)..(133): n is a, c, g, or t
  misc_feature (288)..(288): n is a, c, g, or t
  misc_feature (340)..(340): n is a, c, g, or t
  misc_feature (381)..(381): n is a, c, g, or t
  misc_feature (386)..(386): n is a, c, g, or t
  misc_feature (411)..(411): n is a, c, g, or t
  misc_feature (416)..(416): n is a, c, g, or t
cgagttcagagcatggggtctcggttgtcccagccttntgagtcctatatcactgcgcctcccggtacgcgccggcccgcaaactgcgcccccagctacacccggagcgccganctccccagcagaacancgnctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgncacctgggtatcgttgtcatggcagacccaaagggaaggcctaccgcgtgtntgaaagtaccaccagtgaatctgtcttctgtctctgtcccntttcnccgtgacacacagagcaggcatggnatttnatgggtgttactggacagacacttgtacatggacagacatcactactgtggatactacaagactgactaatgaaaatcgtactgttgtcattctctgggctatggagtgtcatgtggccttcacagatttcacaggaagccaataaatccctcagagaagtaaaacaggttcttggtcttatctggggaaggaacgtatagcttatatttaaatatgattgcttaattgagcattatatataagcagtaatagtatgtcttatata

SEQ ID NO: 652685 - DNA, 213 bp, Homo sapiens
cttcgtacgagcgccaagccccaggaatgcgagtggttggtaaaatccgtgagctcggcaatatgttgtttttctggaacttacttatggtaaccttttatttatttctaatataatgggggaggcgtgttaggaggctcgttaaggaggcgctgttacggacgtgttaggaggcgctgttacggaggcgctcgttacggaaggctgttagga

SEQ ID NO: 652686 - DNA, 452 bp, Homo sapiens
aggggtctggatcagatagcatgatgacagtactgatgaccgtgacatccgaccgaactcacgactggagaagagtgacggggatgaatttgtgcaccgtggataatggtgagagagaccacagatgaacgaaaagaagtcaggtctgagtgtacggttaggagatatgcctggaatatcaaggaataaaaagaagaacatgaaggaacagagtcctcttcaagccgtgatgcttcgaatgggaagtcaagaaatccctgaggaagggacgggaagtgacaggaaatttttccagaggaacgattaattgacagatgatatctgatagactctttaaaccaaaaaagcaattcacaaaaagctgcatataagcaggaatccccattctgatggcacattcgacagcttcttcacgagcaacagggtccgccgcagtctgttcctccttctca

SEQ ID NO: 652687 - DNA, 143 bp, Homo sapiens
tacgacaggcttagacttacaaaaagagtactttctggttgtgtggctaaaggagtctgtgacatttcctgagttggctaacagacatcatgtggcaggagctttagcgaagatcaactgagcaactggacctaatttcaatt

SEQ ID NO: 652688 - DNA, 304 bp, Homo sapiens
cggccctctctgtgcacggcgggctctgctccgggggccaggaggtccaggcattctagctgctggcctgtgggtctagaattccccatagaggccaccttttctaatggctcccgacagtgggtggcacagaggaaaagcagtagctgctcaatgaaaccagtgagttcatcttggtgagaagaggcaggtcctagaagtgccttgaggcttgcctcagtcctgggctgggcaggagtctggcggagcctctgaggtgacgagaccacctgggtgggtgaatgtccagagaggggcggagcag

SEQ ID NO: 652689 - DNA, 704 bp, Homo sapiens
ggcaacgcgaccggggcggcctatctcagcaccatccgcctgcggcgctgcaaggtgctctgtgagaagtgcaagagcactggctgagccccccggaggccagcccggaccccagccggcccagggcccgcaggaggctgggcagcggccggacaggggagctccgcaagccggaggagccggataacgggagcccacggctgggggccaccgccaggaggacggcaagagggagaggccgcgaggagggacaagggcccgggagagcaaggtaccgggagagcccggtcaatcaagatctcctacagcacgccccaggtcaccgggacgaaggggtggtcaagatccccgtcccgccgtgcacgagtctctggagcccttccgtaccccagcagggcccccgcaggacgaaggcggcaggaacccgaggtgctggacagagagtccgggaaccgggcggtctgcgccgccctcggcctcaatcacccaagttgaaacttgacacgcgcctagtcccggccggcgacgcagctgcgacccctaagatccgcctgaaagcgctaccggtctgggggacagccaaacacgagactgtgttacgcgcacgatactggtgtcggcacctaacgagatcctagcggaagatcgcggagccatgtgcagacggacatcggtgggtgacgactgaatcttgagtcgggtag

SEQ ID NO: 652690 - DNA, 132 bp, Homo sapiens
  misc_feature (1)..(1): n is a, c, g, or t
ntcggacatgctcacccctccttagactaaaaactaaaatctacgctgggatgtggctcatggctgtaatctccgcactttggaagattggccaaggcaggtggatcacttgaggtcaggagttcgaaacat

SEQ ID NO: 652691 - DNA, 161 bp, Homo sapiens
ttttgccccccccgcccccccgggggggggctgcccctaccaaggttggggttccgccaaaaaccaaacccagcccccccctctttccctccccgggttggaaaaccctgggtttgtttgcccttaggttttccccagggggtttaaagcctttgggagga

SEQ ID NO: 652692 - DNA, 232 bp, Homo sapiens
cccccaaaaaaaaagggtggggttccccaaaccccaacttgttgttttacattatttggaaaagttccataaaaaagggggccagtaataagggaacaatccaaggattgaatgctttcaatatgttcatgtaaaaaggcccctatttttagccataattttgcctgtggaaaaaccaatagccaaaaaagtcattttgtcccgcatatttttttgaaatgttgtctaagca

SEQ ID NO: 652693 - DNA, 642 bp, Homo sapiens
gccgtaagcatcatctactatgctccgagtgatagtagtatcaaaccgcatctctgcattcacaaggttctgggagtacctttgaaacctgtattcagatcacgtctaactcagtttcaaaagctgcaccaaatctactaagctaaaagatgaatactcatcactgcatgctctgtctatatgcatgcgtttgaataataaatataaaatatgggggacgcacagaaccataaaattaaaaatgaaaccaaactgaacattaaacaatagtacatggtagctggagaaatgaataagggccaacactaaatttgaggtaacaatagtggcccaaaaacactgatctgaaatatctgtaacaattcaactaagtgtttggagattccagtaacaaaccatctgctccaacttgttcagacttcccagagtccctgctgagtatcagtccatgagccggcaatcacatagctccttgtaaatcctcttccgcactcgggccagtcttcttgtgaacctggaaaagatgctctaaggcgagcacttgcagactggcgccaaagtaattatagatttatgctatacccatcaactaacattggatcttccagaatagaaaacactttaaatctatgagccaaatac

SEQ ID NO: 652694 - DNA, 124 bp, Homo sapiens
cgaatcccatcaggacatttgttgctgtggactcagttccgtcacggccaccagcccttcctgccgcccccggcgagcgggccggcggtctgcggctggtaacattgtccacgttcttgcgcat

SEQ ID NO: 652695 - DNA, 375 bp, Homo sapiens
  misc_feature (357)..(357): n is a, c, g, or t
agaaagtcgacatgttctagcaggctgccgggcgtcccggtgttgcctatagcctgtgaccgtgactggagacagagcgctgtcggccttgtcgaccttgtcagcgcctcgtgtgaggacatagaggctgtcgcgaacgtagtgctcctagcgatgatcctagcgagagcgcgatgacgacgactgttgcttgctacgtgcgccagagtcgggccccacatggacacatagtacgtacgcctgaagcctgggatggacgacgagccgccatctcaggtgctcggaggcgcaggacacgccaaggtcggaccacactcacgcctatcttctgttagctactgttgcaggccatactgnggtgatagtgtggctcct

SEQ ID NO: 652696 - DNA, 181 bp, Homo sapiens
tccctaaaaaaaaagtttccccctttaacccaaaacccccccataggggggggaattttgggatgggggggggtttttatataaatatataaaacccaatgtttttttttccggatgtggtttaggaactgggaaaaacgttttttttttcccccgatgggcccctgaaaaggttttgtta

SEQ ID NO: 652697 - DNA, 713 bp, Homo sapiens
aaattgtacatggacttaataaagggggtctccctatgttgcccagtcgagtctcaaataaggggcatcaagctcgatcccactcagccatccaaccgttctgaggtcacacacatgagccacagtgcatgccagagtcccgtctttactgttgatgaatgagccaggggtagtaggtttgagacctacccttacatagacaccatgacatcgctgtcaagatcgcacagtcagtgtaggattctattggagaattctggatccttggacctgttaaagtactggagaacatccagtaccaagattggcaagagcattccagcgtcgtgccaactcacaattggtgatggtcagctggtgtcaatgtgcggacacaattcaaggcactcatctggaataagcgcggtgatagatcaataatgtccgtcacaggtgccagaaaagggggtgtggagtctcggtcctccttgtcacaatacagtttgtccattggtcacattgatagcctcaggtttgtaacatgtcatatagtctcacctggcatgccagtccagaggctctcacatagatctctcccgctgtggtccccatcttcccccccatgttacctgtttcaccctttgtaggtccgagtactcactggagctgggcgtgcagggttgggtctcgaaagtggtcatctaagaagtcgatctcatactgggggagttggt

SEQ ID NO: 652698 - DNA, 428 bp, Homo sapiens
aggaatattgtcagggccaagtaatggaagaataagggcggcctttaccctgggcaagtattgagaagagggcataaaaacagggaactactttcatggagacagttttttttttataatcaagtaactagaaggggaaaaatcatttaagttatgaaatcccacataggcgctatattacaaactgggccggattatgcaaattgtaggtggtactgatcaaagtttaattgcttcctttttgtttaaaaagggatactgatgtcaaaaaatctgtaatatgttttattccaaagatgttaataatgtataccgacttgtatgtgatgggatgggaaatatttaaattttagggggttttttttttttaaagaagaaactcaatgtttataagaaaaaaatgaattaataggtacggttggccctga

SEQ ID NO: 652699 - DNA, 183 bp, Homo sapiens
tcctcggtacctcttctctctcttgcctctatgcctgtatttcttggcaatatacatggcctgcctacccaagatcagaactccaaaaccactcccaccccgtaatggtctgggagtggtcttgagcatgccctgtgtggcttgcctgtgctcagtgtccccacgctctcatgtgatcttatt

SEQ ID NO: 652700 - DNA, 248 bp, Homo sapiens
ggtccctggtctcaggctcccggaccacccagtggtattgtctagctgataccagcctcgtgtccgaggggcagcttctagctctagcctctagacttagggcacgccacatattgagagcactatctactcggacgtaatgaagttctaggatcgccgacactatatatgcaccagccaggtcctacattagatactatgggctataggggtacactagtaagtagcatacgaacacctatactggt

SEQ ID NO: 652701 - DNA, 277 bp, Homo sapiens
tctcgtactatgtcggatagtctatcgcttggcatccaatcagtaggacacataatgttcaggagaaccgctaaaatcgaacggaaggcgtgaacgtttgggatatgctgttgagtcaccgcgttgggccattgaaccccctcgcggtctcgaaaccagactgtgatgactgggacagccttgtggatgcaatggagtgtgcattacatttggaaaaaaaatgtgaatcagtcactactggaactgcacaaactggacacgaggacacgaatgttca

SEQ ID NO: 652702 - DNA, 248 bp, Homo sapiens
ctgcgagttagcgggtcgtattgagagtgagaggagagacgcgctggtgtttttcttcttgatggtcaatgacagagactagctcgttaactccggggcgttcctgggctggtcgctcctgctttggcagtgtagctgagaaaggtttctgcctcctgtgttcagcgggtgacggctcttggggtttactcgggggtggctttttaattttagtcttgtgcgcgaggcgggggggatgcttgtgtggc

SEQ ID NO: 652703 - DNA, 365 bp, Homo sapiens
  misc_feature (59)..(59): n is a, c, g, or t
  misc_feature (227)..(227): n is a, c, g, or t
tgctatgcatgaggcagcaacagccagtaaaaacgctaaacttaaagtgggacagtttntccatagggataagtgttatgtaacagaaaacagtccaggcgctgtggctcacacctgtaatcccagcactttgggaggccgaggcgggtggatcacgagatcaggagattgagaccatcctggctaacatggtgaaaccccatctctactaaaaatacaaaaattangcatgcgtggtggcacgcccctgtagtcccagctgcttgggaggctgaggcagaattgcttgaacctgggaggcggaggttgcagtgagctgagatcgcgccacagcactccaacctgacaacagagcgagattcgtt

SEQ ID NO: 652704 - DNA, 419 bp, Homo sapiens
gtattggaaaaggcaacatcgattggttaaaggcattattcagaaagaattaactgggaaaggatgtgcagacagaaacagaagttctcactccaagttgcaggtttcatccggaccagtaatctggtctttcagccttcaggctgttttttggcttgaaggtggggttcacaaggggacccgcccctatctgcctaggccatttgactaccccctgtcgctatcaaacccactgtgttccacttgttttcacagctgcccaagttgtaaggcaatattggttttcaaaactacagtagagctggagaaagggagatggcaatacataaagttaaaactctaaaattcactggtcttcctgagattcaggcatttttctgaataaacattcctcagattatggcaaatttttagttaat

SEQ ID NO: 652705 - DNA, 175 bp, Homo sapiens
tgcgaacgccgtactctactctcggcaaggtggaggcctcgagccgagtgtcgttgccgggcgcctcccctctgaccctcgcgtgcacccgccccgaagaagccgagtccacggcctgagacagcgacccccgacggtgagcacccgtttccggagccaatggacacgcaggagg

SEQ ID NO: 652706 - DNA, 413 bp, Homo sapiens
  misc_feature (23)..(23): n is a, c, g, or t
  misc_feature (34)..(34): n is a, c, g, or t
  misc_feature (53)..(53): n is a, c, g, or t
  misc_feature (92)..(92): n is a, c, g, or t
  misc_feature (155)..(155): n is a, c, g, or t
aaattttttttgtaatttttagntagaagacaangtttcccccatattggccnatgccccgttttccaaacccctggccctaaagtgattcnccccacccacggcctccccaaagtgctgggaggactgcttaaggcaaggagtctgagacccancccgggcaatacagcaagatccccatctctattttaaagaaaagtttcactttgggaggccaaggcgggtagatcacaaggtcaagagatcgagaccatcccggccaacatagtaaaaccccatctctaccaaaaatacaaaaaattagccgggcgcggcggtgggcgcctgcagtcccagccactcgggaggctgaggcagaagaatggcgtgaacccgggaggcagagcctgcagtgagccgagatcgcgccaccg

SEQ ID NO: 652707 - DNA, 597 bp, Homo sapiens
  misc_feature (33)..(33): n is a, c, g, or t
  misc_feature (327)..(327): n is a, c, g, or t
tttctttcctaagccttcctagaacaagtccancttcacatcagcatgtgtttaagaatatattatctggggaaatttcagggtatttcctgctttgtccataattcagtgatattgtacctgtttttctgggctgaaggaaaccaatgactaaaatacttttaaactactgctgcctataccttctttaaagaggtcttattttctcattgctggtagtgagagcttttaaaaggtcgaaatccatattattattccaaaatatgtttagttaaaaactaaatgcctagtagtagaaaaatggtcatataagtaggccgggcatgngtgttgcgcctgtaatcccagcactttgggaggccgaggcaggcggatcacggggtcgggagattgagaccatcctggctgacatggtgaaaccccgtctctactgaaagtataaaaaattggccgggcatggtggcgggcgcctgtggtcccagctgctcgggaggctgaggcaggagaatggcgtgggcccaggaggcggaccttgcagtgagccaagatcatgccactgcactccagcctgggcgacagagcaagactctgtctcaa

SEQ ID NO: 652708 - DNA, 340 bp, Homo sapiens
  misc_feature (64)..(64): n is a, c, g, or t
  misc_feature (70)..(70): n is a, c, g, or t
  misc_feature (228)..(228): n is a, c, g, or t
agatctttcctttgcattcacaacttcgctaactggtgcaagtagcctaacttttagccttttncatctnttgacataccttccttactaagcttaatcatttctagcttttgatttaaagtgagcatcgtgtgactcttccttttactggaaaacttagaggccattgtagggttattaatttggcctaatttcaatactgttgtgtctcaaaaactagggaggctnaaagggagggagagagatgtgggcaaacttaatcaataagatgggcgaacttgatcaatcagtgaccaggaattggttggtcattgggagcagtttagatcacactcaggca

SEQ ID NO: 652709 - DNA, 259 bp, Homo sapiens
agattggcagtgggagaagaatttcagatcatagggttgcttctcagggcatttttaatagtattcaatatatactaaaacattttatcttgagtttgtgattaagatgattaacattgtttcttattttaagggaaaataattttaacaaaatgctgctttgtgaattttaaatatttaacatatttaacttctcatttaaagaccagaaaagattgttattttgattaaataaaaattggctttagtaattcaaaaa

SEQ ID NO: 652710 - DNA, 177 bp, Homo sapiens
gccacaaggcattcgaggcgataagggagagcccggtaaaaaggggcccacgcggtcttcctgtgcttgaacgggacacaactggattgcaaggtctagcctggtatcgctggtcacgcatggtgatcacaggtgctccttggctccagtgggtccttgctggtcctcaggagccct

SEQ ID NO: 652711 - DNA, 114 bp, Homo sapiens
tgaagatcggtctgcttacttccggcggcgactgccccggcctgaacgctgtcatccgcggcgctgtcctcaacggcgtcaagaagtacggctacgagttcgtcggcttccgcg

SEQ ID NO: 652712 - DNA, 249 bp, Homo sapiens
gatctgtgcacaacggaggatgcggtggcgcagtcatggctcactgcaacctcgacctcctgggatcaaaaaatcttcctacttaagcctcttaagtagctcgggaccacaggtgcacaccaccacacctgtgctaatcttttttttttttttgggaaaaaacggggtctcacttattgtggcccacacgtggtcctccaacctccggggtttcaagcatttcctcctgtgctgcagccttcccaaatt

SEQ ID NO: 652713 - DNA, 1215 bp, Homo sapiens
ttttagatgtcgccctctcttctaatatgtggtaagattttttccaagagggaacttttggggcacaaagatgagtttataaaacagtgtgtttccaaattgtggccacaagtgtaaaatacgtttgtgagcgtttaatttttggggcccataataactcagggcctctttctcccaccaatgtgttcacagaacaccctcagagcacggggaatcaccaaagaagattttttgtcacacatgcgtcaatatcactgagtgtttcccctttgtgaggtgttttgtggcccgctgtgttccaccaggggggccccccagacagggtaaagggcgccctttttgactcctcctctctgaggaacacactttctcctttgttgcccctgggggggcacacacaactgggtgacacattgtcttttttttcgctagttggtgtctcgtctcttttctctctgggaatagatcttttataccagatttcctctttgtgtgtgctctctctcccccccccttgttgttgtggtcccacatatgttttttgtttctcccccccccttaaagatttataatgttcgtcgttcgtttgaggagatttttcctcaactctgttgatagttttatataaaaagaataataaataatgttcccccccctcgtgagaaaggttccacaagagagcattggggggccccgggtgttgtccgcgggggaggaaacaccacgcccgctgggctgccacagtgtttacacccccgagtctctcctctcgacacacaccccgcgcgtatagtctcccctctgtgcgctcgctttctctttatatacgcgcccccaatgtttgtttctcccttgagagagccacagagagttgtgggagagaggccccccgtgcaacacccccacagcccacaagcttctgtgcgcctcacacaagagccgaggggaacacaaaacgccacattctccaccccctccttagagggatcacacacacacacaagggctgtggtttttcctctgggggagagagagagaatggtgtttgtttaagaatatcacgggtaaaggcacgtacacgggcgggggttcacacacacactgcctttttttccttctgaggggtgagagagacacacctgtaaccccgcccctcgcccctgggtgccctttcctggaaatggctttaaaaaatccttttccctttttggggta

SEQ ID NO: 652714 - DNA, 97 bp, Homo sapiens
tcaggattacatgaatacttgacaccgggaggagagtattgagtaacgcgagattgaccactgcactccagctgtgtgacagagcgagactgtctgc

SEQ ID NO: 652715 - DNA, 97 bp, Homo sapiens
tttcaaaactttttaaaaggaaaatttaaatgattttttaaaagtttagtgatatgtatccatggaactaaaaataaatttttttcagtccccgcca

SEQ ID NO: 652716 - DNA, 389 bp, Homo sapiens
gatacccgagcatgcctgcaccagcttcccaagtagctgggactacaggcgctttctaccacgcccagctaatttttagacaggggggcaccatgttggtcaggatggtcttcgccctcctgacctcatgatccacctgcctcagcctcccaaaacgctgggattacaggtgggagccaccgcgcccagcctaaaaaaagcaacttttatatgtagtccaaagatacatacgctaagtgtcctcaatccttctctgctcaatctctatgtgacttgatgcagggtaaagtggataaaataataagccacttcacaattttgaaactttacagtaatatccaatatctaaaatttatttgaaagattctgggcctggtgcaggcatacct

SEQ ID NO: 652717 - DNA, 165 bp, Homo sapiens
ggatgtgcgctctgaccatgttttccccaccatgattgacctgaaaaaaccaagctatcctgtgcttggcttgtggcgcgcgtctttatcgcgttgacatgggttggtgggtctactattgccttgttgaaattcagagcccttttgggagcggcacatgcgttg

SEQ ID NO: 652718 - DNA, 144 bp, Homo sapiens
ttgcatatgcaaggccaaggagttgggtaggcagcatggtgcaggatatctagtgtggtggtgcccgagtgaagataaccacgtgacgaaataaaaaaagctacctatggagttgtgccccctacttggccttgccatatgcaa

SEQ ID NO: 652719 - DNA, 365 bp, Homo sapiens
  misc_feature (61)..(61): n is a, c, g, or t
  misc_feature (95)..(95): n is a, c, g, or t
  misc_feature (126)..(126): n is a, c, g, or t
  misc_feature (141)..(141): n is a, c, g, or t
  misc_feature (182)..(182): n is a, c, g, or t
  misc_feature (267)..(267): n is a, c, g, or t
  misc_feature (269)..(269): n is a, c, g, or t
  misc_feature (282)..(282): n is a, c, g, or t
gatccttcccagagctagggctgccttaaaggaaattgtagcctaagtaggtcatggcaanggctgagcctgtcctcacagctcccaggttaggnactgtgaataggctcagctcctctagagagntgaagccatctggtncttagattcctctcccagtcctctttcccattgttctgttntccaccttattgtctcaaggccgtaatctcatcaggttgggacattaatcttttcaactctttgtaagatttcccggtttggttntnttacatgtccttnagttccccacttctccttttcgctgtgtagagaatctctgcagtttaggcaataaaaataaattgtctcactaaaaaaaaaaa

SEQ ID NO: 652720 - DNA, 461 bp, Homo sapiens
ccctaaaggaacctgtacccatccacattttttcctaacctccccagctctaggcaactatcaatttactttctgcctgtacagattttcctattctgggcattttgtataaatgaaatcatacagtacatggttatttgtgactggcttcttctatttagcataacgtttcagggtttcttcatgcctagcatgtttcattatttcattcattttatcgccaaataacattccattgtatgaatataccacactttacttattcattcgtcagttgacgggcatttgggttatttccattttttggctgttattagtaatgcttctgtaaacattcaagttttcagtggatatatgttctcatttctgtagattatatacctaggagtggaatttctggatcatatgttaactctatgttcaaccttttgaaaaacaaccagactgttttccaaagtgga

SEQ ID NO: 652721 - DNA, 945 bp, Homo sapiens
  misc_feature (41)..(41): n is a, c, g, or t
  misc_feature (166)..(166): n is a, c, g, or t
  misc_feature (170)..(170): n is a, c, g, or t
  misc_feature (183)..(183): n is a, c, g, or t
  misc_feature (222)..(222): n is a, c, g, or t
  misc_feature (225)..(225): n is a, c, g, or t
  misc_feature (243)..(243): n is a, c, g, or t
  misc_feature (277)..(277): n is a, c, g, or t
  misc_feature (290)..(291): n is a, c, g, or t
  misc_feature (298)..(298): n is a, c, g, or t
  misc_feature (303)..(304): n is a, c, g, or t
  misc_feature (306)..(306): n is a, c, g, or t
  misc_feature (309)..(309): n is a, c, g, or t
  misc_feature (330)..(330): n is a, c, g, or t
  misc_feature (338)..(338): n is a, c, g, or t
  misc_feature (343)..(343): n is a, c, g, or t
  misc_feature (394)..(394): n is a, c, g, or t
  misc_feature (414)..(414): n is a, c, g, or t
  misc_feature (438)..(438): n is a, c, g, or t
  misc_feature (453)..(453): n is a, c, g, or t
  misc_feature (487)..(487): n is a, c, g, or t
  misc_feature (494)..(494): n is a, c, g, or t
  misc_feature (508)..(508): n is a, c, g, or t
  misc_feature (659)..(659): n is a, c, g, or t
  misc_feature (663)..(663): n is a, c, g, or t
  misc_feature (764)..(765): n is a, c, g, or t
  misc_feature (785)..(785): n is a, c, g, or t
  misc_feature (787)..(787): n is a, c, g, or t
  misc_feature (789)..(789): n is a, c, g, or t
  misc_feature (816)..(816): n is a, c, g, or t
  misc_feature (831)..(831): n is a, c, g, or t
  misc_feature (929)..(929): n is a, c, g, or t
aggggggttcccacgtaagcactggtttccataaccctgtncaccacttccatagcctctgcttcctccagagtaaccagggccgcctcctccataaccacctacaagaatacaattcttctcaataagacaaaagtatttgacaatgaaaactttttcaattttnacgnctgaaggcctgcncacagcatgcgttttatttggcaatattttattttttanatntcacctataattttattntctactaacctattctaaagatccaggtttccangaatttttctctnnttattcntaaannanttnccatcattaccaaatccattntatccatncccantgccaccatatccaccaccaccacggctgctaccaaatccaccttttatanaaattttcaatttttaattnttatttggacttaaatttacattnttaattcatttcccntactttaaaatcttcatatcaaatatttttatanttctatnactacatgtagttnaaccatacataccacgaccactgaagtttcctccacgaccgaagtttttattctctcaccgaaaccacctccacgaccaccaccaaagtttccagaaccacttcgaccttaagacatgaagtttaagcattaaatcattcatactggagtnactnaaagttacctttaaggtttaattaagcaacaagcatacctctttggctggatgaagcactagccatctcttgctttgacagggcttttctaacttcacagnngtggccattcacagtatggnantnctgaatgacaatcttatccacggagtnatggtcgtcaaaggntacaaaggcaaagcccctctttcttgccactccctcggtcagtcatgatttcaatcacttcaatttttccatactgttcaaataatctcttatgtgangtccttcagtcttttt

SEQ ID NO: 652722 - DNA, 153 bp, Homo sapiens
atggaattcagtttctcgcatcattattgaagaactaccaaattaatgctttacttttcatttgctacctcttttttttattatgccttggattggttcacttaattgacattttaattaagtttatgtatacagtctgattgaaaggcaaag

SEQ ID NO: 652723 - DNA, 131 bp, Homo sapiens
gcagtggcaccagtcttgtatttgcccagtgcagagccccacaacctaggtcagcgaatgaagagtatcttcagatctcccccgaagcgatgatgacaccatgaagccccaaccatttggacttatcgacg

SEQ ID NO: 652724 - DNA, 272 bp, Homo sapiens
tttatcgcatctacttattgtctataccacatcagatgacagtcagcacggtggctcacgcatatatcacagcactttgggaggccgaggcgggcgggtcacctgagtgtgggagttcgagagcagcctgaccaacatggagacaccccatctgtactaaaaatacaaaaattggccagatgtggtgtcgggcgcctgtcatcccatctactagggaggtggaggttgcagtgagccaacttggcgacagagtgagactccaatctcaaaaa

SEQ ID NO: 652725 - DNA, 435 bp, Homo sapiens
atccctcagctggaacaagaatgaaatgtctccgtaactgggctcctaaaacatttcatgtagcatgaggctctatacgtgatatagtaggctatatttacacaagtcctggtaaaattctgacaccaagaacacgagaataagagttgttctccatcaagctgtatacccttttctgggcagttgtcaagcagccacttgtcagcttcttgtatattctgggcaatcagcagtttaggtttgaaaatctatggtttatctgcaacatcacaaacaccagaaagttgtttatttggtcatcagcagttcaagattcaacatttagtatttgaaaacaaaaaataaaaattatgtgtgattagctttactagctaagtcacaggagaactttaacataactgaaagctacaacgggaagggacttattacccctcc

SEQ ID NO: 652726 - DNA, 935 bp, Homo sapiens
cagtgagtcgagcggaaggttgacgcaatgtcccagtggatgacttcgggcgcggcgggcggaatgaaacagaatgaggaaaagaaaattctgtgaaaaaaaaagcaagacagcactgcaaaaccacagtgcagtgccagccgaagaactagacaggcgccgtcacacaaggtagaaaaccgcaagcaaagccatcaaacctacagagcatggccacacagaagaaacgctacacgttcacacaaccatcggaaaccgaacgaaacgcaccaactcaactcagccatcgtgcaggaggaacctaaagcattgacacctggcccagcacctcaagtggaaactcaacacacatccatacaaaccacctcgtacaacattggacccgccggacacaccaataccactcacagacacagcaccctaccactggacatgagaccgacacgcaacaccagaggcaccgagtgcatgacccatgcccaaccaaaacccacccaaagcacgaacaccaaaagagccccacagggcccatcaagacctatcaatacaccacaaacaccgcacggcacaccaccatccacagcactcacacacaaacgccaaacaacagtacccacctccgaagcggacaacgaacacgacaccacttctgcccgcactccccacgaacggcaaacacaaaacccaagtatagggaaccacagagcagaaacagcacaccccacaaaactacacataacaggaaacaactacacgcacaaccaccaagaaaagaagccacggaaacaacaccacccaaacgacaccacacaccaacaccagacacaaacgcacacaaagcaaacacacccacaacaaagaacacacaacagaaacgagcacaacacaacaccaacacacacccccaccaacaacaacacacaacacaacaaaac

SEQ ID NO: 652727 - DNA, 229 bp, Homo sapiens
ctcggcaccttatacccacgatcacctgatgatttgggaggcagaggcaggaggattgcttgaggccaggagtttgagaccagccagtctaacatagggagactcttatctacaaaaaaaaattatttttaattagtctggagtggtggtgtgtaccttatactcctagactactcccaagagctggacaagcagtaccagcttgagcccaggtagtttgagagctgca

SEQ ID NO: 652728 - DNA, 463 bp, Homo sapiens
aggacagtcttaaacagcagctctgcattgctctgccgacaggctgcagaggggcagcacccaggtctcagccacggcaggagtggaggagcacagttcaaaggtcacagaattgcagtcctggagctgggtccctgccaactcccggagagtgagcgaggggccaactgggctgtgaatgcactgtctctggcagtggatgatttcctcgttcttctacgatagagactctaatgcctctcaggcccctgatggtctacaggccggggtgacgtaaatcccaagtgaggggtaagaaaaattattcctgcttttctccaggttataactggtgataatgtaggcttgtctgctttaatctttcttttctcaaagtctaagtagaacacctgcttaacaacttcctgcccacccatcactcagacaaaaatgccagcgtccaagaacaatgtagagccacctc

SEQ ID NO: 652729 - DNA, 217 bp, Homo sapiens
gacagaatctgtacaccgagtgtgtcaaagcagatttgcctggtcatagctaggagacgctctcccagtctaccgcaaggagagagtcatgaacattccgtaccagacacatgcaggccagctccccagatacatctgcgctgtgcgtgacaagatcggtgcagcgacgctgcgtggctacccccatgccacccatgacctggattctgctgacctg

SEQ ID NO: 652730 - DNA, 1379 bp, Homo sapiens
gaacacaggtgtcgtgaaaaactagcccataataattgtccaaaatgggatacggaaagagattacatatcatataacttgatcgatctagttaggtaactaactgatgaagtatttacggagagactaacgatcctaccaatctatcctggacacatcatgatctaataaatgggggtggggtcgacaaatagataccgattgaaaaatcgaggaaggaggctggtgagatgggaatagggctcgcattcaaagttgatgcacatgggtttatggaattaaaattgaatatgctagatgactgtagaagcgtggtatctatcatagatatctcattaggggagatttgatgaccagataagtactatgtgaactaatcaatttgaatgtcactcacggaataacatgaagaaacttatagtgcatgataagaatgagttaacatgggaagatacttcaagtgactgaactgttgcatgtacactgactcgtttgactggtcggtcgattggggagaagaatttggaaagcttgggtatcctccaaagagcttggtggcagtacccagaggagtccatagaccttattctgtgcatgtacaacactggtgtttggtgaagattaaaagaaaataatcggtcgggagggttaaacaaataatgggtagtatccaatcttggatgaccaaaccagctaacacggtccaggagagtaagaactcttggagggaaacactttgtttaacgggcaggcttcacgttaacctttgacaattcactcagacccacctggcgtcttactaaggcaccggaactaaggagtgacgttatgtttgatgcccaagcctcacaggggtacggacatcggctgaacagccaattgccttggaagccccacagtggttaaaccatgcctagggggtacaaaggggcatctgggcacaaattggcgccggtaaaagaaacacggggccatgcaccactgtggatagccaccgcaaggatatgaaaggttcttgagaaacggggttctcaaacacaccagaggcagtctccacttgacaagacccttttggccgcggatcataccaagggagtcttaaaccaatggcgggaaaataataagagggtaccaatgaggacaaaaagtgaaaaagtgtttcacaaacccggcgtgtggtggaacccctgtttgaatgcaagacgacaacagggagaaatggtgcagcaccaaagatggtagaacaccactagcagaaaaggtctcaacacgaatgcatacaaagcgcgtgcacggggtaccacacacagccgagagcaggagtgataaatacgacacagagcccacgacggcaaaagaagcgtcgagaacaagtagag

SEQ ID NO: 652731 - DNA, 556 bp, Homo sapiens
  misc_feature (85)..(85): n is a, c, g, or t
  misc_feature (128)..(128): n is a, c, g, or t
  misc_feature (159)..(159): n is a, c, g, or t
  misc_feature (299)..(299): n is a, c, g, or t
ctggcatagatggtttgccagttaggatgtctcaatttgagccttggcttttggtggataactcagctcccctcttgtaacctgnaaagttggttgcctttatcatcctgctggttttatccatggantgaacacccaacagcagtgcactatgctttntatggcatctttcattctcattttatattgtgctataaaaaggattgtttctccatatatatattatatatgtgtgtatatatataatataatatatgtgtatatatatattatatatataatatataatatatatattntatatatattatatatataatatatatataaaatatatatatatatgctctcctctttcagcctctttgtcacagggaagaagtgtaggaggttgccttgggccctgcctctctcctaacctccttttccccactgggtaccctcagcccctatattttaatttttgatcatgtagaaattgtttttggtaaatgttgatattattgttattatcattattaataaataaagagaaaaggaaattttgtttaaatga

SEQ ID NO: 652732 - DNA, 244 bp, Homo sapiens
tgatacggaccccttccccactgtgagggtgggagcagcggaacacgggaatggcagacacaggctcgctgctcgatggaaggctggggtgggacttccattcctctgtccggagaggcacaggtgtcaccatgttccagccaaaggctccctcacaggcgctgtgaatttttggtacaaggtcttgtaattattcgaatcaacaacttgtttcaattttaattaaaaattgctcacttgtggg

SEQ ID NO: 652733 - DNA, 381 bp, Homo sapiens
  misc_feature (57)..(57): n is a, c, g, or t
  misc_feature (86)..(87): n is a, c, g, or t
  misc_feature (286)..(286): n is a, c, g, or t
  misc_feature (314)..(314): n is a, c, g, or t
  misc_feature (324)..(324): n is a, c, g, or t
  misc_feature (340)..(340): n is a, c, g, or t
  misc_feature (365)..(365): n is a, c, g, or t
tagagacagagtctcaccctgttggccaggctggagtgcagtaagtggcacaatctnggctcactgcaacctccgcctccttggtnncagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacagggcgtaacaacttgcaccnaggcggggtcttgcttattttaaaaggnaatattctgnttcatattttagggantttttgttcaacgaaattggttttngatcccctttgggtac

SEQ ID NO: 652734 - DNA, 244 bp, Homo sapiens
ggaagtggcaacaaaaaggccaaaactgccccctttttgttttttcaatggacccttcacaagtgtttttcctgcccttggggctgttttccttttcctgaaatccaaaaacttttttggtcatcccttttccctttcacttttgttttttgctgcaaaaaacaaacttgcaaatccctgattaacaggtcgggtacttttgtaaacttcagatttggagagaaacccgaaagtctgaatcctg

SEQ ID NO: 652735 - DNA, 488 bp, Homo sapiens
catcccatatacccatagcgggcctaagccaagacaacaagaagcggcaccgcgggccacatccaatgtcttcgcaatgttatgaccagtcccagatccaggagtataagtgagtgctttcaacatgacttgaccagaacctgtgatggcttcattgacaagtgaggacctgcacgacatgctggcctcgctggggaagaaccccacagacgaatacctggagggcatgatgatcgaggccccggggcccatcaacttcaccatgtccctcaccatgtctgtgggagaagctgaacggcacggaccccgaggatgtgcttcgcaacgccttcgcctgcttacgacgaggaagcctcaggttacatccatgaggaccacctccgtggagctgctcaccaccatgggtgaccgcttcacagatgcggaagtggacgagatgtaccgggaggcaccccttgatacgcaaggcaacttcaactccgtggggg

SEQ ID NO: 652736 - DNA, 785 bp, Homo sapiens
atacacagcggggtaacgttgcaggcacggggcccacccctgtggtcaggcagagcccggccatgtgctcggaagtgctcgaagcgacccgtagggtgcgccaggtcctttctttcgatccttcggggttccccccctcctggagcacctcgtggggcattacctattggggttgtcttccccagtgcccagaatgcagggtgccaggaccacccagaagtgcagcagggtgccattcagccaccctgggggcaatggtttcttcccacggcaacgttgccaccggtggctgctcagcccccagatggcggttctctcgaaggctcaagagcggggcccgttgggcaaagtggggcccccgcgctctgatacaggtcaccggtggcacccacggaagggtagaacttgaagttcgtcctctccgaagccctcaggcaacaacatgtcccacgcagggagacggctctccccgggaggggcccccgcaaacggcgggcgccagggagtaacatgaagagctaacgcttctatgctataccatctgattcgtttgtatatcacaggtgaacctcaccacgaacgctacgggggttatctctattttttggcatatcacagcgtgcatctatgcccaaaaaagctcagcggttacaagggtgatgtcacgccactgtggtgtgaccactctcagggagtacacacgatggtgagctcccctcgctcaggggggataaaacccccctcccacccagggccaagcccccttaaaacaacccacaagaaca

SEQ ID NO: 652737 - DNA, 364 bp, Homo sapiens
ttcagaggctgagcttggctgcccatttgcgccactcaccttctaccttgtatctccacattcggcaatcctcgaacactactgaatgttttgctctggtggtcacttttacatcccaacaactctctcttggtcttcatgttttcttttttcatggcacccagctttcatctgacaaatgcaatatcccctcagcctcccacaaaatgttaattggagtttccctaagtaggatgcttatcaaaaagatcagcctctgttctctgacttgtctgtgtactttgcagtagtctgaattctctgccacagttctttacccctcgtcacactaccgtaagccagctgcagcatgggtttcagtgtg

SEQ ID NO: 652738 - DNA, 423 bp, Homo sapiens
gcgctgtgggaattttgcacgagcgcacctctcccgattgtggagaccacaggttgatgtgatgtgcactgtttttcatgacaatgaagagacatttttgagtacttatatgaaattggcacgaagacattcttacttttatgccccggaacttcttttctttggttaaagggataaagctgcgttttacacgaatgtgtggcaagctgttgataaagctgtctggctgttggcaaagcttgatgaacttctggatgaaaggaaagctttgtctggcaaacagagacttaagtgtgccactctccaatttcccaaagctgagtttgcagaagtttccaaggtagtgaaagatcttatcgtgcacaccgaatgctggcatggagatatgcttgaatgtgctgatgcaggcggaccttgtgccag

SEQ ID NO: 652739 - DNA, 297 bp, Homo sapiens
ttgctataatgaactgactgaatgatccagctccaatttcatttatagcctgaattctgatccggtaagtggttgctggaaggagaactctcataacatgcatggtggtgtcgcccacggtaatgctagtgtctcctagatcaatggtgtacgcaacggatccagatccggtattgcccggctcttcccagttcagtacaaggcacgcagaaggggaatcaggggtaggcatcaagggggctcctcctccaggacacagagagtggagacggggtcagggggcagaacgctggcgtc

SEQ ID NO: 652740 - DNA, 140 bp, Homo sapiens
gaggtaggaatcacttgagcccaggaagtcgaagcttcgagcgagcagtgtgcatgccatggcactccagcctgggacatagagcaagaccctatctcaaacacaagaaagcacaaagactctcctttgcattcacaact

SEQ ID NO: 652741 - DNA, 382 bp, Homo sapiens
tagtgatccccgtcttccgcatctgccgctcaccaagaccctgctggataatactgtatcacgtgcccttcccgaatttgatgggaacaggttccagaatgttgccaggtaaggagttaagttcgatgaacgtgagaaaactaaggaaagtcgtgactcggagacccctgacgtgagcctctgctgaattggatgaaagataaagcccttaaggacaagattgaataggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgaggcagaagcaggaag

SEQ ID NO: 652742 - DNA, 512 bp, Homo sapiens
gacgaataagtaacatgtaaaaaaagtaattggctgggcacggtggctcacgcctgtaatcccagcacttagggagggcgaggtgggtggatcatctgaggtcagagagttgagaccagcctggccaacatggcaaaaccccatctttactgaaagtacaaaaaaaatagctaggtgtggtagtgcacgcacataatcccagcttctagggaggctgaggcagaagaatggcttgaacacaggacggaggttgcagtgagccgagatcatgcccctacactccagcctgggtgacagagcgagactctatctcaaaaaaaaaaaaagaaaaaagaggaagcagaaagggagcaacacagaagacgagggtatcattaagtcaatgaaaaacaggtatggatacagagctgctccttaaacagattgtcaaatacatgattggacatataatagttccttacatcttgggggaatctcaacctttattctattggacctatgggcctatgtat

SEQ ID NO: 652743 - DNA, 206 bp, Homo sapiens
ctgatagctgattctagagtatcccctatctgtcgtatcaccttcaatgaagaagggcatgctggctggaggaagtgttatgggactaccactatgactcagcacctttgttttttttttgttttggttatttgttttgacgatggagtctgattctgttagcccaggctggtaatgcaggtggcgcgagtcatcggctcactgca

SEQ ID NO: 652744 - DNA, 179 bp, Homo sapiens
cgttataaggatctttattatttattacattgaactcatccagataatctaggataattttcttatctcaaaatcttaaccttaatcacatctgcaaggtccctttgccatgtatggtaacatatgcacatattgcagggataaggacatgggcatatttgggggactagttttctgcc

SEQ ID NO: 652745 - DNA, 785 bp, Homo sapiens
  misc_feature (480)..(480): n is a, c, g, or t
ccaacggggtgtgtgagagacatctcttctagccaacgcggtttgtataaaacccttctactgttggtcgtatattaaaaatgggtgcggctcacgcgcgcggcttgttgttcaaaaagagacaaaatattttgccagaggagtcgcctcatcttttcccttctctctagaagacaaagcgcagtgtttacaatacgcccgctcacgcgtgaccgggcgtattatacagcacccccgcgctcgcatgatgtctcccactcatcacgcgcgcgcgcgagagcaaaacgtccgctctcactcgagggagagccctcctatgtgtcatacgccgcgtatgatatacacatccatactttctctagacccccgccacacttggtgagatacgcagccctacattctctcgcggcgagcctgagcgtatcgtagagctagtgagactcgccacttctctcggaggtatatcgtatatatagacanattttgtgtgaacgctgtagcgtaaaaaaccctgtacatacgacacacacagtgtttcgccgcgagatagcgggccgccagacgtgaagacgattagcagggacacggagatcgagcgagcagttctcgaagagagagcgagcaacaaaacgcgcttacaggcagagcaaaaagaagacaaaggtgtcagaaccgccgcagagtgacgggcgccccccacgtaaaataactacccacacgcattgaggacccacccacgcaaaagagcccagagaatgggcccacaaccggcccaaacaaaaaac

SEQ ID NO: 652746 - DNA, 951 bp, Homo sapiens
agaacaaaaaaaaaaaaaaaaaacctttaatttggtaggactccgatgatttggggacttcgggaaaattcaacccagcccagagttaccaaccaccattccatcttttcaacttggaacgagcaattagttaaaggtccaagtaggtggggacccctttctctgggaagaaagtcctattgggtgtctccagacgggtgtaaacaaaccaagccaagccggccaaccttggttaaaccttataagcttttaaaaatccaattatattctggcaagaaatatggcttggatagttagccctaagcccaataggtgttttggtttttaccagatttatatcctgtctggggggtgagaaaaaacccttggttttccaaagggtccatacggggtcacttggtttcattggcaccactttatgggtttgtcagtttaagaacccatttttggtgtggttcccttgtgaaagcttggggaaagagttaaacttggaataggtgggagaaatacgctgggtggaattttaagcggttttggcgttggtttcagcaccattggagccaaatttcattttgaaaactatatacttatttatcactctttgtgaaacgtttttccagtggaaacttcggccatagtggttttcttcaggtttgtgaaacgcaataggatatatattcttattatggtaacttactggtggatataacgccggcaagtgtggggtggtgtgtcttccccaggaataatgcgtttgggactcgtgggtttcatggatcggtcacaatttaattaagagtgtgagttataccaaatctcctgtccgaattagaacgtgtctgcaaacactgctgggactgaacccaaggtaagaaggtgcgcactacaaacaccgcggggcgtgtcaacaggttctcggcgtagaaaggggggccttatagtagtatcgcg

SEQ ID NO: 652747 - DNA, 162 bp, Homo sapiens
aagtcgggatgaggggtgactatttagacgggcgccctgagatgcttcgatcgcctaggtatgaaacgcggctcgataacttggcggcaggcggaaaagtactgcgctaccaacatggtacggtgcgcgtatcacacagtgaactggggcaaatgtccgaga

SEQ ID NO: 652748 - DNA, 436 bp, Homo sapiens
atgccagataggctttcctcggctcaaaaccctccaaggggttcccccatctcattcacaaggacctgactggggggggtctggcaaagccctccaggtcatcctcaccaccagtaccacggcatcctctactacttttcccctcactcatccacaccaggtacatatatagtagcccgaaccagcagggccttggaccgggcggctccctcaccgggcacactctccccctagataaccacaggacggagtccctggcttcctttggctcatttatcacctggaagaatctgaacttcctcctaataggccccttatctccttaaaaatacctggagatatctttgcagagcactcatcacggaataacatacgatatataagggagggtttttctggatgggcggacatcccatctcccccggaagggagccca

SEQ ID NO: 652749 - DNA, 406 bp, Homo sapiens
gggaaaacccaattgcttttcccctccaaatgtcccctccgggagcaaagtttggcccgggggaatcagcaaacatttatgcccggtcagctatgggcccatccgagcccccccaggggggggatgtttttaacgttatgcgggcccccgggttccttcaaggggtcctaaaaaccccccccggggtgggtccccccaattaagcccttttaaatggtttggggtccctggcccccccggccccccaggggggcaaaaagggccaaaaggggggagcccaaaagttggactgggggggaaggggagttgggtttgttttgggggcggcatgggggggccgggaaatagggtttaatgtgtgttttttgttcccctttcccccttaataaaggttggccccttttta

SEQ ID NO: 652750 - DNA, 295 bp, Homo sapiens
cccaaaaacccggggctttcgcctttggcccatgtcaaaaaaacagaactttgccccctgccccccttctggggaccaagaatgagccccttcttgtagtttgtttcccttgtttaaagggggggcctgcccccggggcttttccccaaggttttggctttgggggtttcccccctccccttccaggggcgccggtgtttcgaggtttaacggggcagctttgtgcagggttttggccccccgtggggtacataggggccaatttagaataattaactggggccttttcctggga

SEQ ID NO: 652751 - DNA, 315 bp, Homo sapiens
gcggccgcctactactactactgctcgaattcaagcttctaacgatgtacggggacatgatcttggctcactgcagcctccacctcctgggttcaagcggttctcgtgcctcagtctcccaagtagctgggattacaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcaaaaaa

SEQ ID NO: 652752 - DNA, 319 bp, Homo sapiens
acttgagttgttgagcaataatgctgatgcaaggctggcatggtgcttgagcctgtaatccagcactttgggatactgaggcgggaggattacttgaggccagaagttcaaggctgcagtgagctatgatcccaccactgcactccagcctgggtgacagaataataccctttgtccagaaaaaatacaaaaattagctgtgtgtggtggtgcatgcctgtattcctagctactagggaggctgaggcaggaggatcacttgagcccaggaattggttgctatgagccgtgatcatgccactgaactccagcctgggtg

SEQ ID NO: 652753 - DNA, 191 bp, Homo sapiens
  misc_feature (2)..(2): n is a, c, g, or t
antagcgaattacaggtgccgctatcacaccaagccaatccttatatttttagtagagacggggttttaccatgctggccaggctggtcgtgaactcctgacctcaggtgatccacccgccttggcctcccaaagtgctgggactataggagtgagccaccgcgcacggccttttaatttttttatttttt

SEQ ID NO: 652754 - DNA, 481 bp, Homo sapiens
  misc_feature (114)..(114): n is a, c, g, or t
gttattttaaaagaccccttttacccacgctggaagtgtttggttaaccaggactttttgggccggcaaaaaagattccccccccccccccttttttttcaattaaggggaaantgttaagggagggtgaaccaaagagccaccttgcccctttcccccccctttaaaaaaaactgtttaacggggggtttccgaagccccctggttttccccctttaaattaaaaggggccccccccttttttttaaaccaaggcatttgaaagttttgccccctggaccctttttttttttttggggcccattgtttaaaaacccgggatttattttttggaacccttggggaattgcccctgggttcccccccccccccctgggggtcccccccttcccacccaaaggggggttttttaaaacccccccttttaaaataaattttttggaatcccatgggtaaaaaaaagcccctttggggattttta

SEQ ID NO: 652755 - DNA, 161 bp, Homo sapiens
  misc_feature (48)..(48): n is a, c, g, or t
  misc_feature (139)..(139): n is a, c, g, or t
cctccagcagccacttcagagcccccgcctttgcctgcactcctcctntggggcttgccctgcctgctctgcggcagcctctggtgacgtgctgtccaccaggccttggagacaggctagcctggccacagaattaaanctgttgccaacactgccggctt

SEQ ID NO: 652756 - DNA, 848 bp, Homo sapiens
cggctccaagcagggcaatccggcattatgcattaccagacgggcggccgcggcggagccaggccggtcctcagcggcccagcaccgacgatcccggcaacccggaaggcgcgcaccggaggccggcggccgaggctcgcgcatcccagcgcatcagtcttccagcctgctccctctagagaacgggaacgcactgaagtgagatccgacgctcgaagatccagcctagcccttggcctcgcaaggcagggaagaaggacaggctagctgaggcaagcggggccggtggctatggccgtcggccgataggcagccgtccggtgatgtcccgggaacgacgcgcatgagtaggggagtcacgagagggtaggccgcaggcgacaatgtggccagacaccgtaagagagccgtcgaggggccgactcaaagggtaaggcaatgaacataggcgttgcatgcgcaagcaccgcggaaagagccgaccagcaacatccaggaaaggacaatgccaaggtggctggacgcgcaaaaatagctgtgagacaggggaggaagaggagggcatcctcggacaggagatcctcggcaggaggagacaagtgacccattgtcagtgccgacctgctccttcacgtggcggaggcagcttccgtcatgtgactgtacagcttgtgctcccggtccccaagggggaacgctggccgcaatgaccccgaagaaatacattggaacaatttcctactcccaaatggccaaaggcgtaaggaaaacaaaaaggataatccggaaacatcacgccggacctcggtggcctctgggccagagatggaagtacttccaaagacaac

SEQ ID NO: 652757 - DNA, 130 bp, Homo sapiens
  misc_feature (99)..(99): n is a, c, g, or t
tacaccctactggaatgagcaaagcagctatcaatctgtcaatcctgtctgtgtctgggcctgggtgggagctggtggagcaatctatgtgtggtgatnctcttagtcagtcgcacctgctagtgctatg

SEQ ID NO: 652758 - DNA, 235 bp, Homo sapiens
gctactgaggaggagctgattggcagccagttatggcttcgtacagcctgtcccgctggtggcacaggtgtgctgaatgtaccagttacggtgacgaagggaatgcatggcccagcttgttgtgatctcagcagcgttcatagcattaggcagatcctgtttgtttgcaaagacaaggagtacagcatcccggagctcgctctccgccagcattctcatcagctcctcccagtct

SEQ ID NO: 652759 - DNA, 1461 bp, Homo sapiens
  misc_feature (1164)..(1164): n is a, c, g, or t
gatcgggtagcaaaaatgctacctctctatagtaactctatctacgaatcttgccgttaagttgataacgagttcaacagtcgatacgaactagatctatagtcttgattactcgtgtcgttcggagaatccactcgttattacccaccttgtggctagtcatcaagaccgatgagggtagacagggctagacatcgcctgatgagcaaggcacgatactcccggattctaagagcccttaggtaggcttcccttgttgctccttacttcgatacgacatgtgagattttacacatgcactaatgaaatccgtgaggtcgtgcatctcaattgcgattgcatatgtaagctctagcgccctacagtggcccgaaggacatgttatcagatacctgcctgtatgaccaatcaaagctttaactgatggaacttaggcatttagcagccaaagtaggacctcttatcagtgaggataagaaggactactgctcattttgacgggaagcgtcccagtgtataagtgagcgtacccgctagagaagccacagtgttccggacagggcccgccccaatccgggcttgggggggtccaagagtaaggttaggcatttgatcccgaaaaggcaaagcttgcttattgaaaaaccaatagggacgggacctcactcggggatagttaatagttagcagacccgtacagacacccttccatgtgcatcgaaatccctcgcgtgtaaggaaacataacaaagatagggaccgtaaatccctcgtggtacaccttgtgtttaacctaagtaatcgctaagttgggagggcccaattaaagtcaccacttaaggcaagaggcgtgcccaatcactggaaccctaacgttaccacaaccaaaaggaaacccgtaaagaaattcggggtccattttaggtcgtttaactacctattctcacagtccatgacccttaaaattaagggcccccgtaccggttagaggtaaaagcgactgcccaagtttcttccccaattcccgaagaaagggcgcccaccttgggaaagaggttcttttctatcgcccaggggggctggcccatgtgccaatttctggtccatcacagttctgggcacccacgagggacacggtgttaaaccaatttccgcatcgagttntaacctcaaaatgtcacgtagggccgtgtaagttccaacaaggttacgaaagatctataaagagcccgcattggaaagtcagggggtggcacctatgtgtggacagcacagggtatatggctcctagaaatcacaaaccttcaaagtatgtggaaaaggttcgagccctatagggccaattaaaatgtcgtagttacatcagaagcgatattacataaagttatacagtggggctcctttttgagaccatctctcaagaactcgttattcaccggactcatagaaaacagcattttg

SEQ ID NO: 652760 - DNA, 361 bp, Homo sapiens
gttagctggctcagttctcaacaataaagtaatcagtacatatccccatatcccttttcagcttaaatctatttggtagtagaaaaagaaatgggaacatgaatatatatacatatttggcatcttaaaatagaatttgcaaaactagattagagaagaggatataatgtcaacaaaatgacggagaatggtgtatacgtaaaagcattggatcctgggaacaggaaaatcagagaatgggatgaatagaacaagattaccaacatgaagtagagtacaacaacaaaaatcactggattcgggggaatagtctgagacagggtttgccgaaggaagtaacgctagtctagattcttataca

SEQ ID NO: 652761 - DNA, 312 bp, Homo sapiens
  misc_feature (25)..(25): n is a, c, g, or t
  misc_feature (27)..(27): n is a, c, g, or t
  misc_feature (44)..(44): n is a, c, g, or t
  misc_feature (179)..(179): n is a, c, g, or t
atttgtaacactttggtcacatctntntctagatggtcattgantttttttaaagatggatgaaaggccaggcatggtggctcatgcctgtgatcccagcactttgggaggccgaggcaggtggatcacttgaggccaggagtttgaaaccagcctggccaacatggtgaaaacctgtntctactaaaaatacaaaaattagccgagcgtggtggtgcgtgcctgtagtcccagctacttaggaggctgaggcatgagaatcacttaaacctgagaggtggaggttgcagttgagccaagatcacggcactg

SEQ ID NO: 652762 - DNA, 885 bp, Homo sapiens
  misc_feature (696)..(696): n is a, c, g, or t
  misc_feature (885)..(885): n is a, c, g, or t
ggccccgggcttccgccgcagcgcgcagcattgggggtgccagaggagaccagcagcagcacttgatttagctgggctgcgggaatccgaccttgtacactttccagaagccttgatctctccaagtcccgcgcccaggggactcgagccccgggtttccatggtttgcccccggagcgctgccccctttcggtgctcttcggcccgggtcaccggcggcgaggcctccgggggtccctgttaaggcccggagcatggctgtgggcctgttgcccttcaggtttccaccccctgggaaggccctactgttgtgtggcagcgccggggggaaagggtgtgtggcattgttgaaccgggccgaaagaaccaacggttgcaggaaaggggggcgcctgttttgggcccccttcccattcctggctttgccggggagcgccctttaggctccttccgggatattggggcggaacaggcgggagtattgcttggggcaaggctcggcgccccctggtgggaaagcttcgcttcaccaaaagtaggcaaaacaaacacaataccactacattatacacgaagcaatcattgtgttgtggcggcaccctatcgcaccgacgaaaaatgcttagtacgaaccaccattccttggtgtggcgcgcgcggcgcccagaaggtgtaaatagggcagcgcggccacangctgtttccaccaaaggagcacctgcgggtcagtacacgagcgggtctgtgcttccacacccatagaaaaaccgccgggggccaacgcgaggttcttgttgaaaacaactccatagtggggttcgagggcacttagcggcatctacacagggtcccaggggcccgatgaaatccgcaccgcgtgtaggn

SEQ ID NO: 652763 - DNA, 467 bp, Homo sapiens
tagtctcgatcgttaggtgactggggctaatcatttaatgccttaggacatttttccttatgggtataatgaagaagtttagaagcttatttcaaagattcctcttggtggtgaagacttaagggcttcaaggaatagtgataaatctaaagtaattctgacaaaaaaaaattccagaaataaggaagactattacggccagcagggaaggcccaggtcccaaagctgggtcttcccggttttttttatggttttggttttttttggagacagagtcccgccccgtcacccaggcgggagtgcaggggtgtgatggctcacggcaaccttcacactctaagcccaaaggactcctcagcctctccagtagctaggactacagaggggtgccaccaggccggtgtgagtaattttttttaaagcaaattggtagataagtttcttactaattaaggatcgagaacata

SEQ ID NO: 652764 - DNA, 123 bp, Homo sapiens
cggacattcagactgagcgtgcctaccaaaagcagccgaccatctttcaaaacaagaaggagggtccttcttggagaaacttggcaagggaggaaggcttcccgcgggtactaaaaggaacaa

SEQ ID NO: 652765 - DNA, 587 bp, Homo sapiens
aaatgcggcacaggaatgtatgtaactagacggacgaggtgcagtgggcagagactccctagatgcttccatgcttatttccagtattatttgaagccaaggaggagtttgtatatgatgtgagtcatatgcccaggacactaattccaatccattctcttatcacctccctgaccagttcctaatcagaatctgcacctcatggaggttacaggaatccaaggtcatgataactgaggcttgtactgcatctggactcagaacagagcaaatgtgtgcctggtctaagtacttccgtaaaatacccagtgtcttggtgtccttctgcagcacagtctctgtcgtcttcggcataagtatcgagattatacacacatcactgataagggataaaaggcaccctggaaatccgtaaatcaaggactagcagtcacggcagtgcactgcattgagtctggtttggttgggtctgaaactgtacctgaaatggtttctttaagtatcttgctttctctatttctcgatgtttaataaaccgaagggacacggacatgtagagaaggctaaaataagaaatgctgtgtgag

SEQ ID NO: 652766 - DNA, 462 bp, Homo sapiens
cacctggtagtagtcgcacaccgaacaccagccacgtcatgcagtatggagacaaaacaatctcctagccatgtaatagtgatgcagtttcagggtatgaaacgctaggccagttctcccggtccctcctgatgtgcctctcaccatcatgataaggaaatcgtgatgaacaccaatgatctggtaggagtccaggctgctcacggagagagatccatcggcatctggtatgccaggcacctcattgagaagtcattgcgtgatatcgtctccttgttggcagcgctccgaggctgaggtgcagcagctcctgtccgagagagccccgctcacggggcacagctgctacccagatgccctgctgcacttccggacccactacttcaactgtgcactcccccacgtacgattatgcttttagacgtttgtacttgctggtcaaactttgttgagagccgtgtc

SEQ ID NO: 652767 - DNA, 139 bp, Homo sapiens
ctgccccgaatgatagaatcttagttcaacatataaatttacgaggggatttagagggttctgtgggccaatttaaatgttgaagtaagattctatcttgagacaagcaagctatcaccaggctcggttaggtatgtcg

SEQ ID NO: 652768 - DNA, 610 bp, Homo sapiens
ctcccaactcaacgcgggtgatggaaagggccagttaatcatgttacctggtctcatggaatggttctccctcccagactgaatttccttctttgctgaatacacaggaatgttctggataaccttcttcattagagaaagctatgagaagctttgagctcctcccagtaaactggttacttctctcaaacagggtggtcatgatgatgattaataataaattaagcaaaagaagggcaggtgcagtggctcatgcttgttatcccagcactttgggaaggcgatgcaggtcaatcacttgacgtccggaagttgaaaccaagctgaacaacatggtgaaaccccatgtctactaaaaatacacacacacacccacacacacacacccacacacacacccatccattctcttcacgttgtgacgcacgcctgtaatcccagctactccggacgctgaagccagagcacggcttgaaacccagaagtggaggtagacagaccccaaatcacaccacgaactcaacctgggggaccacgaggcgacatcattcaaacaacaccaactcaaccatccacgcatagtgtccgactctacctacattatcactac

SEQ ID NO: 652769 - DNA, 969 bp, Homo sapiens
tgtaaatgagaagacgtgtttttttccttcaccgatgctccatcctcgtatttctttttccttgtaaatgtaatcagatgccattttatatgtggacgtatttatactggccaaacatattttttctttgtccctttttttctttcctttctttttacttcctttatttctttattccttccttttcctttttttcttttttttttctttttttttttttttttttgggtagttgtggttacccacgccatttaacgtctccttcacgtgaggggctagtagttttaactttaaatttttaatatttaaatggtgtagactttggacactttaaaaaacaaaaaaagacaagagagaatggaaacacgttggataatttcctcaggtgtattttggtaaaaaaatttttaaagggggggtgttaattcggcggtgataaactcgcgtgtggggattcccgtgatcttataacaggggcggcgggttaatatctcacacagtttaaaaaatcagaccctaatttctccagtgtttacactttcaatcttgcaggcttctaaaagtgacagtatcccttaacctgccaccagtgtcaccctccggccccgtcttgtacagggggcggagaattacgcaaaactggtaggttttaaggaaaaacaaggttttaaacggaaattcttggtctgtccgaaggtttaaaaagtgggtgcattaccgaccagagggagtgtcgtgtctttatgctgtgtcaccccattctttgggtgctttttctttaagccaaaaggttgcgattaaccgctgtttatctaaggcgcttgagttcgcaacatgtagcggggctactctgtgttggacaaaaatcttgacggggcaaaaaagtgctcttggtgggataaaatgttgggcaataggtggttgataaaaggagattgctttggttatacacaatttgttttaggaggt

SEQ ID NO: 652770 - DNA, 383 bp, Homo sapiens
cggccaaatgtgttcccagaatttagaacatcattgcatccttgtgcacatggaaactcacacaatgtgacagtttctctttatctgctggcattcccaccctcatacactttatttatttatttatttgttttggagacagagtcttgctcttttgcctaggctggagtgcagtgctgtgatttcggctcactgtaacctctgtctcccagggtcaagtgattctcctgcctcaacctcgtgagtagctaggattacaggcacgccccaccatgcctggctaatttttgtatttttagtagagacagggtttctcccatgttggccaggctggtcttgaatttctggcctcgagtgatctgcccgccttggcccttatcgag

SEQ ID NO: 652771 - DNA, 485 bp, Homo sapiens
ggagcctgttcaggcaggatggctgaagcctaggggcaggctgcagtcagctggagtccgtggcttggaataagaacttacggtgctttctccaggcccactcatggcacccatggaccaatcagcacatacttcctcccttccgagcccataaaaaccctcggactcaggtagactcaggcagatgtcgggactaccagctgcaggaaggagatacccacttggggtctcctcaacttgtcaggacaacctgactatgggaagcacttacccactatgggtctcctctctgctgacagctggaaacccgtcaggatgacccgctgtggaagggagctacccacttctgatctcctaagagctcttctgtcacttaaatgaagcccctctccgccttgctcaccctctggttgtccacgtatctcattcttcctggatgcaggacaaaactcagcacccgctgaattgcgggactgaaaggggtg

SEQ ID NO: 652772 - DNA, 397 bp, Homo sapiens
ctttctggctaaagacggtgatcccccggtctctacttaaaattccaaaaaattagccggacatggttgcgggcgcctgtagtttcagctactcgggagactgaagcaggagaatggcgtgaacccgggaggcggagcttgcagtgagctgagatcgcgccactgcactccagcctgggcgacagagcgagctccgtctcaaaaaaaaaagaaaaagaaaaagaaaaaaaaaaaaccttgctacgactaagttcctgagggccaaggaaagccatttagatctttgggtttcatttgcttcacttaagcatctttatttttgcacttgaacgtctggcagagcattttgatgatgatgatgcacaaatactacgaataaatggatgcgtgactagct

SEQ ID NO: 652773 - DNA, 409 bp, Homo sapiens
ttgcagtgggatctgtctcaactcccattccgtttccagagccaaagtttggagggaacgtgagctcgggtcaggtcacatcaggtcagcctcatccaccacactacagtctccagacagttgttgcagtcacggagttgaaaccctaacttacagataagtcatctttaacaggaatctcgtgaaagatttttacatttccctctcagcccatcagcaatatttgctgccagcatcccactgtgggtcctaagttcaaaggttcttcatggttggttgtataggagttcttcctgtcccttgaaaccccactcttcaacctcctgagagctttcaaagttggaaaatatatcatgattttctttctgttcattggaaaaatatatccgataattttaatatacctggc

SEQ ID NO: 652774 - DNA, 1389 bp, Homo sapiens
  misc_feature (233)..(233): n is a, c, g, or t
atggcacatgcagcgcaagtaggtctacaaggacgctacttgcccctatcataaaaaagacttatcacctttcatgatcgacgcacatcataagtcattattcctatagttcgtgcttcctagttcctgatatgtcccttttacctaatcactcacaataaaaataatctaatagtaacatctcatacgctcattgaattacgcacacggcacgttctgaatctactctcggncaacccgaccagtacaattacctactgtccttcaatcggacactgctccgatcacactatcgcatttccttttagcttaaactaggactcgaaggtccaaccgactccacttcacccttatccagtcatagattcagagaagggccatccaattggtcactgaagaccaaactgcaggtatggtgacgcaagctactcgcgcactgaaacctaatgtgctgtacaaagctagcctattcaataaactttactgcgcgcaatgtaatgtctctaggaaagacaggcacgaacacttgtcgcaccctaccacttggaacgctttggacagaatacgtaggttacaatactttccgctggaatctagaaatggtctcaccgatatacggttcacttacaattacgtatatcggcttgcacacaaatgagcggtaattctggggcctatttgccaatttggatggcctgggtatcccgcaccaaggagttcaaggggggcctcttttaaagcgcacaaccgagtgtaatttgactccacatttgtgtcgcaccggaagacatccgatacgtaaaataacgcaataaatacccaagatttttacacagctcggggacgtagacaacctgtgaactcggtgggaggcgagataaattaccttaatgggctgcggtccaaatgagcatttcgttgggaacaatgtccttgttttgggcacaggacacaagtattcggcgaaccaagagtgtatctaggtaggacctcgactcttggttccgcataaagtaagaagtctatatattatcctcaccccgtatagggagaaggtacctttttttggaaaaagggtgacggggggtcccccgggaatattgttttttatcgcgcgcataaaataagggctaaatagcgccccgggattggtaacacccccggaggattctgtatgaaaagtccccatgagggggacaaactgagattacgttcaggcataaacttgagcacaaattaatattaccacaacggtgtaataggtgtgtgcgaggttcagccgttggatactgtaagcgttccatgttagtaagagaaagaccataggctcttgtgctgaggaaaaacaacacatttgtgttcattagtgagacgcattattgcgaaacc

SEQ ID NO: 652775 - DNA, 1147 bp, Homo sapiens
gggacctccccttttgggtcggtaggtgagcgccggcgccggtgtgcgagccgcggcagagtgaggcaggcaacccgaggtgcggagacgacctgcgagaggctgagccccgcatttctcccagggtttcttatcagccagccgccgcgtgtccccgggggagtaggaggctcggtgacaggccgctggctgtcatgtagtgtccttctgagtgtcagaggaacggccagaccccgcgggccggagcagacacgcggccagggcagaaacgcggctggcatggagaagcaggcagggtggccggaggacgtacgacctgatgacccgaggctgggagtgcggacctgcgagccggacatgtcgagtggtgagggttggacgtgggctcgcagagactgctaccatcgctggtagcaccgaagccagggggcatcgaagaccatcggacaatgagattcagaagaccgcatgacaccccgttcagtcatatcattaggatacaaaccatacgaacaatcaggagtatgcagcccaaaaatcagcaaatcactcatgccaaacaatacggtgtctaccttcaaagcgatttcatggcacgagcattcaatgacccattcattcacaaggaagcacggaaacacttgacagcttacgatataggtaccacatcgaaacactggtggcagctcaggaataacagcgtaaagaccacgggagacgagcaacacatattatagcggacgagccgggcaccataaggggccacaccgcgcacgacgacggacaggaagcgccgcgacgaacgcgagcgcacagagcgacctgagacgagaccatcacgcgaccacgactaccgacacgaagaacgggcacgcgacgtgacacaacgacgcacccccgcccacagcgcccgtcagcagcgacaaacactacatatcagaagacagacactaccatagcaccacactggagaacaaccccacacaccccctgaacccccaccacactacacgacccactcataacgcccgcaaaggcgcaacaacacacaaacattacccactcaactcataccaacatacagccacatcacacaacctcccaactgccaccacctacctttcgcccacctacacgcaaataatcc

SEQ ID NO: 652776 - DNA, 285 bp, Homo sapiens
atcgagccggtaccccgcggccaatggcatgtgaatgggagttgttcgatttggctctttcttgactgttgtggtgtatggaatgctagtgaattttgcacattgatgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccattgggccagcggg

SEQ ID NO: 652777 - DNA, 177 bp, Homo sapiens
ctgatcggccagatcaacttttcagggttacagatcgcgtaccaggtttgccgaccagtcctggatatgttcaatgccgtaacacagccatttttccagctccacattattcagacggcatgtgccgatcagcgagtacagcaccgccgcatgttcgccaccactgccggaacccgc

SEQ ID NO: 652778 - DNA, 432 bp, Homo sapiens
  misc_feature (27)..(27): n is a, c, g, or t
agcagctttattcccaattaacaaaanacatggaagtaaccagttatttccttcagtaggtgaatgtataaacagcaggtacatcccagacaatggaagattattcagtgctaaaaagaaatgagctatcaaacaatgaaaaaacatggagacaacttaaatgcatataaatatgtgaaagaagctaatctgaaaagactgcatactgtatggttctaactatatgacattctagaaaaggcaaaaacagacagtaaaaagatcagtggttactaggagttaatgaggagggagggattaactggtgaagcacagaggatttttaagtcagtgaaactactctgtccatactccagtggtggatacatgccactatacatttgttcaaatctgcagaatgtacatcaaaaataaatcctaatctcaactaaa

SEQ ID NO: 652779 - DNA, 111 bp, Homo sapiens
  misc_feature (69)..(69): n is a, c, g, or t
aacggacatgattcagcccctgttactcacaaatcctatttgagtcaaagtggaaaactattacgtttntgggaaaaaaatcaataggtatcaggaaaccaaaggctggtt

SEQ ID NO: 652780 - DNA, 165 bp, Homo sapiens
aactgctgccgatatattgaatctagaggatccgctccatgtggtgatgcgttgcgctaaatctaactttcttcccacaacactttctcgggctatccggaagtgacccgacgtgagtcgaaccagaccgatgcatacaccagatgaaacatcctatcatgtgta

SEQ ID NO: 652781 - DNA, 709 bp, Homo sapiens
gtcttcttggaaggcggtgctctgagaagccggatctacgcggcagcggctcttcaaagcggagccgcgaggtttctggctactatattttctggcaccagtgagtcgcatgctataatgatgagctgatagttcttggagaagatcgaatagaaactgctggatggatcaatagaagggcgttcgtgcgccaattatgcatggttgaaggtgtttgtctatgtgaatgatgctctgtgacgaaattcgactgttgtgaggaattaacggatagtgcctgtcgatggtggtggtgtaggtgggcttcctgccaggcatgaagcagattggcaatgtggcagccctcgcctggagttgttcatcgatctattgggcttcctgatgtccattcaggatatgggtctgctattggcgaacgtgtgcagcctttgatatgaattgatcgctgaagcagtagtatccccagggtggtgtcgggtatgacatcaactgtggtgtccgcttgcttagaaccgatttgggatcgacagtgatgtccagcctgtgacaggagcagacgttgcccaagctactgtttgaccatattcctgtagagctaggggtcatcatggtgtgcatcccatatgaatgccaaagacttggaggacgccttgggagatggggggttggactggtccttcagagacaggtatgcctgggctgaatgaca

SEQ ID NO: 652782 - DNA, 944 bp, Homo sapiens
  misc_feature (16)..(16): n is a, c, g, or t
  misc_feature (82)..(82): n is a, c, g, or t
  misc_feature (190)..(190): n is a, c, g, or t
  misc_feature (195)..(195): n is a, c, g, or t
  misc_feature (245)..(245): n is a, c, g, or t
  misc_feature (248)..(248): n is a, c, g, or t
  misc_feature (275)..(275): n is a, c, g, or t
  misc_feature (315)..(315): n is a, c, g, or t
  misc_feature (348)..(348): n is a, c, g, or t
  misc_feature (516)..(516): n is a, c, g, or t
  misc_feature (527)..(527): n is a, c, g, or t
  misc_feature (530)..(530): n is a, c, g, or t
  misc_feature (534)..(534): n is a, c, g, or t
  misc_feature (537)..(538): n is a, c, g, or t
  misc_feature (542)..(542): n is a, c, g, or t
  misc_feature (550)..(550): n is a, c, g, or t
  misc_feature (562)..(562): n is a, c, g, or t
  misc_feature (600)..(600): n is a, c, g, or t
  misc_feature (621)..(621): n is a, c, g, or t
  misc_feature (632)..(632): n is a, c, g, or t
  misc_feature (685)..(685): n is a, c, g, or t
  misc_feature (689)..(690): n is a, c, g, or t
  misc_feature (692)..(692): n is a, c, g, or t
  misc_feature (695)..(695): n is a, c, g, or t
  misc_feature (700)..(700): n is a, c, g, or t
  misc_feature (861)..(861): n is a, c, g, or t
  misc_feature (939)..(939): n is a, c, g, or t
attctttttggcacantagtcccgcgctaaacactggttcttgcctccccacccccattctctaaaataaacccagcaaacngggaggtgcatttgtgccgctgcaggcttctactgctcactccatgcagcacacttagaccaaggagaaacggctgctttccagctcaaagtcgactcattagaaganaaggngggagactgggggtgacacatcgctgatttgtccggggttgttatctgcngcnggcctttgcctcaaaggccaggggcanaggccttgccaggcactgtgttctggggccctggcctcangcatgtgctcagcgggttggccacgcggcccangaagtgcagggcagtggcgctttgatcatacacagcaaacaggaatgggcggttcagggtcacctccaagacctcaggcttgttaagctgttgggtagactctagtgggctctctctcatccgcttcaagcatcaaaaaaaaatgctgattacagcacctcccccaancctgaatgcgngtnaaangcnnaaanaaaaaaanggttcagctcgngtgtgcagatatggcggcgcagctccggcctggggcgngccggtcctgccgggtcctanagatccttgcngcaccagttgggggcatggtcaggtggatggtccggggagacagtttcttcanccannanagngagtnttgctggaaagtgagaccctccaccttgtccaggtcagaggcatagtgaggctggatcagcagcaggcaggcgctctcagtgaagggcacttgagtcaccgagaagttgtcctggatgtcactccagtgctggaaggtgcccatgccagagagcatggganagacactgaggtgctgttgtcacccagaactcctggggctcggcagcagggagaagccttcatcttccttggagtggncgtag

SEQ ID NO: 652783 - DNA, 128 bp, Homo sapiens
catcccccgctccagcttggcaatcttaagaactttaattgacagtttcaattgaaggtgctgtgtgtagactcgacacccagtgtaagcccaaccatcatgactaatccttgaatgttctcttaaga

SEQ ID NO: 652784 - DNA, 279 bp, Homo sapiens
tctggcggctgagcctcacctcctcccggtccatagaacagggcagggccgaccaggacagccccagtcctctcatcccaggccaacacatctcactcgctcccacttctggggacccacgagcaaactgcaccctgaactcagacatcaccagggcccagaggcccacacaccagccccagaccagaggctggcttttgttcacgcccgccctatgccaggccccatccgagcactgacccagcctggacaggagcccacagcggctccgaaactccc

SEQ ID NO: 652785 - DNA, 366 bp, Homo sapiens
tataacgaaaactgtacacggtcatatctgcttccgaaaatatacatagtgagatagtaatttacaggcaattaagaatttgctggccaggcgcggtgacttacacctgtaatcccagcactttggaaagccaaggtgggtggatcacctgaggtcaggagtttgagactggtctgaccaacatggtgaaaccctgtctctactaaaaatacaaaaattagccgggcacggtggtgcacgcctgtaatcccagctactcgggaggctgaggcaggagaatcgcttgaacctgggagggggaggttgcagtgagccgagatcgtaccattgcactccagcctgggggacagagtgagactccgtctc

SEQ ID NO: 652786 - DNA, 639 bp, Homo sapiens
cacatgcgctgagctcgcactgattttttacctgagtaggcctagaaataaacatgctagctttgtattccagttctaaccaaaataaataagaccctcgttccacagagagctgccatcaagctatttcctcacgcagagcaaccgcagtccataatccttctaatagctatcctcttcaacaatatactctccgtgacaatgaaccataaccagatactaccaattcaagtacttcatcgattaataatcatagatggctatagcaataagaactaggaatagcccctctttcacttctgagtcccagaggttacccaaggcacccctctgacatccggtcctgcttcttctcacatgacaaaaactagcccccatctcaatcatataccaaatctctccctcatctaaaacggtaaggccttctcgctcactcgtctcaatcttatccatcatagcagggcagttgaggtggattaaaccaaaccctagctacgtcataaattcttagcatactccatcaatttacccacagtaggcatggagtaagtagcaagttctaccggtacaacccgtaacataaccattcgttaattgaactatcttatattatcctaactactaccggattcctactac

SEQ ID NO: 652787 - DNA, 452 bp, Homo sapiens
  misc_feature (105)..(105): n is a, c, g, or t
  misc_feature (108)..(108): n is a, c, g, or t
  misc_feature (239)..(239): n is a, c, g, or t
ggggggcttctcccgctccgcatcctttgtggttggggttttgtatcactccccatgtgggggataatgaaagctttttatgtaggggtttccaccctcatcagnggngggttttttcccgggcccttgacacagcaaaacaccagttgtgattttttgccacccataaagtttgcaaattttgaggggttttaccaggaatgagtgactgctcaaaggccgggttttttttcaagaanggtgggatcaaactccccccttgggattatggtttaaaaaaagggggttgggtaggcaagcactccttggttgggtcctttggttttttcatttactggtaggatcccgcaccagccaatttagggattgtgttgtttttgggttggttcccatgtaaaaaaacagcaaaaaaatgggatggttcaaaagctcgcccggccccctcaacccta

SEQ ID NO: 652788 - DNA, 149 bp, Homo sapiens
ccgtagctgctgtagccgccccgctgagctctcacgggagtacaaactagtgctgctgggtgctggtggtgaccggaagaatgccatgaccatgcagttcatcagccaccgaatcccagaagatcatgatcccaccattgaagatgctt

SEQ ID NO: 652789 - DNA, 427 bp, Homo sapiens
  misc_feature (40)..(40): n is a, c, g, or t
ctgtgatgtctgctgcccagtacgtgtacgcgctcaaggntgtcgcaggcctggaagacctctgcctgagcgggttcatggagcattgacatccctgccacccagcgggccactctggtatcctgtgcgacgtcttcatcggccgctactacactgtgtttgaccgtgacaaccacagggtgggcttcgccgacgctgtccgcctctagttcccaatgctgtactgtgctgccagcacagaatacagaggagagtcccagatgcaggaggcccctggcccaagctggaccctcccagacatcacccacatcactccgcccgcgccacttgtcctaggagctgccctggagagcacggctggtccaatgcctcagacttgcttgtttttgttcttgctggtctttccccctcccctgtggttcatgaa

SEQ ID NO: 652790 - DNA, 327 bp, Homo sapiens
ggggtgggggccccccgggccttttaagacccccccagccttttgggtcccctttgggccctcaacaagacctgaacaggttttgcccacctgggcctttccctacatcattatcatttcatggccccctggccccccccagcagaggttttcagtggggccagtttttttctcccctttttgctgcctttggccccgcctgggcccgcctgcccccctgtggggggggaatggtctgcagggtttggggcagggtttggtcctttttggggcccgccctttttcagctttttggtatttaaataattaacccccctgttttgtgga

SEQ ID NO: 652791 - DNA, 109 bp, Homo sapiens
tagtgctggttgaggaagagtcagctaaaagatgtgagactgaatagaatccatgactgggtgagaaggcttccttggcgataacactggatgatgacgtcatctgctc

SEQ ID NO: 652792 - DNA, 141 bp, Homo sapiens
  misc_feature (23)..(23): n is a, c, g, or t
  misc_feature (29)..(29): n is a, c, g, or t
  misc_feature (95)..(96): n is a, c, g, or t
tcggtaccggtgactagtatgtngagtcngtgagtaggagagtgatattgatcaggagaatgtggttactaccaactgaccagttttcctgtgtnnttgctggtttggggatctctcagaatgttttattctctattagct

SEQ ID NO: 652793 - DNA, 332 bp, Homo sapiens
atgaggtggtaccccgcggccaatggcagcagacacctgggtcttagcataaacggcgtagtaagctttgagcttccagtgtatatatttattcttttgtgggtttagtttgtttcttcttgtagaactgtacagaaactttttaaaagaaattggattcgaaactggatgtgtattcgtaacctcataattttgatttgtgtatagtttcttttataatgtcagtgtaaatttttacattatttggcatgtatatatcttcgtacagagaccttacatgtatagacagtatgatgtgatgtaaatatcttattttgccatagggccagcgt

SEQ ID NO: 652794 - DNA, 174 bp, Homo sapiens
gcgaattcactagtgattagagactgcgagaaggaggttcgagcctggggatacgctctcctcgttctgcacctcggccaccatgcttcaacaaaagagcctcttcacaacaataacctgcccccgcgcctgccccggctccttctcgcagtctctaatcgaattcccgcggac

SEQ ID NO: 652795 - DNA, 114 bp, Homo sapiens
  misc_feature (13)..(13): n is a, c, g, or t
  misc_feature (21)..(21): n is a, c, g, or t
  misc_feature (40)..(40): n is a, c, g, or t
  misc_feature (70)..(70): n is a, c, g, or t
  misc_feature (73)..(73): n is a, c, g, or t
  misc_feature (78)..(78): n is a, c, g, or t
  misc_feature (98)..(98): n is a, c, g, or t
  misc_feature (100)..(100): n is a, c, g, or t
  misc_feature (102)..(103): n is a, c, g, or t
  misc_feature (106)..(106): n is a, c, g, or t
caaagccctgtancttccccnaatgccaaggcccatctgntccggcgtaaggacgacaccgtcagctgtnccnactcncacacatttaataaactgancncnncantgccaaaa

SEQ ID NO: 652796 - DNA, 232 bp, Homo sapiens
tgtgcagaatccggcgtaatagatcactgaatgatatgtggattaatacaaaaccaagcctattgtatcagaattctttgggcgttatcagtagcacccactaaatctgcaaggaccggagcttaacagctcctgtcctcagccgtgccgcctgattctatccctccaccacatgcccacctgctccaagcccagatcccagtccaccaacgccaacacaccgcacgcagca

SEQ ID NO: 652797 - DNA, 621 bp, Homo sapiens
aggagatctgtcagtgatcatttacgcatggatgaggattcatatagtatttctcaatgagagaatctcgtaggacacatgattcgactatacgagattgtacagctgttgtcggccacggggtcaggctacatacctctaatcagtctcttagaactagtagcatctgggttcctccacagtgctacttcattcagaatctctgcacttggtaccgtggatcatgtgtcatatacaggctcgccaggtaagagctgtcacccagcaagagttcactgctgatgagtctatggtatggagttcgagacactatgtcctcagacacgtgtaagggtcctctctatagttcagtcttgaagttctggctgtacatacgtgaggtagatctgctgacataacatgttcactacagccatcaggatgaagacgttccctgactcagcctccacatgttgactgatgagttctgcattgacagtgtgacagttgattcatgcgatgagcacggatccccatgagaatgccatgaggacacttgcagatctacggagagatgattttatacatgattttagatagaaagccccagacagcttctgcggcatatcggcttcaatgcaa

SEQ ID NO: 652798 - DNA, 654 bp, Homo sapiens
tgaaaatattctgggtctctttttgagttctgtaaactagtcaagaattgtaagacgtcaacctgtaagtcccataacttttctgcgctcattaaatttaagaaattcagatattttcttttaaatttttgagtcttatcgtttaccccgttcccaaatccttctgtagtattttttttgctgatagcatttgagccacccataatagttattggattccaattagcaagcgatagggaatttgaattatcgttaatgaactgatctataccgttgattgctagttgtaaagttgaaatgctttcatccgaagtaaattttggagacccaaatggaacggacgagtcgatttctttggtggcattatctctgatcacataagcgaaggattccacgttatcgcaattttgagagtttaaaatctcattgtttagacattccatactctgacacaattggaaactcaagtcctttagatagtccctttcacaaatcttgttgaagtccggatcacagacaattacaattaaaaaatcatcaaagtaccaaaataggcagttataaaaatcctccttgtctttggagttttcaaaattcaaattcagtttcagggcttggtatgatgatggcaacaggtctgaattcaatggggat

SEQ ID NO: 652799 - DNA, 748 bp, Homo sapiens
gtacctgtcgaggccgatatcaagtgcacgccccgccctggaacctcaggggcccgcgttaggatctgaaccaatgatgctgggttcacccacatctccaaagccaggagttaatgcccagttcttacctggatttttaatgggggaatttggcagctccggtgtaatcctcaaaaactctatacacaatagtgggccttccatcaagtgagtagatggtagatgatatcatcttcatcttagcctatggctgggtgggtaacaaacacaatcgagattgatactcagtctcagtaaagatagaagtggcgctccaccagttagaagtatatatgatgacatttctagcccaggactgtggatcaacaccctttaacttcaagaagacagccaaacatttacagtaatgcagagtcctctgtgggagttacatctactcctggaacagggcaaagtaatgttaagtccagcaagtatcggtcagccacgaaagacgacattatctcctgcccagtgtggatccttcattatactcaaggagattctttgacttcagaagatcacctcgatgactcttgggtgactgtattcggggtttcctcaagcatctgcttcctacatattactacaatttgcaccagatggggaatatcttacaacatgtgatgtctaataccaggaacatggcatgcctattcggttatacaatatcaaacgtggggctcggaaagccttagccaagcttgga

SEQ ID NO: 652800 - DNA, 148 bp, Homo sapiens
atatgtaacaactatagctactatgagaaaatgtatctcacctatagcctaacatgattcattttttttttcccgggaaacagaaaatgtctttggtctggtattaattatcataagaattgaatttaacttactgatcgcacccaag

SEQ ID NO: 652801 - DNA, 146 bp, Homo sapiens
  misc_feature (71)..(71): n is a, c, g, or t
cgagtcgtccgcagcactggaattacaacttaggatgtagtcaccatctgtggcagtgcccagttgtctgntagatgccacgcgatccagctctcgatagcattatctgctccttgtcaatgacgagactgctatgtctaggggca

SEQ ID NO: 652802 - DNA, 216 bp, Homo sapiens
  misc_feature (108)..(108): n is a, c, g, or t
  misc_feature (166)..(167): n is a, c, g, or t
  misc_feature (216)..(216): n is a, c, g, or t
ggatattgtcattagggctggatagattacttcatttaacagtctttgtaacaccctgcttgattcagggcataaacggatattagatccaaatcagtatattcatcntcgtgacactcctcttgtcatcttgtatgctttgtaccatggacagggcatggatctnnccttctctgcacattgtggacagatgtggtctgtaattgagggtttcgn

SEQ ID NO: 652803 - DNA, 210 bp, Homo sapiens
agttttccaaaaggggtgaaagggttgcaggtcccgaccactgacccttcccgggtgccctccctccccagcttacccctcaagcccagcacccagtgccccttgaacaaagggaggggaggacccatggctttcccccctagcccgggagaccaggggccttccttttcctctgcttttatttaataaaaactaaaaccagaaccggga

SEQ ID NO: 652804 - DNA, 175 bp, Homo sapiens
ggtcgctgccggtggggttctaccccagctcgtggaggacgacaatccctgcgtctgggttcgtcgacggcgtgtcgccgccacgcttctccaccggctatttcccgctgcgcaaccgcatcggcatcctggtggagacccactctgtggcgcaccgtacccctgaccactgtgc

SEQ ID NO: 652805 - DNA, 836 bp, Homo sapiens
  misc_feature (5)..(5): n is a, c, g, or t
tatanagaatattacggctaggtacgaggctgggttgcggctaatcccagtcggtgccgcatccccagcccgccgcatggccgcctacaaactggtgcttgatccggcacggttgagagcgcatgtggaacctgggagaaccgcttcagcgtgtggtacgactgccgacctgagcccggcgggccacgaggtaggcgaagcgcggtcggggcaggcgctacgagatgcttggctatgatgtttgactagtcctgtcttcacctcatggtgctagaaggagatgcgagtccggaccctcctgtgacaggtgctaggatgccattgatcagatgtggtctgccagtgtgtgagtgaccttggccgccttctaatgagtcgagcactatggggtgtctaatccggtctcaataatggcatgaaactggtctgcaatcgctttggttgaggcccatgtgtgaggattcgtggagtgcgctccttatgtatgtccccagccactctccgattgggacgccggaccaatcctttcttacagcgagaccatcagtaccgggctcggcagggttttgcagaccctcagcagaaagattcagtacccttccttgtgaagagtcttgaaggggatacctatttgcccaggaagcttcttgccccgtctctgggagttgacggcaagttaggttcccccagaatccagggggggggaccgcgtgttcttggttggcggccgttgggcagcggcgctccggggcgcttggccccgcccttggggggctctccctgaggggcggctccagggggcctggactgcgggtgggttcccctgtccttggtgg

SEQ ID NO: 652806 - DNA, 499 bp, Homo sapiens
cctaatacactaattctctgatgcacctgtataggactacacctaattcacttcactgtattagcacttcacctcctcctatcacctcactgtattagtgaccctagactgctgctggcaatacgcgcggccacagccgttgggagacacctgtggctccactcccctcctccagggcatctgtcaccaatctctgcagaccagcaccctcccacgggcgcaggaccagcctgtcccaaacctttggctgccatcaagggctgaacacgcactccccagaaaagaggccatggagcacatagggaggccgtctccatccctctctgtcctctgtgtacctgagataggtgtgagtcacaccctgcaggctcccccttccttgagaactcacgaacagggggatcccagccacgggtcacgctgtggggttttaacccggaaagaacaagacaccacacacctgcctcacttccccaggatgcgtcctaggtcgtccata

SEQ ID NO: 652807 - DNA, 279 bp, Homo sapiens
  misc_feature (42)..(42): n is a, c, g, or t
  misc_feature (147)..(147): n is a, c, g, or t
tcaggcctcccgcaatgaccaggccgacgataggggaaacantcagcgaggagaaaattttggtcacttcacgcaggtttaacgcatccatcaccgatgagccggttaacagcgcgttggttaaaccgatgccgataatcgcaccantcaaggtgtgcgaactggaggccggtaaaccgaagaaccacgttcccaggttccagataatcgccgccagcagcatggaaaagaccatcgccaggccgtgggttgaccccatattcagcaacaaattcggtt

SEQ ID NO: 652808 - DNA, 115 bp, Homo sapiens
ttcgattggcgggcaccttatggctttatgaccagtgaaaagcgtgggggcggcagtgatgacttgcccatggctttatgaccagtgaaaagcgctaagttgcccgccaatcgaa

SEQ ID NO: 652809 - DNA, 706 bp, Homo sapiens
gagaggagtctcgctctgtcgcccaggcttgagtgcagtggcgcgatctcggctcactgcaaggctctgtctcctggggttgccattctcctggcttcagcctcccgagtagtcccaggagtagctgggactacgggtgcccaccaccacacccagctaattttttgtatttttagtagagatggggtttcaccatgttatccaggatggtttgatctcctgacctcgtgatccgcccgcctggctcccaaaagtgctgggattataggcgtgagccaccgcccgggcaaattttgtatttttagtagagatggggtttcaccgtgtgtggccaggatggtctcaatctgaccttgtgatctgcccacctcggcctcccaaagtgctaggattactggcgtgagccaccactcctagccttaatgcatattcttaaatatacaaaggtagattgttatgaaaatggctttggggctctaataacctaccttttaagaatgagaaacttgctgggcttaaggggagttcagtatgaatcaagatgtgaaccattcaaatgtgggctgtgatttctgatatatcatagatggggatccttctgagaatactggcattagggaattaggacaaccaagccaattcaggtgtgaaactttattctggtactttctttcttgcgggaatttatggggcggtttagaagggt

SEQ ID NO: 652810 - DNA, 507 bp, Homo sapiens
  misc_feature (389)..(389): n is a, c, g, or t
  misc_feature (476)..(476): n is a, c, g, or t
gtagccatttttctgcagtcggaattaaatggccaggtgggtttttcctttgttgcaaatggggaatgtttctcgtttgactctaccatccagttcaggacgtctcagtgtgtgtaacatttgtgaacaggcccaaggactcacatctggaggactggagatttttttttgagaagatctggacttgcgccttatgacttggaagccatgtgcaggattgaataactgagggcccagaacacaatgtatggcagcagttaacagcttttgcttccaaaaggacctaagtaaatgtcagatcattttgggtgtttctgttttatgggatttccatatcgtccaagcccatgcgaagctaagatttggctacaaacaaccccggtttattnacgttataaataaaaagagatttggctaattaagaaattttaataaattattccacaatatatattttaagatctagagattaaatnacacaaaaagtaaagatttaatttatatcca

SEQ ID NO: 652811 - DNA, 363 bp, Homo sapiens
  misc_feature (107)..(107): n is a, c, g, or t
  misc_feature (163)..(163): n is a, c, g, or t
agcggctctctctcctcttctctctctctctctctctctctctctctctctctctctctctgtgtgtctctccttttcccctccccaacccccggtagaggcgcgantgctacccgggaagggggctcactccgagttgcgaggggaggtaattactcaaaanaagaggccgccgttaggaagtataaatagtgggacttcaagcgcagcgtcgctatcagatctgaactctccgcaggaagaattgtcaaagatcttaacattgaacaagcgcgctccggcagggaagcatcagttcccatttccctccggcagcccccgccccttctcttctcctcctcctcctccctctcctcccgcacc

SEQ ID NO: 652812 - DNA, 331 bp, Homo sapiens
  misc_feature (292)..(292): n is a, c, g, or t
aggcgactcttaggatcccagtccaaggcaggaggatcgcttgaggccaggagttcaagaccagcctaggcaacgtagcaagactccatctctgttttattctgtgtgtgtgagactccatctctaaaaaaaaagaaagaaagaaaaaactaggtctgtactgtctaatgtggtagcctctagtcctagtcatatgtggctattaaataaaatggaaatttttgttctctagtcacattggctatatatcaagttcttggttagctactatattggacagcacagacatatnatatattcatcccacagaagattctgttgatagctgtgt

SEQ ID NO: 652813 - DNA, 716 bp, Homo sapiens
atatcccaccataaaatctctttacctccaccattatagtccttgaaaacatgcctggcttttaactaaaacttataagaagttccatgagaaggctaaaacaaccaacacactcctaagagacaaagaaattatcagaagcagactcaaacatgacacacattttcaaaatgtcatggaaaatttgaaaacacccaggaaaaaagaaaaaaaaattacatttgggagaaaacagtaagaattactgcagatttgacatcagaaaccatgtcagccagaagatatattaagtttcatgttttaagttttttttccaaagaaaaaaaagataacacccatgtttatagcagtgcaatttgcaaatgaaaaactatggaaccagcccaaatgtccagcaatcaataagtggataccatgcaatactactcagccataaaaaggaatgaaataatggcatttgcagcaacctggatggaattggagaccattatgctatgtgaagtaactcgggaatggaaaaccaaacatcatatgttttcacttataagtaggagcaaagctatgagggtgcaaagacataagaaagatacaatggactttgggtactctgggaaaaagggtggtgggagtgaaagggataaatgactatgcattggtttacaatgtacactgcttgggtgatgggtgcaccaaaatcttagatagtaccgtataat

SEQ ID NO: 652814 - DNA, 187 bp, Homo sapiens
catccgtctatcgtggcacatcactattatgccttcgaaggaaaattcagatctaacaatttcgggctgcgcacaatggctcatgcttatgattcgagccgtttgggaggctgaggcaggtggatcgcctgagtccaggacttcaagaccagcctgggcaacatagggcgacctcatcatctagtac

SEQ ID NO: 652815 - DNA, 733 bp, Homo sapiens
gccactgaaatccttgtgtcgccatggccccccccccgcccgttgttaccggtattgtaaggacaaccgtacccccagtctcgctttcttccgaggtgtccctgatcccccgattcgcacttttgacctcgggcgggaaaagggccaaagtggatgagtttcccctttgtggccacatggtgtcagatgatatgagcactgtcctctgaagcccttggaggctgcccgaatttgtgcccataagtacatggtaaaaagttgtggccaagatggcttccatatccgggtgcggctccaccccttccacgtcatccgcatcaaccagatgttgtcctgtgctggggctgacccggctcccaacaggcatgcgaggtgcctttggaaagccccagggcactgtggccagggttcaccattggcccagttatcatgtccatccgcacccagctgccagaccaggagcatgtgattgaggccctgcgcagggcccagttcaagtttcctggccgcccagagagatccaaatctccaagaagtggggcttcacaccagttccatgctgatgaatttgaagacactggtggctgaaaaacggctcatccccgatggctgtggggtcaagtacatcccccatcgtggccctctggacacaatggcgggccctgcactcatgagggcttcccatgtgctgcccccctcttaatactcacccataattttacttcctgtccca

SEQ ID NO: 652816 - DNA, 346 bp, Homo sapiens
  misc_feature (24)..(24): n is a, c, g, or t
  misc_feature (142)..(142): n is a, c, g, or t
  misc_feature (232)..(232): n is a, c, g, or t
  misc_feature (331)..(331): n is a, c, g, or t
  misc_feature (338)..(339): n is a, c, g, or t
accactctgtctgatgaaaccctnatggcctggctcctgactcccattcaaatctcatctcatgctgccttctttctcttccttccaccttcaaactgcttccccttcaagtctctgcctcaaatgttaggtcctcagagangcctccctgatcactctgtctaaagtcaaaatgcgacagaacctgatggctcacgcctgtaatcccagcactttgcaaggctgaggtggncggatcacaaggtcaggagatggagaccatcctggctaacatggtgaaaccccatctgtaactaaaaaaaataattggctgggtgtggtgacatgtgcnaggggtnncgagctc

SEQ ID NO: 652817 - DNA, 128 bp, Homo sapiens
  misc_feature (25)..(25): n is a, c, g, or t
  misc_feature (47)..(47): n is a, c, g, or t
ctgcgcaggagccgcaggcggtacngccatggcgcccagcggaatgnatggtcttgaagcccacttcacaaggactggcagcggcggtggcacgtggttcaaccagccggcccgtaagatccgcagac

SEQ ID NO: 652818 - DNA, 216 bp, Homo sapiens
agagggtggtttatccagaaaccaagaaaaaaaatcaatcagaataaactcaaaaaaaaaaggtggggggagcaaaaccatcaaccaccaggcagccaggccataagcccacctccacctttggggggccccaagagccccacccccgccccagccccgggggggcttaaccaggggccccggccggggaatcgcctttgctttctttttaagacc

SEQ ID NO: 652819 - DNA, 419 bp, Homo sapiens
agcggacatatgctactgtccattacaggacaatgccaaaaagtgagacatatcaactatcagtagaaatttaacttagctagacggtaccttatgcacatctattacactaaaagaaacgattgttaaccccttccagttgtttaaaagacagtactcctttacagggagtctcgtcaggcacctataataggctacataaaagatacagtataaactgcataagtcttaacgagtagcaaaaacactgatgcacttataaaaagtcgagaaaatctataagaatattagcctgaaatggcaaatctccaaacaccgatctgtgtcaaaatgtttaaatattgatggttactccaaaaatcattacttgtcctatttgttatctatttggaaccgtttataaaggcaaagaaacacct

SEQ ID NO: 652820 - DNA, 1110 bp, Homo sapiens
agcggagcagggttatgggagggctctggtgttctggatggaggatgcgtcccttgtctgtggcgtggggcgtggatccaccctggtgttctccaatcaggcctgcagagagggtagagccgggtcataagaccagaggtgcaaggtgggagcagagagggagccagagaaagagactggaggtggcattgcgcgacgagtggaacgcagcctagcgagggcatacgcagaccctggcagtccgagcactggctgcacggtagtgcgtaggaactaaggaagctccgaacgcgctaatgcacagctgcgccgcgggacggaaggacgctggcgtctggcagacacgaagaccgatgccatcacctgtagcggtggtccgggtgctcgtatcggtgggacaatgcttgcggggcgtactacgttcctgccgtagcccccatgtaatcgggtgctcgtagatatgccagcagtaacctggaagcgtgtgggatgttgattcaggacagggttgcaagaggtcagtggcgctacagtaacgaaagcatggaatagatcgatggagtgacaccttgattgacatgaattccggctagtctaatctaggacctttaggcgttttaaactgacagaattatgtgccatgtcaccgtgtcttcccgagggtggaacctggttatgcacgcttcaaggcgaataacacgataatactattgatgggaagccacgggaggaagaagcttgtcccctagggcagtatttgtaatccaggagacataaacggataataccgttagctgggtcgacacaatcgcaggtcacaattgggagatttatcataacaattaccggatgaattgctccccactatttgaacacacctgcgaactacgagaatctacccatcataccattaacaaagaggcctatctggtggataggacacgaacctcgaaagtgttaaatccccacaaagaagtgaaggtacaaatatgtgcccaaggaatccttataacgatttggactccttggacattctgctgggtagatcccgagccagcttgacggttgctaccatcacatgtggaatacacctttcttgggactccacag

SEQ ID NO: 652821 - DNA, 298 bp, Homo sapiens
tttttttttaagaatcagggtcttgctctgtgtcactcaggctggagcacagtggcatgatcatagctcactgaagccacaaactcctaggctcaagtgatcctttcgcctcaggctcccaagtagctgggaccacaggtgtgtgcaaccatgctcatttaaaaaaaagaaaaaacaagaaaaaacaaaaatggagataggggtctcacatctaccaatgaggagatgtgttgcccacgctgatctcgacttcctgggctcaaatgatcctcccacctcagcctcccaaagcactggg

SEQ ID NO: 652822 - DNA, 599 bp, Homo sapiens
cgatccgaggattccgattgcattgtcttcctcgattttatttttcttcctcatgtagcccaccatctaccagcttatatctaatgcatttacagccacctgatgctaatacaatatgcataataatctccatgagtctatccttcttagcattatcagcactgcatttttcgatttctactcattttcataaaatggacaaccttttaaaaaatgtgctcgttaggggccgggcgcggtggctcacgcctgtaatcccagcactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacgcacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatg

SEQ ID NO: 652823 - DNA, 876 bp, Homo sapiens
  misc_feature (31)..(31): n is a, c, g, or t
  misc_feature (37)..(37): n is a, c, g, or t
gatgtatccccttcgacggtgtctggacatngtcctnccactgaggtccacctaccctatggtcagcaccattgatgcttcagaaccagccaagatttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatgtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgagcccacccagactgagggtgggtctgcctctcccagtctactgactcacatgttaatatcctttgg

SEQ ID NO: 652824 - DNA, 939 bp, Homo sapiens
ttgaatttcaagtacacgggcctggcgttttacgttcacatatagcattaggtcccctcggtcgacaaagacccacttctggggcaaggaggacgcggcgcgcgaattatcgcgctatcagctatctgctagcagccccgagcctgaggcggaagccgaggctgcggcgggtccgggaccctagcgagcggtagctgagccgggtggccagccctagtaaccccgcgactgacggcctagggcggctataccagagcgcaactaatacgcgatagaggacggggactatgggtaagcctatataaccagatagacgaggaattgacaataggacatagtacctaacgtagaaggatagacatactataccgaatactaacatataagagagacaaacaagagtagccggtcgggaccaccagcacccaccggtagtagctacaggaggaaggccgcccccggacgaaacataggtagacaaccgccaaataagtagatactcagcaggataaggctagcaatagggagcctagtagggttaaggaaaccccggactaacaaggtaagcaaggtcgtactcaggccgcgaggaactaacagaactatgttgtcaagcggtactagccgaaggggaaaagggggctatagcacaccgggggggccaacaccgaaggtcttcagcatatcctcgcagggtctcctttacgaggacaaccctagtatagaaggggctatctacggcaccaggccaggctagagctcccgggaaagggttgaaaacgacagggaacacttaacggggtagggcccagggatagggcaaaattgtggtcccaccagggacaacttgggagtctcacgtctctcatacgttagcagcgcgaagggtcggcccctgggtccccaacggcaagaatcaagcttcctggtcccatccga

SEQ ID NO: 652825 - DNA, 489 bp, Homo sapiens
  misc_feature (51)..(51): n is a, c, g, or t
  misc_feature (124)..(124): n is a, c, g, or t
  misc_feature (316)..(316): n is a, c, g, or t
  misc_feature (321)..(321): n is a, c, g, or t
  misc_feature (340)..(340): n is a, c, g, or t
  misc_feature (345)..(345): n is a, c, g, or t
  misc_feature (410)..(413): n is a, c, g, or t
  misc_feature (481)..(481): n is a, c, g, or t
gctgaacatgctcaacatctcccccttctcctttgggctggtcatccaagnaggtgttcgacaatggaagcatctacaaccctgaagtgcttgatatcacagaggaaactctgcattctcgctncctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaagccttcttgctgatccatctcctttgtgctgctgccccnttctntgccaccacagctgctccnttctntgcagcccagctaaggttgaagccaagaagagtcggaggagtcggacgaggatatgggatttggnnnntttgactaatcaccaaaaagcaaccaacttagccagttttatttgcaaaacaaggaaataaaggcttnttgcttta

SEQ ID NO: 652826 - DNA, 355 bp, Homo sapiens
gaaacgatactgatacatttttatattaatactataatacatagtttgcattagggttcatactttgtggtgtacattctgcgggttttgacgaaggtatggtggcatatattcattgttactgtatcatgtagaatagttttagtgccctaaaaatcccctttgcgtcacctctttcattttcccctctccctgaacaccaggcaatcactaatctttttctgtgtccacatttttgccttttccagaatgtcatgtagttagaatcatctagtgtgcggtcttttcagagtggcttctttcacttagtaatatccttttaagattcctcaagtctttccatggcttgatagct

SEQ ID NO: 652827 - DNA, 137 bp, Homo sapiens
cccccatgaaatcactgagaactattagaaaccagtaagagaattcgatattggtgtatacggacttactgaggtaagaaagattaaaattctacaaaagaacatgaagcaagacttgatgttaattcagacataac

SEQ ID NO: 652828 - DNA, 205 bp, Homo sapiens
gggtctaaggcttgctactgacatctgatacgcatctgagagagaccttcagatgccaacaggagaagtgctttcaagaagtcaggtcatattaaccccgaaaaattcacactggtgaaacaggccatgtgtgttatggatgtgggaagggcctcagttaaccgtctaagctggggaaacacccagaagggttcaccactatata

SEQ ID NO: 652829 - DNA, 511 bp, Homo sapiens
  misc_feature (1)..(1): n is a, c, g, or t
  misc_feature (215)..(215): n is a, c, g, or t
  misc_feature (274)..(274): n is a, c, g, or t
  misc_feature (280)..(280): n is a, c, g, or t
  misc_feature (292)..(292): n is a, c, g, or t
  misc_feature (344)..(344): n is a, c, g, or t
  misc_feature (359)..(359): n is a, c, g, or t
  misc_feature (373)..(373): n is a, c, g, or t
  misc_feature (407)..(407): n is a, c, g, or t
  misc_feature (422)..(422): n is a, c, g, or t
  misc_feature (424)..(424): n is a, c, g, or t
  misc_feature (428)..(428): n is a, c, g, or t
  misc_feature (444)..(444): n is a, c, g, or t
  misc_feature (508)..(508): n is a, c, g, or t
ncccactgaaacgctgctgctctcaaacagccagagtgaaatatgatcgtcagtatcgacttcttttaagtgcgcttcacattcacattggtgtatgtgcatgtccttggtctgctgaaaatctggcccttttagtgcacaggggcgacataacgtcccctgaccagcagttccagaatgtcccattttcatatattggcatccatgcacacctnctaaaaatgaggtacagcagggcaaacacttttccaaaatagatgtaatatatataatntatacncattcgtacatncatacctttattcatgtgatgtccaaaaatttaaaaaaaatggacacatttnttacaaaatcgtaanaaagactggacagngttttgctcattctggaaagatgaagctcagtcntaacacaaccctggnanaccntccagagattgtggcnatatctttgcttctaaacagtcagatattcttgcattaagcttggcgaaactgcctttcaaaancag

SEQ ID NO: 652830 - DNA, 903 bp, Homo sapiens
  misc_feature (208)..(208): n is a, c, g, or t
  misc_feature (258)..(258): n is a, c, g, or t
  misc_feature (340)..(340): n is a, c, g, or t
  misc_feature (355)..(355): n is a, c, g, or t
  misc_feature (423)..(423): n is a, c, g, or t
  misc_feature (433)..(433): n is a, c, g, or t
  misc_feature (440)..(440): n is a, c, g, or t
  misc_feature (442)..(442): n is a, c, g, or t
  misc_feature (448)..(448): n is a, c, g, or t
  misc_feature (450)..(450): n is a, c, g, or t
  misc_feature (452)..(453): n is a, c, g, or t
  misc_feature (467)..(467): n is a, c, g, or t
  misc_feature (478)..(479): n is a, c, g, or t
  misc_feature (487)..(487): n is a, c, g, or t
  misc_feature (492)..(492): n is a, c, g, or t
  misc_feature (496)..(496): n is a, c, g, or t
  misc_feature (501)..(502): n is a, c, g, or t
  misc_feature (510)..(510): n is a, c, g, or t
  misc_feature (514)..(514): n is a, c, g, or t
  misc_feature (517)..(517): n is a, c, g, or t
  misc_feature (537)..(539): n is a, c, g, or t
  misc_feature (551)..(551): n is a, c, g, or t
  misc_feature (558)..(558): n is a, c, g, or t
  misc_feature (640)..(640): n is a, c, g, or t
  misc_feature (809)..(809): n is a, c, g, or t
  misc_feature (891)..(891): n is a, c, g, or t
tgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcantggagatgggctcagctcctggacgtgccacagacagataagacaaaacnaactactcgcccaagaaaaagcctttgcctgactcagggcagacacagagtgtgggaaagtgaaccaccactcaggcagagngcagagcacagccantaacccttggcacacacaagaccgtggggcaggggccaagccatgtgttcaaggcccgcaacaagaanaccggagagncggttgncntgaagntntnnacatcaccagtcancgcggtccccnngggtggcngtgcnggcntttgnngtgctgtnggantgnaaccaccaaaacttgttcannngcttgcggtggnaggaganggcggaagcgggcagaaggtactggtgatggagtactgctccagtgggagcctgctgagtgtgctggagagccctgagaatngcctttgggctgcctgaggatgagttcctggtggtgctgcgctgtgtggtggccggcatgaaccacctgcgggagaacggcattgtgcatcgcgacatcaagccggggaacatcatgcgcctcgtaggggaggaggggcagagatctacaagctgacagacttcggcgnggccgggagctggatgatgatgagaagttcgtctcgtctatgggaatgaggagtacctgcatcccgacatgtatgaacgggnggtgcttcgaaa

SEQ ID NO: 652831 - DNA, 613 bp, Homo sapiens
  misc_feature (448)..(448): n is a, c, g, or t
ggttgagagttatagaacttttaaatttctttagccaaacaggtctctatttttttaagttatcctaaactccaataaccatacttactgaaaagggagtcctgatacatctaatattggtaacatgtaacattatttgacaaagaataaataaacaatattcttggaagtcaatgttatatatttcaccaaactattattttatatatatataccattttctccctacaaaacatctcaacaagataaaaatctctacttataggacttaaattaatttctatttcaaataatttcctaatacattctacattataactgaacactattctattggaaaagtgaaaggaaagaaatgtaattttctttaaacattaaaaataaaacaactttcatagtaatcatttaacagtacatatacattattatcataaaactattctataantccaaggttaattatattaattgaaatatcactctttaatgtccaacttattgtaaggtacaaaacaactttctacttcactaaccattactcattaatcccttaaatacatctataatttcctgggactattatcactactagatatatatttagctatttcct

SEQ ID NO: 652832 - DNA, 947 bp, Homo sapiens
  misc_feature (439)..(439): n is a, c, g, or t
atggccgctgcgtgctcatcggattccgacgcctgcggagctgagagcaatgaggccaattcgacgtggttggatgcgcagtacgacccaagtggccaactatccacaccttttctgcctgcctagcgctggcagatttacatggggatggggaatacaagctggtggtaggggacgcttggccctggtgggcaagcagccccgcctgaaggtgctcaaaggaccactggtgagtgacgcgaaagcccggctacctgctcgtgccagcgtgcatgctgccagccttcctcatggagcaacagtgagccccggaccccagcgtcttggcacgttgcgttcgacggcccttgtgtcatagtgtgtatagagaatctcgagaccactacttcgaaggttcagccttggccccaatttgccgtccataatcctcgtggaacanagaccttgggaaccggggccagaagaggaccggaatcgagccccttaaccctgaaggagagtgctggagagcatccgggagacggcagaggagccttgggtccatccagttcactcagggtttctgcagctggagctaagtgaagatggaggcattttgtaaagccaatcacaagtccaactcctatcaagcggcgagacagtcatcgaccatccatgaccagccttgaagaagaacctggctgacgaggatgctgtgtctgtgcctggtgctgggcaccgagaacaaggagctcctggtgcttgagcccgagggcttcacattttagccaaggatgagccttcccagcgtcccgtcttcctagagggtgctggccagtttgactgttgagttccggcttgccgcgggctggccgcaatgggtaccatctattttctgagaagagactccaagcaccccaagtactgcttcgagctgagcgccagctgggggacttatgcggggtacc

SEQ ID NO: 652833 - DNA, 1153 bp, Homo sapiens
agcggattgtcgggcgctgctgtgaagctgaaagcggaggccggtccgctgggcggccgggcgccgggggccgtaggggcgcgcgcggcggggcaaccccagcgtataggcgctgaagagagcagacagtggcggtgaaacattcgaatcggaggagccggaagtagctggtactagggggctgggttgattcggcagtgcacggccgttggcgcttgcttgcagtgggcagcggcactgggggatgtacctgggtgctggagacgtcgatgcacacaggaccccgtggggtacatacttgttggctacaggcggtgcataaggatgaaatctcggcgctgatcgtctccgcatcgtacaaatctattcaatacaatgcgaaggcggcccttagaaggcccggcgctgagttgccaagcggtttgggcccggtctgcaatgtcattcggggccccgagatggttggatgttcgcccgttacaggagatcccgtcacatagcgacgaaattcaaagaaagattagaggaattatcaatttgtgccattggtcttttaaaccgatggggaaattactttagcgagaaaaatgtagaacgataattttggtgcgaaagcaccagttagcgacaactggaataggacttagtaaagacggaatgagtgatgtagccagagcaactgccgagtgaccaggtgcctaggtttgggcagcaggagaattctctagaggacagttgacgcgaccatgcggtgagataaatgtatggcgaacagatctcagtctgtatatggcgacatttcccaagggcggtgccacagtggaattggcaatcgagaacggacacacgcatacaccccgtattgacaaggcaaccggggcagacatgacaatcagatggcacgtgaaatccccgcgggaaaccacagggccctgtggcagcacgagacaacgggctgtgaggcaaccagctgcgggcgacagcggcacggcagcggaagaggcggcgaacgaaagacacagacgagcggacacatcaccatgagatcgaccatggatcgctccgcaaacaagcattcagacaacatgtgcctcgccgacccaccaatgcgaaccctcggcaccacgcgacgatggcgacggagtaaagcccg

SEQ ID NO: 652834 - DNA, 879 bp, Homo sapiens
  misc_feature (5)..(6): n is a, c, g, or t
  misc_feature (58)..(58): n is a, c, g, or t
gtagnncgcgcataataaatgtaaatattaagtggccgataaagaaaaagataacgangcgactcagtccatgcgactcagctcgccttattgtcttacaactgttccgtcacactcgcgtaaaaatatgctgccaacaataaattggggctaccccccggtgtgctataaaacctggctcctattatacaccctggcttccaaaatactgaagttgggtgccaccaacaagcctcctgctattcgcccccattaacccccggttataacgggccttttgataccccctttgggggccgccaagaaccccgcacttttttttcccgggtcctggcgcccccgtacctcttggcgttatttctgggatacgtccccccgcgcatagcaagtctcgggccccccctgctccccgggaagttctggccaacgcaatggtgcccccctggcgggcttccctcgagacggccacattaagatctcatttggtgcgccctcctggacccctgcaccaatcttcgggacgacccccgcgccctcgtttcttgttgtttattacacacaccacaaagggtttaatcagtgtcgcttaccccaacacctatcatagtttctccactcaaaaatccgctatactgacgagttctcacacgaatgcaatttcgagtagtccccccccctgaaatgatgcattcttcagtcctccctccacaaaagtagcttctgtaggccaccgcttcttcgcttgtcgtaaaatcatccttttgacccaaaaagatgtgcccattatgtaaacgacgaaatctagcccgcgatgaattcctccctccaaaacttcggccaggtttcgggaaaacccccaataaaaaaaacaacaataac

SEQ ID NO: 652835 - DNA, 273 bp, Homo sapiens
  misc_feature (30)..(30): n is a, c, g, or t
  misc_feature (34)..(34): n is a, c, g, or t
  misc_feature (137)..(137): n is a, c, g, or t
  misc_feature (206)..(206): n is a, c, g, or t
  misc_feature (225)..(225): n is a, c, g, or t
  misc_feature (260)..(260): n is a, c, g, or t
ccggtcgtggcaagttattctgagcaggantgcntgggtgcctatgtcagcctgacggcaaaatacccgataggagagcacgtcgtattgatggcgagcgcaggatacagcgagctgccggaagagattaccgacancccgatgattgatcgtaatgagagttttacctttgtcaccggggtgagctggcgtttttaattcaccgntggatgtcggtgcggctgntgctccgtcgtaatgccacaaaggttgttactctngatttgctctgtt

SEQ ID NO: 652836 - DNA, 106 bp, Homo sapiens
ctcggtaccggtgtaagcactgtacaacttccaagactcgatattcagagacgacgatttcttagtggcaataccttaactgcaccaaaagctaaagtttgccgct

SEQ ID NO: 652837 - DNA, 423 bp, Homo sapiens
gagagagagagagagagagagagagagagagagagagagagagagtagagagagagaggcctagacttcgggaaccaaggtctggacgtggatggcgtgaaggtgaagctgctgatgtgggacacagctggtcatgagcggtttcgcagcgttacctatgcctactaccgataggctcatgctttgatgctgctatacgatgtgaccaacatggacttgttagtgaacatcgcaggcctggatgaccgagattcactgagtactcctagcaggacgtgagacctatgcttgtggtgaacaaggggtagtatggcaatgatcgtgtggtgtctaggttggccggactgaacctgttcaatgagagctgaggcccgtgtgtccttggggtgtgcacattgaggttgtactacttgagttcctctc

SEQ ID NO: 652838 - DNA, 293 bp, Homo sapiens
  misc_feature (26)..(26): n is a, c, g, or t
gggttttgggtaaaagccctttaaanaaaaaaccgctggggtgaaaaagctttttccccctgtttccaaggttggaaaaaaacaaaggggggggctttttctgcccccgccctggaaacctttttagcccttttcctaagggaaaaagccgttttttttgggccccctaaggaaaatttcccccgttgggtaccccttgggggggggatgtgaggggggcttataaactcaaacttttgggttggttggcccaactgggaaaatttttttaataaatggggccccccccccca

SEQ ID NO: 652839 - DNA, 203 bp, Homo sapiens
  misc_feature (175)..(175): n is a, c, g, or t
tgagctgggatcacaccattgcactccagcctttgccatagggtgagactccgtctcaaaaaacaaaacaaaacaaaaaagaataggaaaatattaaaattcttaaaaagcatcaagctgaaactttattgttgttggtgttgttgaaaaagcactgaaaatgggaatagctttnctccctgttgtgactcagtggttaattt

SEQ ID NO: 652840 - DNA, 205 bp, Homo sapiens
ctatctctgggaggctggtcagcagtggggtgccaaacagagctgacctcgaaggcagcacactggcagtgttgatgatgaccccacgtatggcctccctggtctggttcattctaggcccatactcagcgagagcaacacgcgggatcaccataggaggtgttcatgagattcccatcaagaactcgctggaagtcttccaagg

SEQ ID NO: 652841 - DNA, 194 bp, Homo sapiens
tgacttgcatgctcctgctacacatgcatgtgtgatcccctcagtcactagcctctcctgttcccctgtgtgacccagtgcctggatgtgttggcagcatgctcccactattcccgtgtgtacccgtgcggccattacccatgccccgtgccgtctggtgagaattgaatctgtgtcagggtgatgcttgtgtt

SEQ ID NO: 652842 - DNA, 666 bp, Homo sapiens
taggaacagcgagcggttgctggaccagcttgaccccggagcttggttgctttcttgagatctcacagccacacgcaagagcaaacaggagagacagcctctgaggatgcagaggccaggaggaccctctgctaatgtcagcaaagtgaggaacccctcatgtcagcgttttgccagtgagcccaggtaagatgagacaagctggagctcagaagccccagctctggcattgcccgtgacccctcagaaagaatggctgcacatggacactgtcgagctggagaagctccactggacccagtgacttgcctccactgtctcggcgtgcagcatgacaccaggacatggatgcatggctcggttcacgtcttcagggagaactactggaccctgacgtggacctgaccacccaactgtgtactgcaccaccatggagaggaggcagagagagcggggtattcctcgtatcaggagctgttccaccgtgatcccgcaaccaggtttcccaggcagagagcactggtgactgcatgtgttagcccagtgtcattcacgtcatcggtcccaggctggtgagtccaggggaccggcatagcaagcagtgtcttaagcctccttttggatgctggtttcctcttcctactgcacttctccttggatgacaga

SEQ ID NO: 652843 - DNA, 439 bp, Homo sapiens
ggcctttgggcggtgggggccacggagagggtggtcctcggactacgtgcgggacacgaggtcatggctggcaagtccctcagggcttcctcgatgccccagctctcgcaggcgcgcctaactgccccgttccaagggtgccaccggaccccgctggagaggaacttatccgttggctgatttcatcaccacgcattcacgattgcacgtcacctttaagcggagctggcggagccgcatggcggcaaggaactggattgcgattggtcagcacgtgcctcggtcagcggcacaatcggctgaagcgctgggacttgtgaagcatatcccgacgggattggtcgtcgatctgcgagagcccgtctaccgcagtacgcggtccacgtgtctagtggcaggacgagactccaggactatgacgatggctctggccgcctcc

SEQ ID NO: 652844 - DNA, 114 bp, Homo sapiens
ctcggtatgagcggtgggtgagtgagcacagcttcattgtatttacagctgctccccagatcttgcattactgcctgagctctgcctcccgtcaggtcagcagcagcattagag

SEQ ID NO: 652845 - DNA, 693 bp, Homo sapiens
  misc_feature (68)..(68): n is a, c, g, or t
agtaatgatagcggttgtcccacgccaccagaagcgccaagaattgcgactttgaccatatttatgantgtttgtctctttttattttcttttgcactgacaagtgttttcccttgatttacgaaggccttgattgttttatgcttgaattcaaacccagcaattcttcctttttcccttagtcttttataggccggcgaaatttatgatgggcagtaaaactccaatagtaacgaaccgaaggggttcaaaagttgtcaactcgtggaaattcacacgtaagaaggatacagaaaatcttgagtaataggccatgccaagcatgtccactagtcataatggcattgctcgtcatacgatagggtattgaacacctttcggccggaccggcgttaactccggccatataaatgtggtaaaaaaggctactgcgctaatggcctacaagtgttcaaaacctcttctatataataagttataatgttcttgtacagatgtcgcaggcgcgaatacgtgatctgattttagctgtataattttaaattttgttcttttcctaaacaattcacggaaaatcaactgagagatttttaatatatataagaaatactaacaacaataacagcagctgttaacggatcttacttattatttagctcatttataacttctcccaaagtcttctgtttaatt

SEQ ID NO: 652846 - DNA, 215 bp, Homo sapiens
cagcatagctaagacccccgaaatcagacgagctacctaacgaacagctaagagagcacacccgtctatgttgcacaatagtgggaagatttatagtgtatgaggcgacaaacgctaccgtaggcctggtggactagctggattgtccataggtatacgaatctctatgttcatagctttataattgtgctccacaagagacctcgtctaatagt

SEQ ID NO: 652847 - DNA, 470 bp, Homo sapiens
tgacatattgctaaaaggccaaaataagtaaccataaagatgatgaaaggtgtctagagaatactatgatgcctataacagtagcatgactctcaattggtcccatggataacatggtacaatccaaaacagtccagcagacaagcactaactgaagatgcctgtggaaaaccagttatgtagacgtgtcagcttaccctggaggcaccaccagggattccgcaattaagctcgctggaagagagcttcacgtcactttctggggacttcagctccatttcacactttaaacacatgcaaaatatactcactatacataaaattaatgtttcttcagcaaagtcaaggcaaaaataattcagcatgagctaatggactgctaacagagaaaccaccaggtacaagtgcacacacatgcttggtgcctggacagccttccacctagtcggggaggagctgtttctcttcct

SEQ ID NO: 652848 - DNA, 153 bp, Homo sapiens
gtaaggtactgtgcttatacaacaagacaacctcatttctaataactacattttcttccattcacttttttctttatgaaaagaaaaaaggccgggcacagtggctcggacctgtagtcccagctactctggagcctgaggcaggagaatcat

SEQ ID NO: 652849 - DNA, 124 bp, Homo sapiens
cattggaagccctcatgagatgcagagaccgccacttgtcacaagagaggccacgacgtggggatgtacttgaacccacagcacatctgggatgagccgctatttcagccaccactgtcttcaa

SEQ ID NO: 652850 - DNA, 393 bp, Homo sapiens
atatggataatgaaatggggtctatccattcaagggaattttattcagcctttaaaagcaaggaaattctgatcatccatgttcagatccatgttcagatctgtgttcctccaacatggatgaaccttgaggacattatgttaagtgaaatcagccagacacaaaaggacaaagattgtatgattccacttaaatgaggttcctagagcagtcaaattcaaggagacaggaaacagaatggtggttgcgagggtggagagcaagggggagtttttgtttaatgggtagagtttcagttttgcaagatgagaaagttctggagatgaacaacggggatggctgcacaacaatatgaatgtacttaatgccactgaactgtacacttaaaagtag

SEQ ID NO: 652851 - DNA, 327 bp, Homo sapiens
ataagttgattgtaatgatataagcatcacacaagtttacattaagaaatactgtgcaggccatgcgtggtgctggaggcgtgtaatcccagcactttgggaggccgaggtgggcggatcaccggaggtcaggagttcgagaccagccttgccaacatagtgaaaccgtgtcgctactaagaatacaaagagtagccgggcgtggtggcaggcacctgtgatcccagctgcgagggaggcttttgaacgccaggaggcagaggttgcagcgagctgggatcgcgccagtgcagtccagcctgggtgatagagtgaggttcagtctca

SEQ ID NO: 652852 - DNA, 189 bp, Homo sapiens
gacgtgtccaggaatgcagtgccctctctcaatggatgaccatctccctgtggcacttctgagatgtgcaggtgccactatggtatccctccacgtgacagcctacaagacccagccaatacacaggcacgtccagcacttacggaggaatccttacctggttctcacaggacagagcagcagcagcgg

SEQ ID NO: 652853 - DNA, 345 bp, Homo sapiens
aaattaacagccgcgtcgacttctataattattgtgtaatatatatacgctaatgaaatgtataacacaaagtggggttttttttgatacatctatatctactaaaagatatatcattaccttgtttctaaattagtatattagtgactattagtagcaataacttcctatattatccactctccaaaggcagttatgggttatggtatccacataaaattagcctggttaacatatgccttctgattcacacaagtttgtgatgggtatggtgctctgaagccagagaatggtgcatgcatatttaatggcccagtgtggaagtactttggaatgatgtcgacg

SEQ ID NO: 652854 - DNA, 457 bp, Homo sapiens
cgaggcggctccgcccgcagcccgcgcccgagcccgcctcctccgggcatgaccaggacgttcctcctccgacctcttgctccagaaccgactacgggggcaagaactgcaaacgaatgccgtgccgatttacgggcctaacggtagaagcccctgcgggcggccgtgggtgagcctggccaaaaagggacgccgcgtgcaacccaccgggcatgcaggttcgcggcaaccatagattaccacaaccaggagcgcgacacaacacagaccacgcgccagcacgccaagcgagccatacagccatcaagagtgaaaggacggcacccgtcactgcacacacatgccgccgcggacacaatgccacaaaacagcgccacataagaatggaatgacccgagcacgaccacatgctgagtaagacacacagaccagcgaagtgaggagagaaaagaaaagt

SEQ ID NO: 652855 - DNA, 549 bp, Homo sapiens
caacataataccttaagcgaattctttgtgcattttcatgctcatttatatatcacttttaacagagaaattagtcaccaaatacctcttcccactaccaaattattccaataaattttagaatatttaattttatactaattactaaaactcctacttcttttcactatgctacccacagcaatctgtgtgtattataatattagcctcagaaagctgccatcagcagaaattctacttaaccatttaaaattactatagctgggcagcctggccaacatggtgaaaccctgtctctatcagaaatacaaaaattagccgagcagggtggtgcatgtctgtaatcccagctactctagaggctgaggcatgagaatcagttggatccgtgggcggaaggttgcagtgagctgagatcgtgccaccgcattccagcctgggtgacagagtgatactctgtctcaaaataaaaattaaaataaatattttgtaaagaatcatgcagggagtcagtcaataaaagctttgaagtaagtctcccaaggactg

SEQ ID NO: 652856 - DNA, 826 bp, Homo sapiens
agtcctcacaaagcatttggctgggtgcagggctgggcgcctcccgcctccggcgccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtcctctgggaggcgccgattctctcgcccgcggccgtcggtggggagttcgtcgccctatccatcctagtcgcgcacatgatggttggtgggggccgccccgtagctcgccgcgtccgtcctgcgcaagatgagcgacctgctggagctgatggtgaagcgcatggacgcactggccaggctggagaacagcagtgagctgcaccgggccggcggcgacctgcactttcccgcagacaggatgccccctgtgggccggcctcatggagcggatccaggctatttgcccagaacgtctccgacatcgctgtgaaggtggaccagatcctgcgccacagtctgctcctgcacagcaaggtgtcgaaggccggcgggacccgtgtgaggccccagtgagcccagtccctgactgctcagcaaggtggctggtgcgtcccctggacttgccctgtaccttcttggggtgcggcc

SEQ ID NO: 652857 - DNA, 969 bp, Homo sapiens
  misc_feature (1)..(1): n is a, c, g, or t
  misc_feature (113)..(113): n is a, c, g, or t
  misc_feature (133)..(133): n is a, c, g, or t
  misc_feature (137)..(137): n is a, c, g, or t
  misc_feature (169)..(170): n is a, c, g, or t
  misc_feature (178)..(179): n is a, c, g, or t
  misc_feature (182)..(182): n is a, c, g, or t
  misc_feature (194)..(196): n is a, c, g, or t
  misc_feature (200)..(200): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (218)..(221): n is a, c, g, or t
  misc_feature (223)..(223): n is a, c, g, or t
  misc_feature (225)..(225): n is a, c, g, or t
  misc_feature (227)..(227): n is a, c, g, or t
  misc_feature (240)..(240): n is a, c, g, or t
  misc_feature (245)..(245): n is a, c, g, or t
  misc_feature (265)..(265): n is a, c, g, or t
  misc_feature (283)..(285): n is a, c, g, or t
  misc_feature (334)..(334): n is a, c, g, or t
  misc_feature (341)..(341): n is a, c, g, or t
  misc_feature (345)..(345): n is a, c, g, or t
  misc_feature (394)..(394): n is a, c, g, or t
  misc_feature (399)..(399): n is a, c, g, or t
  misc_feature (968)..(968): n is a, c, g, or t
ntcgtacttcgttggaccaacaaagctactttcatgtttttatgttgttctttttagatatttagattaaccagataatcttaaattatcttagaaattagaaagtttctgcngtcttgttacatttgttccnagtntaccagttcgtttctatgccctacgcttgtcnntcctgtgnnagncgtctattaccnnngccntttctnacncnttgctcnnnngncncngtaacgttgtganaggcnttttgttggatttagtcccnttttagtatccccttaannngtttgagctgcatgactctggatattcagccaacagtgttgtgtcaaanacttgcntgantttatgctaaaaattcatagtcggtgctgaacctgaatttgtttgcccnaagcngccccgtccctgcgctgcgcgcaaaggtacaccatggtggtgagcacgcttgtccaggaagtagtgatggtagaccacatctgaggctaggacgtaatcatagtaaaaagctgacttgggaaagtttttgtccaggtcttccccccataccagtcgctttgcacttgaggcagatgtgctgtacattgtagtgtgttttttaaaagattgtattgaaggtttcccaggacatcaggcaaatgctgttgctgtgacttgagctcctaaaatactggccacaatggaaacaaggcctggtccggcaccaatttcaagtatttttgcatcttggaaattcaattcctcggcatgttcctccaagtattgacacaaagccatagcccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattcttctaggactcccccggtgctgtctttctgcgganc

SEQ ID NO: 652858 - DNA, 140 bp, Homo sapiens
tgactctagagatccttggacgcattcatcgtggctaccactcccctcattgttgccagcctccagaagccctcagatttgcccagcagtcccttgagacctactctactgctcctttcccccacttggcttttcaacct

SEQ ID NO: 652859 - DNA, 325 bp, Homo sapiens
ccaatctgtgctgacgttatttcacttaacataatgctccagttctatccatgttattgcaaataacaggattttattatgtttatggctgaatagcagtccatgtgtatatgtaccacattttatccattcatctgtcgatggacacttaggttgcttccaaatcttagctattgtgaataatgctgcaacgaacatgggagggcagatatctcttctatatacagattttctttctttcgggtgtatacctagccatggaatagctggatcatatgcatgcactggttttagtccactcctgtcacgaggcacagattgcagt

SEQ ID NO: 652860 - DNA, 198 bp, Homo sapiens
tgaccgaaaggcctcccgaaagagctgatgtcacttgagaccttgtaagcgggacacagctggtctcagctgattgaagcgtcttgatcgggggactgcactattatttccggagtggctcgctctaaacaatcaactggtacatggcccggtcaactgaactaggctgtctggctgaaaccttttgaaccgtgacct

SEQ ID NO: 652861 - DNA, 102 bp, Homo sapiens
ccgtggccttatttctacgtacctcgacgtgggcaacttccactacggagctggacacctatgaagcccatcgcctgcattgaccatagcctggtcctgcat

SEQ ID NO: 652862 - DNA, 939 bp, Homo sapiens
cacacgcacagagacctgccagaccatacaaggacaatgctgcctgaacatacacatcgcagcatccagtgcgcggatgtgctgcctggacccacagacttacacgaccggagtatgctgtctggacgcacacatgtgcagatatggtatccggaggcacacgtgcacagatatgcggcctgggcacacagataatgctgccttgacacgcacaagtgcacggaatatagccctggaacacccacacacactacccgatgaacagatattgcgtagtctggcacccgcgctactgcaacatgacagaatatggcgtgccaaggactacgagcaacgtatgcgcagaacaacaacggttacccacagggcggcgagtgaataatgcctggccctggcacaacgacgtcaaaattatgcgtgtcatagctcaacaactcagccgcaagacaatcctggtccggtaccactcgacacagctatgacactgggaatagtcgcatgatcgcggacacacatcatctggagagcatatagagcagcactgtggcacgacgacgacgatgaataaatgcttagccatccaaatcgctacgagcactgtgcaaggagtatttgccatggacagaaacaagcagtgctgcagcatgagtaatgccagttagcgtaaagtgcatcccaacgtgactagtaataatggatagttccgtgatcacgccaacagtctgggaccactactgatagatctctgactagacctgggtaacacgtcttggcagtgagaacacattgaacaacatagggttggcaccagtattgctgcctgggacacgacgcaaaacgagtgaagtgatagggaagggtgccaacgagaaaaccctgcagtaaagtgtgtccgtgaaggccccatagttggagacgcgaaattgacttggtcctcag

SEQ ID NO: 652863 - DNA, 120 bp, Homo sapiens
tgggttgcagtgtgactgtgtgcagcgtgggcagaggggcctggggctgtctggcttcacagcccagcaaggtcatgctcgcagaagtcgaacaccaggtatatactacccttgcagcgg

SEQ ID NO: 652864 - DNA, 256 bp, Homo sapiens
tacgagacacaataagcttgaggagcatatccttcgtaccggtgagggacctcttcagccctggtactcggcaggaccccagccccgccaggccccccactccgtatcctccgggagctcgtctcttccctcgccagcggaaatactgattcccactgctcctgcctctagggtgcactgtccgtacctgctggagcctgggccctccttccccagcccagacattgagaaacttgtccaacacgagagaaaactc

SEQ ID NO: 652865 - DNA, 545 bp, Homo sapiens
tcaaaattttgtgagaatttacattaatgtagaacctatatttaattttttgtaaaatagtgatggggtaggagttattatcttgaacagttttcagaaagttagaaaagaaatagccagagattttttatctgttcccaaacatcttaataagataaattactcatagaatgttagaatgctagaagagccctgtgaaggtcatctatcttatcctgctcatttaaagacaaggatcacctcctaatacttttgtcagttgtactctgtttatatgcatagatgataacatctcaccagcatcatcaattgtaaaggatagcaactgtctctcaatcacaatagatacagatttctgaaaatgtaaagccatgtcagagaagaactctggagctagtatcgggctgtgaaaagaatttgggctttggcccggtgcggtggctcactgcctgtaatcccagcactctgggaggccgaggcgggcggatcacgaggtcaggagatcgagaccatccttgctaacatggtgaaaccccgtctctact

SEQ ID NO: 652866 - DNA, 1026 bp, Homo sapiens
ggtggtgctagcaatatgtctctgtctgctgtgcccgggcctgctaccatgagcgtcccggccttcatcgacatcagtgaagaagatcatgctgctgagcttcgccgcttatctgccatctaacaggagctgagatttcagaacataactcggaaggtggacttcactgtccgattgaggctcaaattaattgaagcctgtggatgtgtgtctagaaggcaggatgcatcaaagatgttgaaaagtgtagatagaacagtgtggtatcccttacgtcctatgatcctggatcccccaaccaatcaagaggcgtttgcacttgaaagcctcatgttgaaccagagctcggtcaaataacagggaaagtcgcaagtgcccgtcctcctcgagagtgcagttgttaagcgaaacttaccccccggtgcatggataaagaatactcctgtcccgatacatcatgtgtacttgcacgcctgagtgtggcacgtggcagggatcttgtgggggcatccaggtacatgccacctgagctgcctcaccttggacgggtggacctctgactgttaaatctcggccacctgatttggacgcgggttcctttttccgactagttttattgctgccacgtgttggatagcccgaagagtgtgctgcatcaagaggtcatgccgaattgctcggggggtcacacagaggaaccttgcttaccccacgctcgaagttggatgcccggcacgctgttttgtccgcagcgttgaaagatcgacacgattacttgcggaccagcgcctacattacacgagggaggtaagcggcgagccactcgtgcacaggagcattgggtccgggtgatcggcgcggctgccgccccgggaaaaaccttgggaccctgcgggacggaaaacttggcggacaaaactctgcgggcctcaaaagacaaagaacccgccaaattagttgccagttcccaaactctgttctcaacaacagaccgtgtacaacgagccaataccacggggcataaaa

SEQ ID NO: 652867 - DNA, 315 bp, Homo sapiens
  misc_feature (75)..(75): n is a, c, g, or t
gggcccccccccccccccccccccccttggtgtggaaggcacaaaacacctggggttgggggaacagcctgggtncggctttcatcaactcccctggggaaaaagtggccatgcccaaactggtgcgctcagtgactgtggtttaggaccacaaggatgaggatggaaatgacctgctccctcccccccccgtgagtggtaaccccccctgaggccgagcctgccctggggccccccagccaggcctgggggcagcctctccccaccccccccgggccaaaaattttttcattaaaaaatgttttgggcctttta

SEQ ID NO: 652868 - DNA, 224 bp, Homo sapiens
  misc_feature (13)..(13): n is a, c, g, or t
  misc_feature (73)..(73): n is a, c, g, or t
  misc_feature (81)..(81): n is a, c, g, or t
  misc_feature (102)..(102): n is a, c, g, or t
  misc_feature (133)..(133): n is a, c, g, or t
atgtattgttatnattaatcagtcttttactactaaacttaaatgggcaattgtaaataaacagttgtgagancgttcttncaccactgattaggagtgggntggcaggtattagggataatattcatttagngttgtgtgttttgtggggagagttggtgagtttgccagctccagcagccttcttgctccactgctttgatgagacccacgggaagtgtgtg

SEQ ID NO: 652869 - DNA, 713 bp, Homo sapiens
  misc_feature (131)..(131): n is a, c, g, or t
  misc_feature (143)..(143): n is a, c, g, or t
  misc_feature (160)..(160): n is a, c, g, or t
  misc_feature (193)..(194): n is a, c, g, or t
  misc_feature (242)..(242): n is a, c, g, or t
  misc_feature (283)..(283): n is a, c, g, or t
  misc_feature (304)..(304): n is a, c, g, or t
  misc_feature (309)..(309): n is a, c, g, or t
  misc_feature (317)..(317): n is a, c, g, or t
  misc_feature (321)..(321): n is a, c, g, or t
  misc_feature (325)..(325): n is a, c, g, or t
  misc_feature (330)..(330): n is a, c, g, or t
  misc_feature (358)..(358): n is a, c, g, or t
  misc_feature (361)..(361): n is a, c, g, or t
  misc_feature (387)..(387): n is a, c, g, or t
  misc_feature (515)..(515): n is a, c, g, or t
  misc_feature (521)..(521): n is a, c, g, or t
  misc_feature (532)..(532): n is a, c, g, or t
  misc_feature (579)..(579): n is a, c, g, or t
  misc_feature (592)..(593): n is a, c, g, or t
  misc_feature (635)..(636): n is a, c, g, or t
  misc_feature (644)..(644): n is a, c, g, or t
gtcacgtcttctgcctctggactgaaccccacatctgcacctccaacatctgcttcagcggcccgtgtttctcctgttccacagtcgccaatacctcccttacttcaggacccaaatcttcttagacaatngcttcctgcttngcaagccacgctgcagnttaataattctaatgtggacatatctaaaatanntgaagttcttacagcagtgtgacacaagcctcactgcagtctataatncataagtttcttactgctggaccatctgctttcaacataangtctctgatttctcaagctgntcagntctctaanaagnccangcatntaatcagtctccgagtgtctttaacatntgntgcgtcatccccaagatcatatgttnctccaagaataagcacacctcaaattaacacagtccctatcaaactttgatcagtactcctcctgtttcatcacagcaaaggttagtactccagtagttaagcaaggaccagtgtcacagtcagccanaagcancctgtaactgntgacaagcagcaaggtcatgaacctgtctctcctcgaagtcttcagngctcaagtagccnngagaagtccatccacctggtcccaattcatacttctaatagnnagtcctgnctcaaatgcacagtggtcccaacaagaattttctttctggcccgatcccagtggttccattaaaggccg

SEQ ID NO: 652870 - DNA, 988 bp, Homo sapiens
ggagtatctaaggatcatgtctgcgagccacggattcccgatccagagacaatgggcccggaatgggatggagcccgaaggcgtcatcgagagtaactgaaatgaagcatagtagtacagcttagatgatcccatgtaagcctctcgagaaggatcctctgtctccgtgtgcatctacgcctatggtttttgagaagccccatctgtccatccgaggcaagacgtagtccaatgtaactacctaagtaatcaacggggtagagtagagggtgattagctcaaggcccaatctgggagctgggagggtacgggcacatgtcgcctatcatcgatgctgccagctagtattgaattaggatctagaagaccacccgccaaggtcacttgagtcctaggcattccacatcgaagaaataggctcaggcagattacagtacaggtgtgcatgtgactagggaagaacctacatggtgcgacctccatgtcacgccatgtatcggagggcacctaaggtgcgtgccgatgtgtgcagaagactgcagaatggaaggtctctccacatcatctgtgggtacctcctgcccgtgtgtattgctgtgcttaaacggagatacctgttcccaaaatacgtcagagatgtgtgtactggttgaagtgagtgaatgttaagcccgtgggtgcaaggacagatctttgaaggtgttccaagagctcaagaggacggcaggagatatggatagacacatgcgatactagggcttaaggaccaaatagaaggacccattcggtccgtcagacgaaaacataccgtaggatacgcagtctgagataagtggaacaagagtggggggaacatgtaatgtgaaccaaaacacgggatataaaacggaaggtgacaaaaagcgaaatacaaaaataagaaataaaatcaaacaagaacggatgcataacccatcctctgcggcctcgcctcacctctcctccctag

SEQ ID NO: 652871 - DNA, 460 bp, Homo sapiens
acctgctgttctcctcctcgactacgtcaatcatttctatcattctttaaaatttattttggtgattatttgactaatgtctgcttctcccactaaatgcttagctccctgaaggcaagggccatggctaattgttcacagcacctggcacagtgtctggcacatggtaggtgctcaatcaatatttgtcgaaagaaaaaatgaatgtggatatccttgataaacagtaaacagctgggcaaaaataaggcagagctgcagaaatgaagaaactgatcctacaaatcatgtggaaattcaaaggtcccagaatagccaaaacaatcttgaaaataaaaaactaagttggaggactcacacgtcccaatttcaaaacttactacaaagtaatcaaaagtaattacagcaatcaaagttttcaaaactatgtgctactgggataaggatacacatatagatc

SEQ ID NO: 652872 - DNA, 781 bp, Homo sapiens
  misc_feature (393)..(393): n is a, c, g, or t
aggagacatagacttgaacgacccaggccagcagcgaacagtatatgccacgccctgttgtgccctacgctagaatcaagtcatgctgttcagcatcttgccgaaacgtgctaagtgatggctgcgtactctggacatgcacgacgggctgtatctgccacgttacactagctcaagatctgatggctcagacgatagctcatctgctgcattaagaaaaccatcatacagagagcagggacttttacaacatcttcagaccttgatagagacatgcattgcttaccctgcagaacaactccaagctgactgtactagaaagagacacccatgtactaccatacctaagacgaggctgtcaagacgtatacgtcgtcatccacaccgcctgtntcactgatgggtccggtggcacttacagtgaggccatgctaaatgtcacatgcaaatgtacccacattctggtcaaaggcccctgtacaagacagggtttcaattttatgtccaccagttaatacaaggggacggggcaactccttgcgggcaaaatttataacggtgccgaaaaaaaccttttgaaaacacatgggcaactaaaaagccccacccaaaagcttctccaaaaagtgggctcccggtattgatggaaataaaaaagggtttcctttcattacggcgtaaacacaaaaaaaattgggggggagcccacccctctgccccaaactgtgtcttaaaaaaaaaacccgccggggggggggtcttctttaacaaccaactttta

SEQ ID NO: 652873 - DNA, 462 bp, Homo sapiens
tacaaggattactactggcatgagccacagcgtccagctccaactttcagaaataaaaattaacaagctgattcggaagtttaaatgtaaatgtagagggcctagaacagacaaaaacagtttagaaaaagagcagagttggaggattacagtccctgatttcaagactaacagcagtaatcaagacagtgtgtaagggtagatacacagatctactaaacagagcaacagccaagaagtagacccatcaatataataagttcaattgtttttttggtttcgttttttgagaaaaaagccaagttgattcagtgggggcaagtttagtctttttacagtctgtaacaactagatgattatgtgtgaaaaaatgaacttcaactcctgattcacactgtatatcacaacctgaaattatagtagatttaaatgtaaagctataaaaactacaagaaaatgggc

SEQ ID NO: 652874 - DNA, 347 bp, Homo sapiens
  misc_feature (19)..(19): n is a, c, g, or t
  misc_feature (220)..(220): n is a, c, g, or t
atcattattttaatcaagnaacttagctgtttaaacaaatccttaaggcagttcaatagggcaaagtgaaggattactctattagggtaacctgagaacaaagttcaggttatgagaatttgtattccattcgaagattggcaccaggctgaacactggtttaagccaaattttttagtgatctagaagccctgaacatgatttccctcaggttaaaagnagaactttataatagaacctcattagcttgacactgagaatgctgagagcaacttagcttaggacaccagtatctcctacagaattccagttaatgaaagcagaacagccttgcggcaaagaatttg

SEQ ID NO: 652875 - DNA, 190 bp, Homo sapiens
  misc_feature (5)..(5): n is a, c, g, or t
  misc_feature (18)..(18): n is a, c, g, or t
  misc_feature (168)..(168): n is a, c, g, or t
  misc_feature (182)..(182): n is a, c, g, or t
agctntttttttttaagntcacattttatgaaccgtttcatacagttgagcgttgaatttgtcctctggtgtgacatgacaattattattcttaagatgtgtcattttttcatcaaaatgatgtgtcatcattctttgtcattcctgtctcacaataatgtgttaccntgtggaaattaagnacaattag

SEQ ID NO: 652876 - DNA, 170 bp, Homo sapiens
ccctccccgggtagggtttgtagacttgaaacccactgtcattaaacagaggctaatgttgaaatagcttgcgcgaattgccagtgcgaacttcatcaatgactgtggattccaagtctacaaacactgcccggggcacatgcttgccagcaccctgtttactacccggg

SEQ ID NO: 652877 - DNA, 206 bp, Homo sapiens
ggttagtcttcttccaggctgatacctatctccaggcttatatgactatgtaatcatagttgggcgtgggtgttgtcgtttttcaatatgaaatggaatcatatcatagtcattattcagcttctctaacctaatgccatatcatggttttccttcttgttaaacaatacacatgtaactattaaaaagaatgagttaaattgtgt

SEQ ID NO: 652878 - DNA, 397 bp, Homo sapiens
tctcgtggtggggatcatgactcatgagcaaagcacctctttcactggtactagccgcaccatttatggcaccctggccaagcatcagtatcactgttctgtggtgcttacacatatatagtatatcattttgtccccacagtggctcaaggtaggcggcttggtaacatgacacccatttcagacgactaggtaagcgaggacagaacggcttaggtacttgtcccgacaacacactagagagtcattcatagatcttatcgtgggtgtacaagccgcctaaggagcccaggcatgtaacgcactgcactgtgtgggcctgtctaccaggtaatactggaacttttcccagtgaaggaagacacaggagaactgtacccttcctacacaggaccaa

SEQ ID NO: 652879 - DNA, 483 bp, Homo sapiens
  misc_feature (29)..(29): n is a, c, g, or t
  misc_feature (36)..(36): n is a, c, g, or t
cctattataaaataatgatgcagggcagncgtgggncgcacgcctgtaatccccagcactttgggaggctgaggcaggtggatcaccttaggtcaggagttcgagaagagccctggccagcatggtaaaacccccatatctactaaaaacacaaaaattagctgagtgtcgaggcacgagcctgtaataccagctactcaggaggctgaggtaggagaatcacttgaacccgggaggtggaggttgcagtgagccaagatggggccactgcactctagcctgggagacagagggagaatccatctcaaaaaaaattaactaatttaaaaaaataacgatgcagtgtacatccttacaactgaatctttgtgtgtgttatttatttttttgagacggattccaagtgattctcctgtctcagcctcccgaatagttgaattacaggcgcacaccaccatgcctggctaatttttgtatttttag

SEQ ID NO: 652880 - DNA, 271 bp, Homo sapiens
gggcaaactgcaaccctaaagattggagagacagacaaggaaatacaggtagtcagggcttcccagaacaaagactcaggaatggaaacttccaagggaaggagtacttgagtaaaaaatcctgaactgtaattgatgagtgctaaaggcccagtgtggacacatctgagagttaaaaattccacggggactcagttacaccccccccccaaaaccctttataagttttatctctagaagctctaccaggttctcccagtgaagatcagga

SEQ ID NO: 652881 - DNA, 282 bp, Homo sapiens
gtgtgcaaagagagcggggaccgaatcatcctcactagtactctcacatctgtccatccaccccgtgatgctctgctcgccttcccagagtagctttcgcctagatgtttcctgacatagaacaaggttgggtgctgggaatgagagtggcccgtgtgagagctgggtaatcagtgctgtgtgtgtgatagaggtgcaagctggcccaggagaatggctggggggtcatggtgagtcatcgctcaggagagactgaggacacattcattgctgacctggtgg

SEQ ID NO: 652882 - DNA, 283 bp, Homo sapiens
tggaaccaatgctccgttcggtgcggccggggccaaaaaaaccggcaggttttttttgttgggaacaacggttattaaataaacaaacaggagtgtgggtccggccccccccacccccccaaaaaaaaggcctttgaaatgggggcctgtttttttgcctggttccccaaggactggaggtccaaggtgaggccggaacccccaaccatattttgctttttgggtaaccatgccccggaccccccacccttttcagcaaaagtcaataaaattgttttggtca

SEQ ID NO: 652883 - DNA, 620 bp, Homo sapiens
ctcataagagtggtggtccctcaatccggtaatcgggatataaacagtcgcgatcaactctccgcgggcgtaacagctcaagctcatatgttacaagcttgggcgtcaacagacaaggaagtcttgctgcaacaatacacatctaacaattagtgaacatccattacttgccagaaacctcattaaaaggtacacatatatagtctcattaaacttatgtgcattagcaaacttgaaagctcagacatgccgagacaatctaattgatcatataggtagaaagtggcagagatgaaaaattaaaaattctgatcgaagggcccagtcttaacgcagtctaacacgcccctcctaagggaaatgtcttctacccctaaggaccaaagcttagagttagtgatatcattccccagcagctctctgcgctttggcatcaggttaagagtatgaaaccagctcgcagaaaaggagcaggatcttgaccgcgggtaccccgggagatagtggccaatttgagccaagggctagaaacctcctctagcatcggacaacacttagcagcctccggagaaaacacctcttcaggtaccggctcgattcgtattctgtctacttttacc

SEQ ID NO: 652884 - DNA, 323 bp, Homo sapiens
ttcttttctgagatatattgactgttaagaaaaattccaggctggctgggtgtggtggctcacgcctgtaaccccagcactttgggttacacgagggtggatcatgaggtcaggagttcaagactagcctggccaccatggtgaaaccctgtctctactaaactacaaaaattagctgggcatggtggtaggcacctgtattcccagctgctcgagaggctggggcaggagaattgtttgagcccgggtggcagaggttgcagtgagccgagattgcgccactgcactccagactgggcaacagagtgagactccgtctccca

SEQ ID NO: 652885 - DNA, 345 bp, Homo sapiens
ggtaagagaagggagtgtgtcctgtgcatgccctttttctgaggttgtgacactagctgtggacccctgccttgagactcatctcatcaatgctggcaacctcttgggttttagagctggtaggttacttcattctttgtggcacgaggcatgtggctctcaaacttcttagggcgcccgaagagtcacttactggatagtgtgaagatattcagagggcctctgtcccctttcattctcaaccacatttgactgtggcattggatctgtggactggtggcaattatgtgaaccttcacgtgttcttgctgtatatattgacatatcttgagatctgcggcttgg

SEQ ID NO: 652886 - DNA, 87 bp, Homo sapiens
ataaaactcgggaggcagaggttgaatgtgatgccgaattgcatatgcactccagcctgggcaacaatgagcgaaactctgtctcag

SEQ ID NO: 652887 - DNA, 82 bp, Homo sapiens
gctttttataataataaacccaaatacttaacagaaaattggcagcttttctggcaaaaataaaccttttgagaggctttta

SEQ ID NO: 652888 - DNA, 541 bp, Homo sapiens
ttccttatagtgactcctagaggatcccggcatgtgctgtagccagcgtaggtgggaaggaagatgtctgtccagctgtttttttatggctgggactttggactgttaggcgccatggtccgacttctgccgtaacactctgatttgcctgccatttgcagggtgatggcctccttctgataaaactgattctaccaatctaaaggggagttgcctgcatcatatgggccgtggcatagctcgcgcaccctgggggggccggtgtcattacgcatcccaggtacgggcaagaaggcggcataggcccccacagcaccttggctgcccacacgacttgctatgccgttagcgatacgaggggtacggaggtagagagacaggagaagcaggcagcgatgatctggaggtataggcggaaaaatgggacgcagcagtcatgggccggtcagcctcttttgtcagcacggttgctgtatctcctagtctcttctagataatcgatggtatcgtatctaccaaagctcctctttctccgggaagg

SEQ ID NO: 652889 - DNA, 101 bp, Homo sapiens
ataggatccccctggttgcgaggaatgctgagtgatacaggcttagtgttgaggaaatttctgcagttttacgcagtcgtgtctgtgattgaccccgtgag

SEQ ID NO: 652890 - DNA, 337 bp, Homo sapiens
cataacataggaacaggaagggctccacatcatactataatgtctcgtggtccacacactaagtgtaggccaacaggcacaggtattggcagtagatctatgtgtttcttgccatccacttcaaacacagagattgaaccttagcgatatatctcatcaccaggtgggtagtaaccacacacatatggccatgtgccggcggagtatcgtacggctcttcatatattttaaaccagaattcacacataatagagacgtcccagccgtgcatattcttcaggatatggcgaatgataccaggtatcaagctcatagcggtcaaaagcacttgtttcaa

SEQ ID NO: 652891 - DNA, 379 bp, Homo sapiens
ccatcgtcagctaacattcgagaggcacaggtctgccaagggtttcctctgcccacttagttccccagtggctcagtgctccttccttggatgttccctggcggtcggtgatgcagaggccgctctccgatgcacttgtgtgactgatcaatgtaaatgctctctgagttttcctcccaatgtcttaaggtggcttggcaagtcctcaaccctctcacactgtctcagggtctctaccctcaacaatattaaattcctttcagccagaaagagtaatgagaggctgacaattggatacacctggagctttcagggctggagtgcccagagcctcctgatgtcagagttcagacgttaacgtatgtcagtgggagaagat

SEQ ID NO: 652892 - DNA, 195 bp, Homo sapiens
atatatatgtatgccataccagtctatctatatatgtacatagaacacaaaccatctataatgatgcctcgatccccagcctagcattacatgattcattcatgccatatctccttaatcatatttgtcctatctttctcctggacagaaaactggctcttgtaacctaccatatatctgcttatttgttcatct

SEQ ID NO: 652893 - DNA, 1305 bp, Homo sapiens
gctggcacaggcggtttacgcatcaggacggttcctactcctcagcatcttccgtgcagttaccagtgtccctggcggggtcatcgactgtgccgtcggtacccttgtgcatgctcctattcaggtctgagcctgctgaggagcagggcatcgccgggactccttgtggtcctccccgaccctcacgcgtcatgctgccataagctgttgcgtcctaaggtgcttggcccacgatgcaggaccacggaggaagctgtgagctcgaccattgagtgcctctgaaggctgccatcatgtcttgtatggtgcctggccttgttgggccagggggccagtccatgtgcgctatagttggcgcccatcgaagtcgtcctagacgaggccagacgattgcgttgtctaaggtagccagcgagggttcgccatcacatatcatctgtgctcatgcatcgcgtctacctagcacttgcgattaccaaagatggcttgtttagtctgggctctggcacctagtcgcctcctgtagggccaggtggtgggaggtccggtggggggccggtaggtcctcgtggtccaaagtcattacgcttagcttgattgtgcgtaggaatgctagtagtgcacgaggtggttcctgacgttgggcggccccttcacttggcgccacgaccgttgaagcgcaggcgcgttgggcgtcagggggagggcgaatctcatgcgcttggggacatgaaccgggaagttcttccaggtgacttgtggtgcttcggtttcctggaccgtctccatgaggcatggacccgaaccctctggggctctcaaggtgttggctgtgcgccgaggtctccctcgggtttccccatcatagtagacgtacagattggggttggcacggagagacccgtacacctagagtgacacgtgcatggcaaactatgggcatgagaatcgagcaaattaccaccggttctatttaacggtatgactggtggaagataagcacaaagtggactaaatgcttgaactaggttttacacaccacactgtattgagcctagaacaaatggattgagaggagacggacacaaccaatggttgaacgggccgaaactactggaagaagcaggctagcactagcagaggacagagcaacaggccaccatcacgcggagaacaaggagacacaccgacgtacataaccgcccacaggaaaaaaaaaaaatgaaaacacgacagaacaaacagcaaaaagaacctgcacaaaaaaccaagaaagcacgccagacaaagagagcggacacccaa

SEQ ID NO: 652894 - DNA, 355 bp, Homo sapiens
ctggtatcctatactcttttaataagggcactaatcccaccaagggctccatcctcataatctcgctaaacctaattacttccccaaagcctcacctcctaataccatcacatgggggattagggctactttaacttgttaacttttaaggtcagaagtacatgtgcaagtttcttatgtaggtctcgtgttgtagggttagatgcacagattatgtcattacacactcttaagcccagtacccattcgctatgcttcctgatcctctttctctacactacaataggccccagagccacttgttcgcctctatgggtccatgcgttctcatcatttagctcacacgttgaggtgt

SEQ ID NO: 652895 - DNA, 296 bp, Homo sapiens
  misc_feature (74)..(74): n is a, c, g, or t
aggtcatatgaggattgtggttgggtgcgtcactcacttcattcgcagcgttaggctcagtttcgcccatttgntctgcgcgcacgcccaccgagttcagcgcatccagcatcaccgacgttctggttgcactgcgcgccttgaagcggccctcggtgtcgcagtcggggtcgtagaggccatcgttgtcctacgagcgcgtgctcagctcgcgaccagcgtgcgggcggtacttgggcgtcatgcgcgccttgagcagcagacacttggaggtcagcgtggagcagtcgaccgcc

SEQ ID NO: 652896 - DNA, 326 bp, Homo sapiens
  misc_feature (82)..(82): n is a, c, g, or t
  misc_feature (88)..(88): n is a, c, g, or t
  misc_feature (96)..(97): n is a, c, g, or t
  misc_feature (294)..(295): n is a, c, g, or t
aaacaagcgggttcagtactcagtgtgttccttatcccttgtagcatttgggataactattaaacactgcaaatataaagtngttttngttttgtnntgttttgtttttttaattggtgatcattttaataataccgtccatgcataatgttagataccaggagggaggaaatataaatagtaaaggtccacggcatggttcacttgcatttaaggaatttacttctcatcatatagacagattcacacctgaccatctatcacatttatggcatactcttgctgtatctagtnnagagggtgggggctttttgtagcaaggctgt

SEQ ID NO: 652897 - DNA, 1574 bp, Homo sapiens
  misc_feature (256)..(256): n is a, c, g, or t
  misc_feature (365)..(365): n is a, c, g, or t
tacagggttaagtaataaaaatttatggaaaattccggggtcgggggtataatctcttcccagccttgagggagggaacaacacgtggtaggaaaatctcacgtggaaaaatctcacgccaggtggtccccaaaagcccccagtttaaccacgagggacggagtagaaagtataattctccccagaaaagaggggcatagctctctcagctctttccttataatctccaagagaggggttcacagggacacaccgnggtgtgtgtggtgggcacccatctcgcatgtgcatcatactgtgggcgcgggggtcataggcgctgtgtgtcctgtggaacccctgtgtgctgtgtgctctcctctcanaacacactgtggcagaaaagcaaagattcacagcttatcctctgcgtggggggggtgtaggagagtatctcagtgggggggagacactataaagaagcgtctcaaatatctctattaatcacacgctgtgtgaagtgacgaggggccgtgagcacactatttcccgcctgttgtgtgggacacacacttttctcaaactacccgtagggagaaggggtactagagacacaacaagagcgtgtgttgctccagcgcccgtgtggcaaaaatataaaccacctctccagaactctctgtgcgtagacgtgcgtggggaagaaaatcggctctctgtgaggaagaatatattctctggggggggctgtgcgctccacacatctctttttgccagaaacattttgagacttgatacgcccaggggggcttccttggcaccagagggtgcgattcctctctcaagcgaccattcttgtgtgagcagcgcctctcggtggcccttcccacctctctcggcggcgcttggcgacaacatttttctctgggcccccgcgtggttccccggggcactttggggctttgtgttctttacacacggaacttttgggtcgcccccggtgtggggcccccccctgtgcgttggcgggccactttattgttccggcgcctatcatacaaaagcaacgcgttagtggtaacaatcttacggggaaaaaagagttccaaggctctcggactacatgcgccaaccattcatctacccaagggatagggcgggtaaaagactcttttggggcccatctcttgtgacaggatcccacgggggagaatcacccagaagaccaccttgaggccccccgtggaggcgacaccacggtggaacggcgttagaactttggggcacaccagttcttttatggagccccctctgcgacaacatgggcggcgaccacaccggtttccagaaatcaagcgccaaaaggcgggagaactcatcaaaagaagccccgcagcactggggtgggacaaacacaccaggggagaagaacccccatggagcgcataggccccacagggagagacctcacggcggcaggagaatccaaaagggcagggaccagagcacagagcgcccaccagatatccaccacaccaaacagcagtcgcgcgaacaaagcagcaggcaacaatcagcgacagctcaatcaccag

SEQ ID NO: 652898 - DNA, 233 bp, Homo sapiens
atgatattcggtcatgaatgatagggcgaaggggctgtggtgtattctgatgttgaatgctgagactagttctggatccccttctgcatggtcgaagggggtcggttgttctctgctagtgtggagataaatcatattatggccaagggtcatgatggcaggatgtaatcagaggtgtacttgtgtatgtgataacgggtgggtgagtgttaaatgtgagccacttacttagt

SEQ ID NO: 652899 - DNA, 96 bp, Homo sapiens
agcatcttcataacataaagtcaagtaaacagcacacgcttgagtgagtatgatgtaaagctgcacaggtattcagagatctagctaagataattg

SEQ ID NO: 652900 - DNA, 177 bp, Homo sapiens
ttattgctttgggactgctatgtgtgctgcttttcatcatggagagtggggcaaaggctgcgagactgtggtgtctgggaaactccgaggacagagggctacatccatgatgtatgtcggatagactgatgatccacagcggacacctgttaactactacgttgacactgctgtgct

SEQ ID NO: 652901 - DNA, 804 bp, Homo sapiens
tacagatgggaggtgagcgacgcagccacagctccgcagctggcaggtggacaggacaggccaggccgaggccaggccaggctgtgactccacagctcagatacagcagcagccctagcactgggcagcacaagccccgcactcagagcaggtagccctggtcttggaagacaggcccacactctgtcctgagttcatgttatgtgcccaggcgtggaagaccagggacagagtgtgccatgtcgacccaagtgacacccagcgtctggcacaataggctcacaacgcaccctgagaccaaatgtggaggacggaaaggtgagggacagatgaaatgatccataggattattcaacaacacatagaccgttgaatatggattagttgatggagacgaatgtttgagataaaagcaattatagaatgatttattacaagcattttaatgagagggggataattgatggtaaagaaactgagttgtacaaaagaaatagtaatcaaaaaatattgaaagcaaaaaaggttcaatattcgaagaacagtaccgacacacaaaaaacaaacaaagtcaaacctacggcaaggcgcgacgattactcagacaaagaacccgaccacaaagggtcaccacatcggacacaaacaaggacgaaccgagctagtacgaatcgtcaggaaacaagcaagcggccaccatcaattagtgcgaggagcgtagacatcaacagaacctagggaaaaagaggagcagcagagagagaagacaagacaacgaggaacacataagctgcgacacaaaag

SEQ ID NO: 652902 - DNA, 722 bp, Homo sapiens
gactgttcatctcaaaagctatacaaacctaggcaaagctatgcaaaaaagaagtagtttagatgtacagtagcccctcttatcaatagttttgctttccacagttttaattacccatggtcaactatggtcctaaaatagtaaatggaaaattccagaaataagcaattcataagttttgggccaggcgtggtggcttatgcctgtaatcccagaactttgggaggccgagggtgactgatcacctgaggtcaggagttcgagaccagcctggagaaaatggtaaaaccctgtctctactaaaaatacaaaaattagccgggtgtggtggcatgcacctgtaatcctagctgcttgggaggctgaggcgggagaatcgcttgagtacggaaggtggaggtggcagtgagctgagatcacaccactgtactccagcctgggtgacagaatgagactccgtctcaaaaaaaaataataatttaagttttaaactggtgcattcttagtagcatgatgaaatcgcatgctgtccagctccatctggcctgggatgtgaatgtcctcttgtccaatgtatccacactgtatatattaccctcccattagttacttagtaggtctcttgattatcagagaagaaaacaaaaaacatactatatatatgatccagtactatccgtggtttcaggcatctactggaggtcttgggaatgtatctccag

SEQ ID NO: 652903 - DNA, 324 bp, Homo sapiens
  misc_feature (222)..(222): n is a, c, g, or t
cgacagatagaatcgagccggaccccccgactagcccgacaggtctttttcatccgtttctctgggcacttgaagaaccctttcaatctggaaactcatgtccttctggagtttggagtaaacttttctgtatggtttatggatgacgcctctcctacatattctttttctctctggagcaccaattattcaaatattgaacacaccgggtttttttttggnatttttttgttttttgtttttatttgttttttgggggagacgcccgggggtatttttggggtgggggcccccaaaagaaaaaaaggtgggcccttccagagg

SEQ ID NO: 652904 - DNA, 139 bp, Homo sapiens
ccccttcgactagccggacagggagtggagggctgtaccaagtgcatcaagtacctgctcttcgtattcaatttcgtcttctggctggctggaggcgtgatcctgggcctcgactgattgcctgtcgggctagtcgggg

SEQ ID NO: 652905 - DNA, 153 bp, Homo sapiens
agtgtgtgatgggctcatggggatttgtaattctactctctctacttttttgtgttagaaagttcataataaataatgttgctcaaaggaagctataaatagttggaggccaggcagggtaaagagcatctcctagattttttattttttttt

SEQ ID NO: 652906 - DNA, 1001 bp, Homo sapiens
gattgttgatgttcgcagaaactctggtgaaaataccagctggtgttcaggttatcttgggaaattaattagaggcaaagcccaaattgttcagtttggcaacaaatgaaagggtgggccaaatctcgtgtgaaccttccaacgttagggggcaccatgtattggaggaacttttgacaggtgaaagccaccaggcaagaatgtgatagaatgattgaaagtacggaataccttacttcatgaatgctaatacaaagaaccagtagctcttctcacagcaaaagaaaagctgacgctggagaaaggttgctcttctgttgttacgcaaaaagtaagtattagataagaatgatatggttgaacttttgggccccagaccatttgcggaaaaatctacgtatgaagaatttgtggaaggcattggcagcttggatgaggacacctcacttcacagaaggccttaaggactggaaacaaggagcgggaaaaaggagataagaggagtcccccgggtgaagaaaagttgccaactagaggcccagagggaggccatctcagtactctccactgtgtgtttcagctggtgcattatttcagactgtggactttcagaagaatgggaatgctgcagctgattattagccagccaactggcccagctgaaatagatgagggaaaggagtccttagtcctttcagctctcagaggtcatcagtgggtggcaggtgactttccggaggaccttgagggaaatgcacactgtgccaccgcatagcctcaacttgggctcccagacgtgctggaaaggttgagcccagagtggccgaggctggaccctgtggcaccaagtggggtcggctgaccgtgtggcagggatcgattgcactggactcttggcgtgtgggaagggatgctttctctttgtcgcccactattcattcctgtttctcctcagttccgccttaaaacgatgggctgtaaatatagtttttttttttttc

SEQ ID NO: 652907 - DNA, 1277 bp, Homo sapiens
tggaaaaaaagaaaagttgagtaagaaggggaagacaaggctgggagaaggtagaagagacagtttgcaatattaaatggttgttcaagccaggcctgcctcattgaaagggtgaaatcttccttcactggaaggaagtgagggaattagtcaagcagctatctgaggaaagaacattccaagtaaagaatatacagcccatacattgttggatgtgtgtacattgaaatttttgtgcagtaaaatgaatatttcatttacctatataatcattttacataaaataaaatatattttgaatgtgagtttgttccaaacaaatcattttcttgccttcaaaaccactgagcttaaagaactctttcaagtgtcattagagatagattccaactacaatcaacattgtggaatccagaggaggcaaaatgaaggaagcagcactcattacaaaatgctgctttgtaaagaattaattctgtcctggtatgtttcacattaggtaatatgaaggaaatgaatatgtcatgaaccctccttgaggatgtgggggaattaaaagtaatttcgcttaatatccaactctcacttttggctttgtagtcagagggaaacaatgctttcccaggttctaaggtaaacgttaaaaggttacaaggagacttggaagagtcaaggaacgcttccaccaactattcctgccattccagttgggagggttgtctgaggggaagtgaaaaatagtttattacttactatatttttggtacaagatctgttatatttttctagattaaaaacaattcagtgaacactgatcctttaaaaaaaagaactcgaggtttataaaatgcctctaaggtgggggagtgggttagtggtaagaaaagcaaaactgtgatgcaattgttgaaaaagccaattattaaggcatcattcatggaactataatacctgatcctaaaagtaatatatccattatactttgcctcagttctatatgtctaactcatcaagttaatttctgagagctgcatttcttaaaagagatgttaaaggtcagggagatcgagactatcctggctaacacagtgaaaccccgtctttactaaaaatacgaaaaaaaaaaaaatagccaggtgtggtggcacacgcctgtagtcccagctactcgggaggctgaggtaggagaatcacttgaacctgggaggcagaggttgcagtgagctgtgatcgcgccactgcactccgtcctgggtgacagagcaagacgccgtctc

SEQ ID NO: 652908 - DNA, 326 bp, Homo sapiens
  misc_feature (44)..(44): n is a, c, g, or t
  misc_feature (251)..(251): n is a, c, g, or t
caacaacaaaggaacaaatgacccggtgtatgccaaaaatgccncagtatcaccaaccgttagggaaatgcaaatcaaaaccgcaatgagagagatcacctcatacctgttaggatagctgttattaaaaaacacaagataaagaatgttggcaacaatgtggagaaaagggaaccctagtgaactgttggtgagaatggaaattagtacagcctttatggaaaacagtatggcggttcctcaaaaaattnaaaatagaaccaccatttgatgcagcaatcccacttctgggtatacatataaaaaagagatgaaatctcgtgccg

SEQ ID NO: 652909 - DNA, 1694 bp, Homo sapiens
  misc_feature (25)..(25): n is a, c, g, or t
  misc_feature (122)..(122): n is a, c, g, or t
  misc_feature (254)..(254): n is a, c, g, or t
  misc_feature (289)..(291): n is a, c, g, or t
  misc_feature (296)..(296): n is a, c, g, or t
  misc_feature (299)..(302): n is a, c, g, or t
  misc_feature (309)..(310): n is a, c, g, or t
  misc_feature (363)..(363): n is a, c, g, or t
  misc_feature (382)..(382): n is a, c, g, or t
atgggcctgctgcttgtcccgcctntctctcccacagcccctgtcttttctgttcaatctcagggtaaccttctcccttgtcatctcagcctgagccctggaggctgggcctgcccactccngctccatcccttatttattccttccagcagggccctcttcccaaggttcgggccagcaggaggtgccggctggagtctccaccatagactcagtggcctggcctccccagaccccagagccaagaacacgangcactcgccggccttcggcaccctcgccctcccannnaaaanaannnnaaaaaannaaagaaaaaagagaaataagtaattggccgcgcgcctcccgtcagtccacggnactacccgggcctcccggngtccctcggcgagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaaaaaaaaaaaaaaaaaaaaaaaaaaaaaaaacaagaaaaacaaaaaaaagaaaaaaagaaaaacaaaaaaaaaacaaagagagagcggggggggcgcgccccaagaatctcctcccccggaggaggagcccaccgcaggacgaccgccccccacgtttgggaggaaagaagaggggggcgccaccacaaggagggcgagggcatacattaatataagagagcgagagcggaggcgcgggccgaatcaccacaaaacggcgaggcgcgcggggacaacagagggaggcaagaggggggaactctggggggcagaccggcggcacccacaaatagctgtgcggggggtcggccggagagaccaaagagaggggggcacaaccacaccacccacacacgagagataacacaacacagcccccgagggagggacaacacaccacaccctcacagagaggaggggaagagcgggggggacaacccacaaacgcgccgaaacaaacgagcgcatcagacgcggcaacagcagacacagtgagcggcccagcgcgggactaaacaacacacatcaaggcgaacccacttatatacccaggcggaggacaacaagagcacaaaaacgacaccgcaccaacagcgaagcaaggcagcaaaggaaagaagcccgcagccggacgcagagagagaaacacgacaaacagccaagggcggcgagaaggcaactaggggacaccaccacaggaaccaacagaaccagaacgcaacagcgcccccaaggcagagatctgagcgcaagtcagcacacgatccgtcaaacaaacacaagcaagccaacagcagcgatcagaagaag

SEQ ID NO: 652910 - DNA, 1714 bp, Homo sapiens
  misc_feature (25)..(25): n is a, c, g, or t
  misc_feature (122)..(122): n is a, c, g, or t
  misc_feature (254)..(254): n is a, c, g, or t
  misc_feature (289)..(291): n is a, c, g, or t
  misc_feature (296)..(296): n is a, c, g, or t
  misc_feature (299)..(302): n is a, c, g, or t
  misc_feature (309)..(310): n is a, c, g, or t
  misc_feature (363)..(363): n is a, c, g, or t
  misc_feature (382)..(382): n is a, c, g, or t
atgggcctgctgcttgtcccgcctntctctcccacagcccctgtcttttctgttcaatctcagggtaaccttctcccttgtcatctcagcctgagccctggaggctgggcctgcccactccngctccatcccttatttattccttccagcagggccctcttcccaaggttcgggccagcaggaggtgccggctggagtctccaccatagactcagtggcctggcctccccagaccccagagccaagaacacgangcactcgccggccttcggcaccctcgccctcccannnaaaanaannnnaaaaaannaaagaaaaaagagaaataagtaattggccgcgcgcctcccgtcagtccacggnactacccgggcctcccggngtccctcggcgagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctctattttcagatgttgctgtagaaataaagacggtttaaatctgaaaaaaaaaaaaaaaaaaaaaaaaaaaaaaaaaaaaaaaacaagaaaaacaaaaaaaagaaaaaaagaaaaacaaaaaaaaaacaaagagagagcggggggggcgcgccccaagaatctcctcccccggaggaggagcccaccgcaggacgaccgccccccacgtttgggaggaaagaagaggggggcgccaccacaaggagggcgagggcatacattaatataagagagcgagagcggaggcgcgggccgaatcaccacaaaacggcgaggcgcgcggggacaacagagggaggcaagaggggggaactctggggggcagaccggcggcacccacaaatagctgtgcggggggtcggccggagagaccaaagagaggggggcacaaccacaccacccacacacgagagataacacaacacagcccccgagggagggacaacacaccacaccctcacagagaggaggggaagagcgggggggacaacccacaaacgcgccgaaacaaacgagcgcatcagacgcggcaacagcagacacagtgagcggcccagcgcgggactaaacaacacacatcaaggcgaacccacttatatacccaggcggaggacaacaagagcacaaaaacgacaccgcaccaacagcgaagcaaggcagcaaaggaaagaagcccgcagccggacgcagagagagaaacacgacaaacagccaagggcggcgagaaggcaactaggggacaccaccacaggaaccaacagaaccagaacgcaacagcgcccccaaggcagagatctgagcgcaagtcagcacacgatccgtcaaacaaacacaagcaagccaacagcagcgatcagaagaag

SEQ ID NO: 652911 - DNA, 1755 bp, Homo sapiens
  misc_feature (242)..(242): n is a, c, g, or t
tgtctggtttgtttgccttggtggggtgctgtggtgagttctgtgtgtagggtggcggcgtgtggtcgctgctgggctgctgttgctgcgctgttgtgtgtatcttctctgccgtggggtgtgtgttctcgctgcttcggttgtgggtagctgccgcaccgacgtgggtttgtggtgggttgtatgtgtgtccgctgccgcactggttgtgctcgtgggggtgttaccagtggggttggctngtgtcgcctcttctttttagttgttcgctcccgatggttgtcctcccaccacagaggtggtgtgtttgtggtcgctccgttgagagatatttgtttggcttctttgtggagctcccccgcgcgggtagtgtttgttgtagtgggggttgctctgccgtgtgtgggtgtccctcgcggggtgttgtttcgtcgtgtcttgcggtggttggttttgcgctcgatgcccttcggtggggtgcgactcccacagcagtgtgtggtggtttgatgtctcctcctcgtcgttggtctgtcctctctgagtgaagttttgatatgaagggtggttgtgtgtcttaagtatgtaagcaccccttcttgtgggtgggagccttgttgtatcggccctgtcgtccgtgttcgtttgttagtagctttttcttgttccacacactttggagggaaggtttgcttccttattaaaaagagttgctgtctttttttgtggaagagtttgttttccctagggagaggtgaaaattttgtgcgcactaggatcctcccttacttcgtatggtggcggttcctctcattttgggggtaaatatgctttggtccaccactgctctggtatgttgggcgcacctaacaccattgtctgcaggaagtctccaaatttgctgcatagttgtcttctcctcctggtaggggtcctcccccccctgggtcttgtgcgtgttttgtgagggagcgtatctatattttgtgcgctctctcacgggtacacctctgttagacgacgggtctgttattgtcgggagcgccccacagatattggcgctcactttcgggggacaatagcgctagccgcactattacagggccacacacgagagagactgtctctatactctcatacagaggcggcagttgagtgtgagagagttcaaccacccagaggggtgcgacaccctactctcacagaagtgcgacacagtgttatgaagaccacccacgagaggtctcagtgtgtgtgagagagagagcgtgtctctctgtggtctcaaaggacacacgcgtgttaacacgtggcgggagtgtgtctccaacagaccacacccgcggtgtgggtcacacacagtgccatccacatgtcaatagagtgtagaggaacctgtctgagtcttgccttgtgaggacacatcgggagagttgtcaaagcgaacacacacacggaaatatgttttgtggagatgtgccccatacccagacatttcgagcctgtctatatttcggttactgaagagttattttttctgtgatagaactagccctaaattctccaggttgctaaaccagaacacatgtgtccacaaggcgtgactcgcaaatgtcccctcaagaagaaattatcccttgccccatggtggggtttgttacccttggtacatgctcgtcaaccctgttatccacccagaaaatgtcccatgtgaattttttacaaagatccataaaatgccagagaaacgaatgt

SEQ ID NO: 652912 - DNA, 314 bp, Homo sapiens
cctcacaactgcgcccgcataaggcgccgtggatgttgcgtggagagcaccgggcgccacaatctacttcacgctgcgtgcaccgaacgggggtggccgaggatcgatcttccagctgtccccatggcacatatccctggctctgggaacgctccacgactcacggcttagtgtccatgggtcaacgattcaaagaatccagtcatggccagtccacgcatccgtgtcggcgcaccgtgtcagagtcctactgtgtgaccggcgcgacccgtcgctgctcactacaacccacacggggccgctagatcgtgtgc

SEQ ID NO: 652913 - DNA, 820 bp, Homo sapiens
ggagagaactgtctcgcgtattattctttttttttttggaagtaggcaaagggcccatatttttaaaaaagtctcttaacatatgtccatcaaaatctggcaataaatacataaaaaccgcgaggcgccacccgtgcacagccccgccggccgggcgccgggaaaagggtgacgcgggacaacaaactatacggggtcagcggaagggcgtgggggacggcgacagaaatggcactaatatagacgacaggagcgtactgcaccacagccggagcccccgatgagcgcggggcgccccgtgacgcccaccgcagggggctaccccagaaaagctcacacaaaacgacatccgtgggagagcacacacccagggataatcacacaggcgactcacaccaagggggatctaggagcgcccacaactcgtgatagccccttagtgagagggcgaatagccacaccaacgtacccccacaaagacacaagacacaaccacacgggcacgcaccccattcgtccatacccaatggggcacaccacaacgccgcgcccaccaaagcagacaagggcgacccccgtgaccacaaccgaccccacccgcggggatcccccccccaaagaccgtggtcccccgagcaacgagttggggcacccccccgcacccaacggcggcaacgtgaccaccacaagaaggatgagcacggcgccccacagagcagcaaccgagaccacgcccacgacaaacggcaccaacgaggaccgaacccccaaggtacccacccaaaggagacgacccaccgcggcgaagcccacaaccggg

SEQ ID NO: 652914 - DNA, 247 bp, Homo sapiens
cttggggccaaaagggcccttttttccagggggaccggggggtccccccctggggttttttttcaaaaggggggcctttccaaaggggaaggggcccctttccctttttaatggtggaacccaaaggttttctttttttgggggacccttttgcggggaattttcccgccggtttttttaccccgggtcccggttttcccttttttttacccccccgggtttttcccttttaggggtttccccccca

SEQ ID NO: 652915 - DNA, 546 bp, Homo sapiens
ggcaggtgtcacccaggagccgccagatagcggtgaggagcggctgcgctacaagctaccccagtgtaggcctgcgagattctgacctcagatagtagccccagatacaatagatagccctagggtagctagatagagtacccttactagaaccggctctacggcttcctgcagagcaccggcagcctcaacccactagctaggccagcttcttcagcaaggtcattgggcatcctacatcaatccgtccaagcacagaccagctcgctgtcctattctatcgcgacacgacaggatgacttccgctggcaccttgcttgcctgccgtccacctctggccacctcgcgcccatctatcggaccctctcttgcctgccgccctgcctctcaccttgctgcctgcgcagccgggccctccaccttgcagcgccagcggatgctctgctcccccttggcttccacccgagggagcaagcactcgtccccgccggcctgccctcgcaccaccactccacccccctcgcacgcgctgcccactcccccctc

SEQ ID NO: 652916 - DNA, 909 bp, Homo sapiens
  misc_feature (9)..(9): n is a, c, g, or t
tctgtctcnttgtaataaaaatgagaacgacatgtatattatcatcatatgcagtacagaaccgacccaaagcaatacacctcatgtgccccacaagcgcccgtgtggactccctcgttggacaataatatctgtgcgcaacaattgctgttccattctcgttaacacactcattccctcctaaaaatttgtgccccccgttcaattttgtttcccccccgccggcacattttatgttcgtgccctcttgccccgacagactttgcttgtccccaagagcgccactggcctttgttacacgccttccctagcattgcggtagcaaacaagtgctgcttgtggcccgctgccatacgtctgataaaagggggccattgttctaatccatacggggagttcctaacccagcgtcgccccacttccgccgggccccccttagtgccaatggctgcccccaacgcctttcccccgatgtaatatcactgggggtaatgataacctggtctgtccgcccaacgaaactttgtttggcctcattcgcgagtaggcccccacctcattgctctggagctcctccctatggactaacacccacatgctcacctactcttatactacataggggcaattaattttctttcagtagcacgaaatcttatatcttttcttctagtgatgagcccttctcatccaacgccaaacacgccttactattcggagaaccccctccctatactccgtggggctctaatatcatgatgccgcccccccacctgccactaacaacttgtccatggaccccgtatacaacacttcaaacattcttatacccaaagaaaggtacagatggaaccccccccacggggtttagcccaaaccagggcccccctaattttccccacaaaaaca

SEQ ID NO: 652917 - DNA, 290 bp, Homo sapiens
  misc_feature (23)..(23): n is a, c, g, or t
  misc_feature (48)..(48): n is a, c, g, or t
  misc_feature (59)..(60): n is a, c, g, or t
  misc_feature (275)..(275): n is a, c, g, or t
ttttctcccacaaaaaggggggnggtggttcgcgactgtaaatagggnctttgggaggnnaaggcgggcagattgcttgaggcccggagttcgagaccagcctggccaacatggtgaaaccccctctctactaaaaatacaaaaattattgggcgtggtggtgcacgcctgtaatcccagctactccggaggctgaagcaggattattcgtttttttcgatgttgtaactgagggagttatagagagaactttttttctgcagatactcagcagncctggattggcagcg

SEQ ID NO: 652918 - DNA, 200 bp, Homo sapiens
gatcctgagctctgtccagtgacgcccagcatactgcgcccgacggggtcagcagcgcgtcatggtctattcaggcgctgttgggctctggttcccgtgatctccgtgtcccgctccaccagtcttcagggagcggcatggggtccgggtgcgcctggccaccggcgatagccggggagtctggcagagacatgggaggc

SEQ ID NO: 652919 - DNA, 320 bp, Homo sapiens
caggtctagatttgagagagacgcttttaactgactgccccgcatcaccggaccgtcccagctgcaaggagtgtaaacaggaacatcgatcattagtgtacaaacttgcacaatgaaatcccaaaccaaggatggaaaggaggaaagcctacagactgctttcaaaaaattaaaagtggatccatcagggtctgtactatctttgtctgttgaaaaaggcacaggtttcaaaccaccaatcaaaacaccaacaaatgatcccaaacctaaaaccacatgttcatctaaagactgttggcacgtatctacaaggaattctt

SEQ ID NO: 652920 - DNA, 879 bp, Homo sapiens
gcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaaaacttagaattgggatccttgggtcgggttctcccaaattctttggaggtgtccagggtcaacgggttcagcttggtttgggcaacccctgttgcccgaagtcgcatataggcggttcttcacctggtttccaaggctgaggaacagaaagtagcctctgtttggaggaggtggaagttaagtatacatttattttttacggtgactgtgttcaggaccacattttacaaaatgcctggtttccttcatggtttctgggaaaggaaagttctattaatatggttttacttggaatatagaatagtttttttaaattagggcttatttggaaaaattcggagtttaattcaaatgtttgccaataccttccaaagtaggtaatattcagagaaagttgtgtgatcagatgggttagagaaattttggaatattcacattcgaagattcttattatgaatgtcttgacttaatttaccaaaatgacatatcttgggcctttcattatataggtacaaagttaggtgcaacaataaattgtaggtattaaaaaagagaaattcaatgaatctatagaagagagagtaattaaaaaagcaaatgcatccaaaaaacaaagggggggggtatactcggggagataaccattgtaaggccgagtaaaagggggagaagagagaaagggttggcctgtggagacccacccaatttttggggtggtgatcttaattgt

SEQ ID NO: 652921 - DNA, 429 bp, Homo sapiens
gccgatgcgcgcgaagagctccgcgctgccggctggagctggttggacactcgcggccacctacggctcgccgccaatggactgctggtagacgcgaacgtgccggctgccatgcgcgcgccacgccggcgcgaaccgttcgccggtcaagttggcatcgaattagcgtcagccatgctgctcacacccgaccgcgtggtctccattcgtcccctcgccacgcagatcgaccgcgcccccagctcggtatccgacacgattgccgcgttccgcgacgccaacctgatcactccggccgggcaccctagaacaccagagctcttctgggagttagcgtcacggtggaagcccaccgacttcgccgtcgcaaatgagccgcgagagggtggcctgcttaatgcactgcggatgaatctcgacgacttcgac

SEQ ID NO: 652922 - DNA, 482 bp, Homo sapiens
aagaagaatagagagataaggatgtaagtatacgtcggattatatggaagagtcaggaaatatataggagataaggttataatagataaatggtctgaaaggatatatgagctatcgtgaacacaggtatgatcaggagagggaaagctggaaggcggataatggagggagggcaactgacgttttactgtatactcctttgtaccatgtgaatgtattaacctattcgacaattagtttagaaattttttttgaactattcaaaaggtatacattgtccttaggggaaaggtgtggtagaatttatagaagaaacaataaattttgtcccaaacccattatccttcccatacccactctgtaaggccactgctaacacagtctctgagcctgacctgacccaggcagggccccaaaagttctgcagtactggtcttgcttcctcaagaaaaacaaatcctctttctgagtattgtataaag

SEQ ID NO: 652923 - DNA, 1234 bp, Homo sapiens
  misc_feature (69)..(69): n is a, c, g, or t
  misc_feature (73)..(74): n is a, c, g, or t
  misc_feature (77)..(77): n is a, c, g, or t
  misc_feature (79)..(79): n is a, c, g, or t
  misc_feature (82)..(84): n is a, c, g, or t
  misc_feature (127)..(127): n is a, c, g, or t
ttattaaaagaatgtttcattaatgcattgataagaaaactaggttagttgcgagggatgtttctggtntcanncananaannnaatttctactgctactaccaagaggactggctcagtggtggcnaaatactggtgatgctccctagagcaggaggcccggaagtctgacgcagccatcagcctgccaagattgttttttaatcttcacagtgttttaaagaacatgttaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaatttccaaagtaattaaaatttttctggagacaaacaaaaaaaaggttggtcttaccatattggattaaattaaaatttactccttaccatttttcttaaagggtatttaaatttttaaagtgggtccccgggggacgtattggtatgatacccataattggtatattttatggtacgaattcaatttttttaaaccaggtacccaattatcttttttggaaaaaattacctttttattggttcttttggtttctaccaatcatttggtcgaataatttggaagtccataatagcgatatggataatggtgggaatggtcctaaagtggtttttattaacctggactttattttaaaccctaacggagcatgtatccagtctacctttccatccagtgggggggagttctgcggaagaaattaaacctaccctttttaattttcaaatcttagccaaagtgtttctcagcggtttacggttccagtcggtcgcacagcaacttcttactaccccttctttaacatctcacctggaactggacaccgagctcccttggtaatataatttcgggactaatttcaccgtggtggcactcttggctctgtgtttcgccgacaattgtgccgcagggcttcaagatataccccttaacactctttgtggtcaccccgggaagcgcaaatgtgttatatcggcgagcccgaagcttaaaagggggaagccttgggcctgaacacggcaaacggccttatggtggttgtcacatacacggccgtggggctctccccgactttataaaacatttgtgaaccatttgggcactaaattaataaatcccctataataaaaaagcgccccaaaaattacgc

SEQ ID NO: 652924 - DNA, 160 bp, Homo sapiens
atgcacatctgagatgcatacaacaactgaacgatctcatcacggaaagatcatctgagatgagctgagaggacgaggctactccatggccaccagacacagcatctgcagataggatggttctgcatcacgtcccggatgatcccaaattcatcgaaat

SEQ ID NO: 652925 - DNA, 148 bp, Homo sapiens
gaataaaagggtcctctaattgggtataatccaccttgggttggccaacggtggggccaccggctacttcaatggaaaccagaattctcaagagagcgggattggggggcaattaatgattttttggtgaacctggggggacgttaac

SEQ ID NO: 652926 - DNA, 269 bp, Homo sapiens
ccccaaaagaaaaaaaaagaaatattaaaaaaattataaaagcagaaatcaacaaaatagagaacactcaaataaaacaaagaaaatattaaactggctctttaaaaacactaataaaatggacaaatccatcaagactgacaaaggaaaaaagagaaaattttaagcaaaatgcagaatgaaaaagaattatgaacaatcaatgtgataacaatggatacagttctggaaagagtatatagtgccaaatgtggtaaaagattaactca

SEQ ID NO: 652927 - DNA, 638 bp, Homo sapiens
  misc_feature (38)..(38): n is a, c, g, or t
  misc_feature (95)..(95): n is a, c, g, or t
  misc_feature (101)..(101): n is a, c, g, or t
  misc_feature (112)..(112): n is a, c, g, or t
  misc_feature (169)..(169): n is a, c, g, or t
  misc_feature (220)..(220): n is a, c, g, or t
  misc_feature (321)..(321): n is a, c, g, or t
  misc_feature (335)..(335): n is a, c, g, or t
  misc_feature (344)..(344): n is a, c, g, or t
  misc_feature (357)..(357): n is a, c, g, or t
  misc_feature (600)..(600): n is a, c, g, or t
acataaaatcatatcaacccttttagataaatacaaanggacaaatgaaatacacaaaaaacaatatattttaaaaatccactgttagtttttanaaaaanatttagcagtntccattaagcactacatcccactattgcgcatttttaggaaggacagatggcttganggcgcataggttagcgcaggctgcttgtttggtctttaaaaatggcaagtnagtcggctaagcattttgcaaataagatttgcaagcataagctgctgagcaatggcgcagcaggagcagcagcagtttgggctccatgtacacgtaccctngggacagttggcantccccaggnctgctggcgcatngccaagatcagggccccaagggccattgcaggcaccagggcacaatgctcctggctttgcctgacaactgggcctgctttgcttatttaccttagtaggccttgccaggtaactgacactggtgtttgaacgcttaactttgcacaaagcttgtttaggcaaataaaatatgtgcatactgatgctgggaattttgttactaattttttgcgcgcttaagttgcaaataaaagctaaggagtngataaaagggctattctgaacagaaaagtaaaagccaa

SEQ ID NO: 652928 - DNA, 132 bp, Homo sapiens
aagagccaatcagataatgcctcattaccctgtgactataaaacctgccccaactcccagttcaaagagacagatttgagtgttttctcccattttcttgccaattggctcacattaaacctttctcactgc

SEQ ID NO: 652929 - DNA, 202 bp, Homo sapiens
cccccccccttttggggattttcccccccccttttttttttttcccaaatttttttttttccacaaaccttttttagtttttttccttcaaaaaaaaaaggggctttccctgggggggtttttttttgaaatgggcaatttttttttttaggggttttaaaacccccccccaaaaaaaaaatttgaaaaaaaaaatttttta

SEQ ID NO: 652930 - DNA, 914 bp, Homo sapiens
caggtcccacgctttgtcatctctgcctaaatgttagcttctccatcctcaccacatgatgacctgctgtgtccctctgattactatccagtggtgaaaactctgcgaatgggccacacttttgcaaatatactggtatctgacacttaggtcttgttggaagaatttcctttctggaaggtgtttacaagaagactgatagattctttcgagcccccgacatcacaggcttagggacggcacgtaactcactcccaggatctaactgggtagttcaaattatcactcttttaccttcagtataagcagtgtctcccccaaatcttgtgtcccttcttgtcacttgtgatctgctatagcccctgtgtcattgtcgccgcatagttcgtagtctttattttcgcaatcctatctttctaatatgtgctgtcttcaacaaactgtgttctgtgtctgtgctccatcacttccctctcaagacactggaagggcaagtccttcttccctttggaatgtactctggatcccttctcgctgctttgagcgcccagaatttgtccatctatgattgcttctccatcctggatcttgacatttgtcaaccccatctgggcttcctcaggtgccatcagtacaaatgctgagaactctggggtcctatcctccatgactgagattttgtcaagtggtagcttatcaactgcctttccttcactggcttctcctgatccatggagatggcttcctccactctctatctaaagggtttccagatacactgagggcccctagggccagtgatggcctcgagcccgtcctcccccttgttttgtgcccccggtagaccgttacacgcacccgggcttacgccgcaatcaagaggggccacaccatcgcctaaccccagcgactcc

SEQ ID NO: 652931 - DNA, 891 bp, Homo sapiens
taatggcaaaaaccacaattactttggcaccaacctaatatttaataatgggagttaaaggccgggcacattggctcacgccgtgtaatcccagcatttggggaggccgaggtgggtggactcatgaggtcgggagtcgggatcagccgtggccaagatggtgaaaccctgtctctactaaaaaatacaaaaaaaattgggccgggcgtgggtggtgggtgcctgtagtctcagcttcctgaatggctgggactgcaggcgcgccacacgctcagctaatttggtattttaagtgaaatacgaaaattagttttagcgaaacgggttctcaccatgttgggccaggatggtctcgatctctttgacctcgtggtccacccgtctcggcctcccaggtgctgggattacagacttgagccaccggcctggtgaacagttacaaaatcttaaagcaaccagtggttgcgacactttatctttacacaagcaagaaaacggctgggcgtgatggctcatacctgtacccagatcttggaggctgaggcgggatgattcctgaacccagggagttttgggacccggcctgttacgtatgaaccttgtcccagtcgcacaattcgttccttattaacaacaaacgcacggcagatgtaactacctctatattcacagggagccaaaatgctgacggttatgccaagaattggccatcaacggttcagagagtcacctctcaaagcagaggacattataccgccaggaatctggcaggatcgtagtgagaggcacacaagacaggggtcgtccacattaatcgaggtggcctcctacatcaagttgctgtgtctgtgctgtcagtctgtttttgtgatctcatgagcacgcaaaaaa

SEQ ID NO: 652932 - DNA, 895 bp, Homo sapiens
  misc_feature (41)..(41): n is a, c, g, or t
  misc_feature (44)..(44): n is a, c, g, or t
  misc_feature (103)..(103): n is a, c, g, or t
  misc_feature (115)..(115): n is a, c, g, or t
  misc_feature (126)..(126): n is a, c, g, or t
  misc_feature (131)..(131): n is a, c, g, or t
  misc_feature (134)..(134): n is a, c, g, or t
  misc_feature (141)..(141): n is a, c, g, or t
  misc_feature (148)..(148): n is a, c, g, or t
  misc_feature (164)..(164): n is a, c, g, or t
  misc_feature (177)..(177): n is a, c, g, or t
  misc_feature (184)..(184): n is a, c, g, or t
  misc_feature (186)..(186): n is a, c, g, or t
  misc_feature (216)..(216): n is a, c, g, or t
  misc_feature (226)..(226): n is a, c, g, or t
  misc_feature (245)..(245): n is a, c, g, or t
  misc_feature (248)..(248): n is a, c, g, or t
  misc_feature (258)..(258): n is a, c, g, or t
  misc_feature (278)..(278): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (299)..(299): n is a, c, g, or t
  misc_feature (304)..(304): n is a, c, g, or t
  misc_feature (322)..(322): n is a, c, g, or t
  misc_feature (325)..(325): n is a, c, g, or t
  misc_feature (334)..(334): n is a, c, g, or t
  misc_feature (339)..(339): n is a, c, g, or t
  misc_feature (343)..(343): n is a, c, g, or t
  misc_feature (345)..(345): n is a, c, g, or t
  misc_feature (357)..(357): n is a, c, g, or t
  misc_feature (359)..(359): n is a, c, g, or t
  misc_feature (363)..(363): n is a, c, g, or t
  misc_feature (375)..(375): n is a, c, g, or t
  misc_feature (405)..(406): n is a, c, g, or t
  misc_feature (412)..(412): n is a, c, g, or t
  misc_feature (432)..(432): n is a, c, g, or t
  misc_feature (435)..(436): n is a, c, g, or t
  misc_feature (453)..(453): n is a, c, g, or t
  misc_feature (463)..(463): n is a, c, g, or t
  misc_feature (467)..(467): n is a, c, g, or t
  misc_feature (475)..(475): n is a, c, g, or t
  misc_feature (493)..(493): n is a, c, g, or t
  misc_feature (503)..(503): n is a, c, g, or t
  misc_feature (509)..(509): n is a, c, g, or t
  misc_feature (511)..(512): n is a, c, g, or t
  misc_feature (519)..(519): n is a, c, g, or t
  misc_feature (531)..(531): n is a, c, g, or t
  misc_feature (539)..(539): n is a, c, g, or t
  misc_feature (542)..(542): n is a, c, g, or t
  misc_feature (544)..(544): n is a, c, g, or t
  misc_feature (552)..(552): n is a, c, g, or t
  misc_feature (555)..(555): n is a, c, g, or t
  misc_feature (559)..(559): n is a, c, g, or t
  misc_feature (563)..(564): n is a, c, g, or t
  misc_feature (876)..(876): n is a, c, g, or t
ctctgcactatgtcgggtggcctcctgaaggcgctgcgcanganctcctacgtggagctgagccagtaccgggaccagcacttccggggtgacaatgaagaanaagaaaaattantgaagaaaagntgtangtnatatgtnggaaatntttctttttaaaaaantgaagaaaaaatntatgaantnttaagaaaaagtggtgaaataaagaaaatnattatgggtntggataaaatgaagaaaanagnatgtggattntgttttgtggaatattaatnangngnagatgcggaaaaagncatgnggtaaataaatgggaagngtntggatgaangaatnattngnaaagaatgggangnaggntttaaggagggnaggaaataaggaagtgggagatatgggggnnaggttngggatgagtataggaaggantannatgctgggagaggaggntatggaaaantggnaaagaaanagtaagtggtgagaaaantgtaagtaanaaaaantnntttggantgttgaatttgntgaagaanatnanctaaagtntgnacangagnncatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacactttttagaaagacagaaaaatgtaagaatttgtttttaccataatgagtcttaagtaggttcatgatctacattggggcctgggattatttttttnattttaagtttgcatgaga

SEQ ID NO: 652933 - DNA, 922 bp, Homo sapiens
taaggttggagggggaatgctggaaatggtaatgggtatggaaacttgtcatataagtaatgctagggtgagtggtaggaagtttttccataggaggtgtatgattgggccgtaccggaatcgggggtatgctgtccgaattcataaaaacaggggaggttagaagtagggtctgggtgacaaaatatgtggtgtagagtttcaggggagagtgcgtcatatgttgtccctaggaagatggtagtggtgagggtgtcactcataataactgtggtgtatcggctatgaagaatagggcgacggggcctgcgcggtatcgatgttgaagcctgagactagtcgggactccccttcggcaaggtcaaagggggtaccggtggggccctcaggctaatgtcggcaaaatacaatcatcatacggggccccaggggtcaatgaaaggacagagagtacaaacaagaggggggtccacaaggtccacgcgcacaacgggacggaccagcgtacaaaggaagcaacaacataaacaacatgcgacaactcaaatgaaagaataaaggaagcatcaacactcatacaacatcgacacgcacgaaaaaaaccacgacaaggcacagcaatcacagcaaacaccgagatatgaagaacacccacaaaaaccagaatgagccaaccgaacacagaacagacaggcggcaagaaaaataagagaaacgccaacgataacgaacaccaaagagcaagaaaggcgacaaggacccaaaacaaaccaagacaaggacagaaaggcagagagagccaaaaacccaagaaaaaaaaagaaagagcaccaacaaagaaacagaaacaaacagacacaacaacaaacgacacaacaagacacacacaaaacagcagaagaagaacagtagagccataaag

SEQ ID NO: 652934 - DNA, 688 bp, Homo sapiens
  misc_feature (99)..(99): n is a, c, g, or t
  misc_feature (115)..(115): n is a, c, g, or t
  misc_feature (125)..(125): n is a, c, g, or t
  misc_feature (164)..(164): n is a, c, g, or t
  misc_feature (597)..(597): n is a, c, g, or t
  misc_feature (614)..(614): n is a, c, g, or t
ctgacgggcacagaaatgggggacataggtgctctcaaggtggaggtaactctctccaattgctttctgggtaatgaaaaggaatccaaataggtgtcnggtcatctgtgtggtngatttctgcngtctccctttaaagactgtaactgagaaacaaccatctntccacctttgcaataccgttcttttacagggcacttactgtccacataacacaaccaccaacatttaaagttcctcaactacattttccattattctcatggtttatctagaaaaaagctggtgaattatacatagataatcctgttacaccattcaggctgtcctgagccatcacttacagacaaagactttatatactattatatttcatttcactcctgggggccacattgccctctaccctctagtccaaggtatagctcttccctgctcacttcaggatactttctaggctctctgcctttcaatttcaattcaggtgaggctgccctcctagcaggttcctaacatccggtgctatctagtctccagcactggggcagctctcttcaatcaccccaggcatccaactctgtagtctggccttggaancatcccctccagcctgnttctcatgtgctgcttctcaggggatctttgttcccatcccactgaatctcacatattatgttatttcttctga

SEQ ID NO: 652935 - DNA, 169 bp, Homo sapiens
agctaaggcgcttgttggcagtgctctgctgttaatgagaaaagtaagaggagatgccagaaacatgcccctataaattcagccctcacctggacaatgttgacaaacaggtcccaaagcctggaagggtagtactacaaatgatccaccaaagcaaagacctgggtcc

SEQ ID NO: 652936 - DNA, 845 bp, Homo sapiens
agcggagggggaaacagacgccggcgctgacagggccgtcaggccctccgccgcgcggaggccacctgaaggggacagagctagcctggcccaagtctcgggtctccgggggcaccgagcccttatgatctccgtcattgcaggtcccccatctgcccactggaacttggacgtaatcagatctgacgctccagaacctggccagcataactcgggagggccgcagctcccccgccacatccagtcaagatgccatatgcctcggagatgcatactggtgtccagctcgtgatgcatctctcaatgcgtccgttcccgaggctggacctcacaggtccgagatgatcagtcgccccgctgggtcgtacttccgacatcatcagtgcgatgttggacgagccggatacgcctttggggacagctctcttcctcaatagccaggttggcgagtccgatgacaagtccttggacgaacagcgctcttcttcagtcttccaaatcgcagccgccgtgtaccaaggatagagcccggggctagcaaagcggtcacagacggggcgccagaggggagagcgggagcagcaggtggacatgcgggggctccctgcgggactcggccctgtccgtacaagaatgccacagtccctgccccagcgcaatgagaaaggagggccgaggacgaatggggcgccacgtaggctgtcgcacagcagcctggtcgtccacgcccccgacgaacgaacggccaactgacggggacggggcggcgacgctgaggccacggccagggaggaaggcagagaccccggcggattagggccgcggtgcactacccgaacacgcta

SEQ ID NO: 652937 - DNA, 704 bp, Homo sapiens
agggtggccccttccggctttgaaatcaccgttgggtccctcataaattcaggcccagcatgagcgggaaaattaaggcgtaggaaaccgggctcctgttaaagtttgcacggaaggttctcataattgcggacgtgactaacctgggcagatctaagagcgtttcatgtcgtcgaccattggagtgctcgcgctcatcgcatactgtatcgagcaggctcgaatgctatcaagcaggcagatcttgatcatctatcgcctatgttgagatctctgtaagctgctgacagcatggaactactaactgacttcattgagctcaagccagtcctggtctcggcaatgtcacgttgcgcaggaccagtttagggtctcgagtcagcagtgcatgcgtggatcagtcttcagtatgcaccttacatctgtttcatgcccaaactaacagatctcttgtacagaatccaacgcctctagatgcggcttactccacatgtccttggcctaataagttacactatgccggtgttcatcatgtaagtcagctccttgtgctgcccgttgccaatctgatgcagtctagtcgattaccgaatccatagagctcccatacatgggccctgtagtcctgactcaagctcctatagaatgcgacacgcctgcacagcatcctaaaatggcaagtctaacagacgcgtacatccgag

SEQ ID NO: 652938 - DNA, 273 bp, Homo sapiens
ttcaggtaagcaaaattttactactggggttatgttccctttcctcctttgattaggcctgtcccttggatgggctcccccactgaagtttttaccaatggtagtatttggatgcctgggcccactttttataacttttctgcatagccttaggaggggggcctgtttattaatgggataattggggtttaataccctcccgttttttttgggattggttctggatgtttgccctttccaattcaaagttgggtggttttggttcctccccca

SEQ ID NO: 652939 - DNA, 843 bp, Homo sapiens
gagtcgccgccagcgggcgctccccgcccaccggcggctgggctctggggctctgcgcactgacttggggccggcgcgggcaggcgggcatctggcggcgaggccgggacttcggggcccctcccgggcgagtcgcggggcggcggcgggaaggggcgccgcacggaggaagtgccctcttggccgcagcagagccgcgcgcaggtgccgcgatgtcgtcctgccggggcgcgaggatgcgagggctgggggcgcgtggtggccgcggagccgtggatcaggagctgccaggggcccgggagcagaagcggggggacgacgccccagaagtgcagcagctcagcgcctggaggtcttaaggggtctcccctgttggccaggagcggtggctcacgcctgtaatccaggcacttgtgagaggccggggtggacaggatcacgagtatgaaaaaccttctcctgggcttatcagggtggctggcaatggtcggtcaccgacaggttacaaagagtgcctttctttatcaagacacccatgttccaccgttcagagtagccctgagatttctgtgtgacatctacgagacataacacctgaagatggtgatcgccgtcaacagtcgcggatttactccggagatagagcggtcagtcctgagtagagcaaccgaaagaaagaagaacgttaagggagacagaaacgaaaaggggcattcgcaaagtggcacaggaggggggttaaacttcacgccgcagagaacgaacgaaaccagattgtgtgccccctgtgaaagcgtgttaaattccttctcttctcgttttgcttgctatcttcctcccggg

SEQ ID NO: 652940 - DNA, 358 bp, Homo sapiens
cctcacagtgactctgtaaggaaggtaaatgtcattgctccccgttggtggggaacacagagcccagagtggttaaaagtttggccctaagtttaacccaaaatatgaaggctcacttggcctacaggagagaatcctccatacacaggccatttaaaaaaaaaaagaaaaaggttgagccaccctgtcactcttctctcagatgccatgaaagccttcttccacaccgtgtccctacatctcgtgtggaatattataagagccatatctctttttcactatggccaagagagaatatatgaagctcacgtgagtgtctgcacgagcacttccatatatatatctgatgcgatgtgag

SEQ ID NO: 652941 - DNA, 446 bp, Homo sapiens
gatatgtctgtcgccagccgatgcagatgacgtgatcttggtcatgcaaactccacctcccgggtcaggcgatatctcatgcttcagacctcccgaatagactgggacatataggcgcccaccaccacacccagctaatatatgtatatttggtggagacgggatttcaccatgttgaccaggcaggtctcaaacacctgaccttaagtgatccatccgcctcagcatcccacagtgctgagattacagagtgagccaccgaacctggcctcatgtctatgtcattacctacggctttccccctctttctgcgtatactacaacacaaaaaacagaatgaatccgactctgtataccattatacatgatgggaaactcagcttgtatgacggtaggtatacaggcacaattagcaaatattccttgatagtacaatgagtttgcag

SEQ ID NO: 652942 - DNA, 1529 bp, Homo sapiens
aaagtgtaatatacatttaatagcacattataaagttcctgaccaaagacgttgattccctaatttataattaggcacagaaaactccttataaaattataggtaaagcgtaattaagaactatctcagaagttaagtgaaaaaccaatagtgataaaaacaaaaatcctccagtaaagagaggaaccgtggtccattgtgagaagaaaactcacaatgtgagaaacttgtgcaaagtgagacacagagggaaagcagtggcaatgtgggaaacgtgcaatagaaaatacactatagcgagaaacacaaccaatttagagaaagtttatcagccagccaactagagatattataatatatctcgtgacagtgccacagtggtacgaggtgtgcactcttcttcattcattacacaacactcactcaaaagagggtgctatatagtggggatttattcttatactctatcatacatttataacccccgccgacaacgagcgcatctcttatatataggcatatatacacttctataaagtggggagattttctcttgtatactatctcgtgcatatacgatctcaattataacacagcgtggcgctataaaacaagcgtgtgtcccaacagtggtgctgtacaacatgtccatatacagacaagagcaatattttatcagcatgttctgctacaacgaggaatattacagacggtcgttaccacgaaacacagagttgtggcacgtgacaaggctcttatctgctacaaaagagcggcgttacatcaacacgcgtggcaacaaaacgaagaaagcggtccccagggtgtaggaacagtaccacaaggggggtcattgtggacacaaacacaagatgtggcaacataaagccgtctccgttaaagaactccgcacgaggaacagggcgggggcccctccgtccccccatagtattagctaaacgagtagtcacgacaccacaccgacgcggatcgggcacacaacccccccaacaacgagtgtggtcgtaacctcagctaccaacagagaggcgagaagcccgcgacaacagaacaccgacacagcgtggagcaacaccacgtgggcgggcgccaaaacactgtgcgtacacacacgagcggggtgacgatggagtagaaggaggaggaaaacaccacaccgacaacagagcagccaacaacccacccattacgacaggggaggcgccaccaccaccggaggaggtcaattaaatcaaccacgatggcgcgtggacaaaacaccgcgtgatcatacgtgagacgtgtcgggtggtcgaaaacaacccacccaaggggggggggcacgacccccgatacagtggtgaacaaccagcgccaggccaacgtactaattcatctgtcagaaacgagcggatgacagccgacgacgtagtgaaccaacgacgggcgaaaaacacgtggagcgggacgaagcgagttgtttgataacgaacgaaaacgccgcactcgacggaagcatacggacgccc

SEQ ID NO: 652943 - DNA, 117 bp, Homo sapiens
gctgaagcatggtatatagctggactgggtacttgcattaactgcacacaacaaaggcctttgataaggacacagcagagtctatcatgatgaactcaaaatcaaaacagttcagag

SEQ ID NO: 652944 - DNA, 634 bp, Homo sapiens
  misc_feature (48)..(48): n is a, c, g, or t
  misc_feature (93)..(93): n is a, c, g, or t
  misc_feature (172)..(172): n is a, c, g, or t
  misc_feature (249)..(249): n is a, c, g, or t
  misc_feature (357)..(357): n is a, c, g, or t
  misc_feature (367)..(367): n is a, c, g, or t
  misc_feature (396)..(396): n is a, c, g, or t
  misc_feature (426)..(426): n is a, c, g, or t
  misc_feature (430)..(430): n is a, c, g, or t
  misc_feature (460)..(460): n is a, c, g, or t
  misc_feature (464)..(464): n is a, c, g, or t
  misc_feature (496)..(496): n is a, c, g, or t
  misc_feature (515)..(515): n is a, c, g, or t
  misc_feature (517)..(517): n is a, c, g, or t
  misc_feature (521)..(521): n is a, c, g, or t
  misc_feature (540)..(543): n is a, c, g, or t
  misc_feature (583)..(583): n is a, c, g, or t
  misc_feature (601)..(601): n is a, c, g, or t
ttatttggtatacacttaatactgccaacatgcataacatatgccagncaagctcatgcattattggaagagaaaagaaatgtgatgtaactnctatattgtctgattataaattcattgcttcagtcagttttctttcttcagggataccatttacctgtagtctgctgtnggggaatctgagtctgatgtggcaagtcctgctgcgtttgcctcaatggcatgtttgtcctatcatagttgtctgtntgtcacgggggtatgatttccccagtccccgggtggaacacaggaagcgttgcccggggccatgctatctctcttttcttggccatgtctcgaagctccttggcaganttctgactanccctgtcatgcaccagttggctgtctggngtctgcctgtctctcttttccacgccttcncgtnggcagcacatgatataagccagtcttaganaaangaccagtgccactgccgagggcacagccagtnttattaggaaatccgtgtnanagtntctgcttttcaaagaattnnnngggggtttgtattctccaccatcaggtaaaatcccctctncacgaattacttcctganaggtggacaattgctttgttttatcaaccaatg

SEQ ID NO: 652945 - DNA, 118 bp, Homo sapiens
ccccttagattacctcaatccagctctcccccttgttacttttccttgaagccctcctcagtctctaccttttctcatctcacaacatttctaaattctaaaacttcacctgccgtgg

SEQ ID NO: 652946 - DNA, 129 bp, Homo sapiens
aacactggccgaattaaaaacaatatcgaaaccaaagacgtccaactaacgagtggggatttgtgatccataaactcacctctttctattaaatttttactccctttgtagtagagggattgaaccgga

SEQ ID NO: 652947 - DNA, 630 bp, Homo sapiens
  misc_feature (325)..(325): n is a, c, g, or t
  misc_feature (391)..(391): n is a, c, g, or t
ggggagttgtgtgtctctgtagaaaggcgaaggggcagttcctatcaggactgtgtatgtctgagcacatgtggctctgtttgggattacgtgtttgtctgtgaatgtgtgtctctgttggacctgtctctcctcagtctattcctgtcatagatgtgggtgtccctggtagggaagtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtganagaaaaatgaaagcacagatagcctaagactgcacaggcctgtgcccacataccttatagcacagngcccaggtggatcatctcatgctaacaccccacatgtgctggtggatccactcccatggatccactcacatgctgcaggcatgcagtagactcacccacagaccactctctggacaccaatcctgggaggtgggagctggaatggggagcaatgagaggagggagtgagactgttggcttaggaagggtggtacctctccctgcatcatacccaggaacttccagctccaaaatattgg

SEQ ID NO: 652948 - DNA, 796 bp, Homo sapiens
  misc_feature (58)..(59): n is a, c, g, or t
  misc_feature (62)..(62): n is a, c, g, or t
  misc_feature (67)..(67): n is a, c, g, or t
  misc_feature (236)..(236): n is a, c, g, or t
  misc_feature (321)..(321): n is a, c, g, or t
  misc_feature (427)..(427): n is a, c, g, or t
  misc_feature (482)..(482): n is a, c, g, or t
  misc_feature (486)..(486): n is a, c, g, or t
  misc_feature (509)..(509): n is a, c, g, or t
  misc_feature (531)..(531): n is a, c, g, or t
  misc_feature (538)..(538): n is a, c, g, or t
  misc_feature (543)..(543): n is a, c, g, or t
  misc_feature (552)..(552): n is a, c, g, or t
  misc_feature (572)..(572): n is a, c, g, or t
  misc_feature (579)..(579): n is a, c, g, or t
  misc_feature (586)..(586): n is a, c, g, or t
  misc_feature (591)..(591): n is a, c, g, or t
  misc_feature (595)..(595): n is a, c, g, or t
  misc_feature (624)..(625): n is a, c, g, or t
  misc_feature (631)..(631): n is a, c, g, or t
  misc_feature (642)..(642): n is a, c, g, or t
acaggctgaggtttggtgtgtgatctgtcctattggcctcacaatgcattatcttgtnngcncaccncaacctggccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggnctgagtggctctatggatgtggttgttatggatgtggtagggagtgcttagcagaatgtgtgtgtatctctgaggctgtcagggnggtgggtgggtgtgtgtctctgttggacctgtctctcctcagtctattcctgtcatagatgtgggtgtccctggtagggaagtgcctgtgtggtctgtttacagtngcagaaggcggctcagcagtgcaatgggctgacagccttggaccgggagtcagangccntgggttctggttgtagctctggnccctccctgtgatcttcaacangccactntgctntctctcgtnttcagtttcctcaaataganaaatgancagcagntgaanattnatgttgaagatccttttatacctggaaannagtttnttcatagaaantttcttgtgggtggtggatggtggaacatctctggtgtagtgacacagatgactaagaggtaggattggagaagaagtagaggataatgaaaaagggagggggagagataagtaggtgggtatgtaggcccttggtatatgggagatgttgtga

SEQ ID NO: 652949 - DNA, 110 bp, Homo sapiens
cgaggttccccgcgcaggatcctgtgggctcaccgtgggctcccccaccccgctccgatcttgtaaattgacagaagctgaggcccatgagatggtcatcttgtcccaaa

SEQ ID NO: 652950 - DNA, 253 bp, Homo sapiens
  misc_feature (189)..(189): n is a, c, g, or t
gccggcagggtgctgtactgagggagaatagtactaggtgaatattcacaatccgactactccagctgacacaggatgccatcgaccattaaaatttattgatcatacttagatattctaagtgctgatcaacagatagcaaagatggaacccttttgtggagaaaataaaatcccttctgaccccagnttttgacacttttagagaagttattaacggactgttaaacttatttgagcatatttcaaataaa

SEQ ID NO: 652951 - DNA, 123 bp, Homo sapiens
aaatcgagctcggcccaaattatgacatgagtcggtggcatgcagtaatgttagcggttaggcgtcggccaggccgttggttgaatgagtcggcttatggtttcgataatactagtatgggga

SEQ ID NO: 652952 - DNA, 649 bp, Homo sapiens
  misc_feature (58)..(59): n is a, c, g, or t
  misc_feature (62)..(62): n is a, c, g, or t
  misc_feature (67)..(67): n is a, c, g, or t
  misc_feature (236)..(236): n is a, c, g, or t
  misc_feature (321)..(321): n is a, c, g, or t
acaggctgaggtttggtgtgtgatctgtcctattggcctcacaatgcattatcttgtnngcncaccncaacctggccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggnctgagtggctctatggatgtggttgttatggatgtggtagggagtgcttagcagaatgtgtgtgtatctctgaggctgtcagggnggtgggtgggtgtgtgtctctgttggacctgtctctcctcagtctattcctgtcatagatgtgggtgtccctggtagggaagtgccctgtgtggctccgttccccagctgccgccacgcggctcacgcagctgccctgggctgccagccttgcgcccgccactccgaccgcctggggctaccgagccgctacgccccgcgcccccacccgcgatcccccacacacccccccgcccccccctcgccccccagccccccaaccacacacacgcaccgccgctgacaccacgtgacccacccccaccgcacaagcccccacgacacccgcg

SEQ ID NO: 652953 - DNA, 830 bp, Homo sapiens
ggaacaaaaactgtaggagcattactggtgtaatgacctaacacatctcctaggaagctgcggaaaaagccgtcaagagctttcaagagaatcccaaaggcaagactgatagtagaaagacgtatgaaagccgagaacgtggtcaccacagaagtcccagaggacgatatgagcagtgtataagcacagcgtggttgtctagggttgaaatagaaggtgggtctttagcacatagtccagagttcttcagcttcacatcccgtttgtccacgaaaggaagaagtgaagttatgcaaaaatacagtatggatgcaatgtttgatcaggaaagtggaccattcctcctgatcccagaaatgaatgtgattgggctcttagcaagtgcacatcccaccgtaagaaaatttacaagtcagatctgaagaaggtgctttgacattaaatattgattatatggttcttctgaaagatgaggtatagcgcaaaaagaaatgggagaaatcatgtgaagcaagaaagtcagtcgtagtttcaggaaatagcacagaactttgctgtgattggatccatgtgtattacaaagtacagagagtcaattactccaggaggagaattgcaggaaaaagctagaagctctgagagcagataggttggctggactcttgggaatatcttaatccgaaagttacaaagaggctaccagcatggaaagtatagtgaatgaatatgccttcatagctggcaggaaaaatcggaataagccatgagaaatgagaaacatattccatgtgtggccaagcatagttctggagtgtctaaaagccaaaata

SEQ ID NO: 652954 - DNA, 107 bp, Homo sapiens
tccacactggagcagtagactgagggcacccacaggttggaggagttgttgtcaaagacgacggtgaaagcgctggtcaggagttccgatgccgatagtgccgaagt

SEQ ID NO: 652955 - DNA, 1620 bp, Homo sapiens
  misc_feature (84)..(84): n is a, c, g, or t
tgagtgtgctttgctgtgttgatgagggatccacgcccgtcgtcagaatgggtcgtgcggaactactaatgctcgttctcgatngatatttccgagcatagccgctgtgtgccggcggttgatggcgtaggatattaatatcgggtgttcgggtgcgactttgtagtaacactttttcttgtagtatcgtatccgcttagtggaggctagatgtggaaggacgaagtctgggaccagagatgttgatggtgcgcgtcgatactcgctggactgatacctgatgggccagtggtgacaatgcctaaccggggggtctcatgcgcgcgtgttggtactcgggttggggggactgccatgtgtcctccgtggggagcgtgcggggttgcgttccatttccagcgtgtgtgcgcttccagtgctcatggttggtgatttgggcagatactagctcgcggtgtgatagcgcggttgggtagggatgcgccgcggtgtgtccgggcagggttcaatgggcggagattcggggctttcgtgtttgcttgtgagagtggtctgtgtgtgcaatatagggaaccggtttccgaacaggctggtgtgtgctcctcgcgagtatcctcgtctggtcagctgggcttgggtttctgctggggaatgctgtgagggcattcttctgggactggtgcgactacgggaacgcgtagactggtgcggggttccgtctgtgacggggtaaaatcgcttttgcagccgttggggtggtcgcttcgatttggtggcgtgtctagcgtttgggtcacagtcctggtgggattgtttggttgaggattactaagggtgggtcattggtgtggggtgtattggggtagttattgataagattggggaattttattggtggtgtgatgttgtgatttggtgagtaggacgaattgtgttttggaatggggtgtgtttgcggagatgggatgaggctgaattggagatttcttttgaggtatagtgtcgactgtactgccatgcgagggtcttgtgcgggcgatctgttggtgtaccctctcatgggaatggtgtgagggatgatgtttgttcggggagtgctgccgtataggctgtctgggcgctctctgtatcgtgccggattgggaacggtctctttatttagtgtcttgcgagaatatcgcatcggaatagcgcatagtgatggtgctattggccgaggtttgtccaagcaatggcgatgactaggttagggcttatgggcccagttggtctagtgatagtagtgttgtgatatgtgagtgcgataatccaatagcgttaagacatggtacgatgtgagacgcctacgacgaatgtgatcagggatagctaccatggttgactcatcagactttgtggaatcttcagccaagcccatgtggtggaatgggcctagctgctatcaaagaatgacatgttttatgacagaatactcactgtgtatgggcaaaaaactcgaggactgtactcttgtgactaattgtatcaacaggttattcttagtttctgttctgtggaaagtgtaaagcattcctacaaagggcttttaaatgtagatttttttttactgcacccgatcgc

SEQ ID NO: 652956 - DNA, 960 bp, Homo sapiens
  misc_feature (58)..(59): n is a, c, g, or t
  misc_feature (62)..(62): n is a, c, g, or t
  misc_feature (67)..(67): n is a, c, g, or t
  misc_feature (236)..(236): n is a, c, g, or t
  misc_feature (321)..(321): n is a, c, g, or t
  misc_feature (427)..(427): n is a, c, g, or t
  misc_feature (482)..(482): n is a, c, g, or t
  misc_feature (486)..(486): n is a, c, g, or t
  misc_feature (509)..(509): n is a, c, g, or t
  misc_feature (531)..(531): n is a, c, g, or t
  misc_feature (538)..(538): n is a, c, g, or t
  misc_feature (543)..(543): n is a, c, g, or t
  misc_feature (552)..(552): n is a, c, g, or t
  misc_feature (572)..(572): n is a, c, g, or t
  misc_feature (579)..(579): n is a, c, g, or t
  misc_feature (586)..(586): n is a, c, g, or t
  misc_feature (591)..(591): n is a, c, g, or t
  misc_feature (595)..(595): n is a, c, g, or t
  misc_feature (624)..(625): n is a, c, g, or t
  misc_feature (631)..(631): n is a, c, g, or t
  misc_feature (642)..(642): n is a, c, g, or t
acaggctgaggtttggtgtgtgatctgtcctattggcctcacaatgcattatcttgtnngcncaccncaacctggccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggnctgagtggctctatggatgtggttgttatggatgtggtagggagtgcttagcagaatgtgtgtgtatctctgaggctgtcagggnggtgggtgggtgtgtgtctctgttggacctgtctctcctcagtctattcctgtcatagatgtgggtgtccctggtagggaagtgcctgtgtggtctgtttacagtngcagaaggcggctcagcagtgcaatgggctgacagccttggaccgggagtcagangccntgggttctggttgtagctctggnccctccctgtgatcttcaacangccactntgctntctctcgtnttcagtttcctcaaataganaaatgancagcagntgaanattnatgttgaagatccttttatacctggaaannagtttnttcatagaaantttactgatggtggggacgggggtccgaattctctgtgtgtctcagtatacctaaaggattggtggtggggcggagattggtgtgttctgctgtagaaaaggcgaagtgggacatgtgtcctatcaggactgtggtatagtctagatggcgagaatagttaagcctctagtcctgaggattaccgtggttgtgtgcgtggtggagagtgtgtacgtgtggtagacggaaggcggttgtcgatggtcgtgtgggggaggaatagaggtgtactagtgagaaatgccaagacttgttgtagtagaggccttgctttcatg

SEQ ID NO: 652957 - DNA, 590 bp, Homo sapiens
acgcgcacgcggttcaaaatcttatatggcctctaggcaattgtgaggcaattcgtggctattgtgcttctactgcacagtaaagggacatccccaggcactcctgatctgacaaatgacaatgagaaatggactaggaacaattgtttttttcttcgctttaaaaagacgcaataaccaatacaacacctccgtggggatcaaactctcaaaattggggtatcgatgggtaaagtatccacaatgcaactccttcttgttatctcttagggggttctagttgtcccctttcttctgtgcccatgcaaaagaggatggcaggaagggagcatgagagtccttgccgaatctgctcccggggtagctgtgtggatcacacaggcagacaggtgtgaatacgtctgcaaacatcagagcactctacagatgccatttatgagcagaaggcatgcttttaaagtgcaaaaactggggtgtcccctctgagctccccaggcttggtgtgaaaccattctggaatcttctgtgtaaactccaacagagcagtgatataggataacttacattgcccatagtgcgagaaacaatgt

SEQ ID NO: 652958 - DNA, 653 bp, Homo sapiens
tgtctttgttcctcggtgcatctcattctacggtatgtcttctgtactttccccttcttgccattattaacccatgttgtgtttattcttcctcaatatttttagccatttctcctcatgggccacgcgccctagctcactgttaggatgatgcctcggtcagtcttctgctggcacgagcgtgtagcagttttcctgtgtgtgtcctgggttctggtggcatcagccagctacccctttgtgggcatatagtctatgggccactttttgatgtcttccctcagatttccattgtgtggccttgtgtgggtctgggggagtctttgcaccatgtagatgtcactgactgtgcccctttgcccatcagccatttgcccatcaccccctaacaatctcagcttcggggccggtgagggtgaggggcctcccccaggtcactagatgaggagcagctggggtaggctgtctgtgccatggccccccactcccccttcccttggagggagaggtggcaggaatacttcacctgtcctctccctcaggggcaggtggtggaggggcagcccagggtcgtctttgtgtatgggggaaggcgctgggtgcctgcagcgcctcccttgtctcagatggtgtgttacacctcggtgtgtaaa

SEQ ID NO: 652959 - DNA, 180 bp, Homo sapiens
ggcatggagaatggctccgcttcttttgcagctggcggtgcttggcgcggcgcttgcggcccgagccctcgtacttattttcatcgttgcatttacaacttctacaaaaatgccagcacttcatcgacatgaaggagagaaattcttcttaaatgccaaaggcagagagagactttatcc

SEQ ID NO: 652960 - DNA, 559 bp, Homo sapiens
  misc_feature (18)..(18): n is a, c, g, or t
  misc_feature (22)..(22): n is a, c, g, or t
  misc_feature (27)..(27): n is a, c, g, or t
  misc_feature (140)..(140): n is a, c, g, or t
  misc_feature (258)..(258): n is a, c, g, or t
  misc_feature (408)..(408): n is a, c, g, or t
  misc_feature (451)..(451): n is a, c, g, or t
  misc_feature (464)..(464): n is a, c, g, or t
  misc_feature (473)..(473): n is a, c, g, or t
  misc_feature (481)..(481): n is a, c, g, or t
  misc_feature (545)..(545): n is a, c, g, or t
tggcagaaattaagatcncgcnatctnctctggctggctcaacatggaaggatcccaatgttgaaagaaaaagcatgtaagaaacagaacaggcgaaaaagtaagggcccggcatgccccccagtcccccccaccctgcntgccgcgagggccccccagtcctccccacggcagccatcgccctctcgccaaacaaaacagaagcccccaaacagaacaaaaaggaaaaaaaaaagaattttcacagaagaagaagtncacattcattcgattcattgagcctgcggagagggaagagaaaggaataggtcactacggggagggaagggtgggagactagggggcggaagagaggaggggctggaacaccgtggggggggccagggagcccccccccaaacctgcgcnggctcaggctggaaggacgtgctttttaactgtttagccaggngctcgcgggactngctgaagtnacgccgcnccctgacggagaaggagggacaaaccaggaagagaggagaggggccgcggagggcggaggcgcnagggtcgtagggga

SEQ ID NO: 652961 - DNA, 372 bp, Homo sapiens
  misc_feature (344)..(344): n is a, c, g, or t
  misc_feature (365)..(365): n is a, c, g, or t
ggaggctgagaaactactggagcaccagggacagtctgtaaagttggatggaccaccaatgggaaaatgagagctgcccaccctggccttacactccttcaattaatacataaacagaaaggaggatatacagagagccaaaggccatgggacgtgaccaacattccactgagtctatacgatcaaacagcaaactgtttatcatgaatacagaatgtgggcaaactcatgactgtgcctgccccagaaggtttgctgagggcaattgcttcctggacgccaagctccttgaggttatctattggggacatccagagaatgcagttcttgcaagccttactctnggaccgagcagctgacccccntttttcc

SEQ ID NO: 652962 - DNA, 815 bp, Homo sapiens
gagcggagaggcggggcgtggtggcctgggctgtgctcgtcgccgcgctcgtggtgacctggggccgggcggactcggggaccggcggagtgacgccgtggtgcgccctggccgagtgctgggtggatgcgtggtgctgtgctgtgtgcagtgtgcgctgccgaggactcccgatagccagggcctgggccagagaggctgccatgggctcctgtggggagccagcgccttgaggaagcccaggctgtggcaagtgcacaccatgacaccgggccgtaggtgatgaagcttcacctttgacagttaaaacagctgcgatggagtgcggctggacggcttggcctacacgggccaaggggacactaacagggacacggggctggtccccaggcattatccacggaatacttacgactatggagaaccggaagccagtggcacccgactgagccgggtatattgaacagaccattacttaactatatgcctgactagcatagaatgcgctgcgcagcatagggtgctatcgcattgagcgagccgagtagagaaacgaggaattacatccaactcgtgaacttctttgtggcacgtaacccttaggacattcaccgaattggtaaccaccaagcgggcactcgtttccgagtccgggtaggtcttgtgcagccataagattgccttacaacccgtactagtactatagagtaatgcgcgacagttgggccaacgcatagtagcttcaacttgagatgcagaccgttatctagactgggagcacgacatagagcagccaatggacaacacaggcgatc

SEQ ID NO: 652963 - DNA, 1607 bp, Homo sapiens
  misc_feature (1574)..(1574): n is a, c, g, or t
cgtggtgtgtatgaggtgggttgtgttgcggctgtcatacattatgagaggtggggggtgctaaacatactagagtgttgtaggagaagagtggagttgtgtttgttgtgtattgggtggggtgggttgtgtttctctgtttgttgttgttgatttagttgttagttgtgtgatttggtgttgttgttagtgtgtgtggtggtggtggaatctacaactatacaggcgagcagcatgaattgagttgatgttgatgatgagtagggggtgggatatcaaatctgctagattgtggtgatgtgttatgttggaggtgtggtgagatgtgttaactacatatgacagtagggtgtgtggttgtgtgtggtgtcagacaacaaacaacgtcagacgactcatgactcatcatactcttctgtcggtgtggctgactcctactccacccacactgactgcgatggtggagtagtttgatagatagtgttctagcggcttggtgtagcttcgacttctactaaggctgcggcttgcctgcagctgcgcggcagatgattaagtattataggttgtgtgtgttgtacgccaacacaacagactgtttgtctgggtgaggggttggacaactacaactacaacggagcgatcatcggacgtgtgtgttgtggagggggagagcatcacaacacaactgacggtgagtgctagtactagcgaggacgaacacaacaacaagaaggaggttggtttgtggttgctgctactacagcagtgtacgattcagcgagagtggtgatatcattagagcagccaccacaacatcgagtggacgcacaacaattaaagagaggtgttgcgtgacgtgggagaaatgtgtgtgcagcgcgagcagtagcgtcgccacacgattagagtagggcagcagcactgcgacaagaagtcgcacacacggtccgacgaggagagtagtatgttgagagagtggtgtgtgactatacactatcacacacactaagtatagtgttgttgggtgggagcagcgcgtcgctatttatgtgtcgctcttcatcgcgactctcttctcttgttacgaatttgtggcctctcgggcgcgacacatctgagaggagagtgtgaaggaggaggtcgagctgaaataaaatagtcgtcgcgttcgacgcgcgcaccccttattatatactccactggggtctcctatatgtgtctttcgtgtgggacgcgcgctgtcacataagagatgttcatcacagaagagagagagaaaatgtagtgtgtgtggtgtcgctctgatcagaatagatcgatctcacacaggtgtttcttactcacttcagttaacaatagatgtgtagatgtgtggtgtgttaatataagcaggcggttgtcacatgggtgacacaacacagtggtgggagcacaacacacacaaatccactgattatgctcctcaactggtctcactgtattaatttgttgttgtttgttaggtgataaatataatataataaatataataaaataaattaaaagggaaaatatacttgctgagtatgttnaagtcgaggggccggagatagagtatgtaccat

SEQ ID NO: 652964 - DNA, 855 bp, Homo sapiens
  misc_feature (648)..(648): n is a, c, g, or t
  misc_feature (824)..(824): n is a, c, g, or t
tgtgtttgttgtgaaaaaggaaaaaagttttttgcccttgttttacccgggggcaattggaaaaaagcttatttttaagccttacgcctctgcgcgggaaaaaacaccgcgtattcaacacggttatgacagggggaaataatgcctcataaaaaaggttttttaaacaccaaaaaacacactccggctttttttgttgggttccgcctctttaaaaatgactctggcgtcaagaaaaaaacagtgtgcgtttctaaaaaaaggggtttttttaaattataaccttcaaacccctcttgaccaaaagaccgagaatttttcggggtttttgccctctgggcttggtccttccccccaatttttggattggggggcattttctgttttatgccccctttccccttaaaagaaaagggttataaaaacgttcttgatgtttccgggggtaagaatatttctcttgaaaaatttcttttggtggtggtaggcggttattcccacggcttcaccctttgagtgtggcagataaaggcgtcctttctctgcagaaacgccttgttggcccccctttctgaaaaacgagggagaatagttttccccgctttctagaattttgtttggccgcttggggtctcattttttgtgagncccgccacccaaagatacctggcgcctgtgctaccttattatctccaaaacctataagaaggtgtttatttcttctttttgtgccccagggtgcccggttttgagaggggtgtgttaaagggtcttctcccacaaacctctagttaaaacgccaccggtgtggtttctcgggtgcnaagatgtgtctcttatctggaggttagaaag

SEQ ID NO: 652965 - DNA, 353 bp, Homo sapiens
  misc_feature (307)..(307): n is a, c, g, or t
  misc_feature (334)..(334): n is a, c, g, or t
gacttatttttacagacagggctagaatgcagtggcatgaccatacctcactgcagccttgcgctactgtgcttgtagcctcccaagtagctgggactacacgcacacaccaccgcacccagctaatttgttttttttttttttaagagatgggggtcttgtgctttgttgcccagggcggatctcgaattcctaggcttcaagagatcctccggccttcacactcccagagtgctgaggattattaagcgtgcccactggccccttggcctattttttgctttaggaatttgtgtatcctggattnaaaaatggaaaacaggcaccaaacctncccccattctggtggcttt

SEQ ID NO: 652966 - DNA, 879 bp, Homo sapiens
  misc_feature (149)..(149): n is a, c, g, or t
agatcactggtgtgcgttaatacactctgcgaggaaatggtagatgctgaaaaagtacaacacccgtggtgcttgcaaaggtgaattctaatgttttgcccggtatattcctctgccataaaagatgtagtataaccccgcgcgcgaanggatgtggtggtttccgcgggacaattactgctgaagacccaacacggctgggctataaaatgtgcagaatgttagctccccaccctcgcgtacacagatgggtctcattaatctagtacgccgccctgatcaattcattgtggtgatgactgataaacaccccccctgtagcaggtggtttccttccaagccggatcctctattggagagtcgtttgatcagtgtgtcacccctccatgattggccaaccaccaccacgcatggattatatccgcagcgatgtattttccccgacatgtcccctctcattgggtccttcatgtgcttggtaaggccaccccctctgtggcaggcgccccactgtgccctacacacatcgaggtcctcgtgcagaacctgattcttgttggtggcgtgaagtcagacaattcctcctacccacacgcagaaagtcatctgtgttctatacaagcatcagaacataagaagtgagactattttgtgaattgatgatatcatatcatcgttatttcaatatgtaccccctcttggcacaaaggtttattcgtattatcaatactcgcctcccattagaatagttatcttcgaaagctttaatacccccactagactcgaattttttaaatacttcttaaaagccctcggatacatataaatcaatgaatcaatacaataaacattatcttttttcccaacccccacatgaca

SEQ ID NO: 652967 - DNA, 2184 bp, Homo sapiens
agcggtggggaccgggccgcttcttgttcggcgtgggcggctcctggcagacccatcccgcggtgcagccgccggcccggtaggcgccaggaccccgagcctcggcggcggcggcggcggcggcagcgctgccttcactcacctcgtcctcgctcccgtcctaccccgttccgcgctgggtggagtccaagtctgattgcgagagtccggaacgccgcctcgggggcttgactccagccccggggatcgagaacggcgcccaggggtccctacgtctgccttgggggctcgagtcccgccctgggcgtccgtgacgtcgcccaggggtctccacgtctgtcctggaacctggagagccgccgtgggggccccggaagccgcccaggagtccccacgtctgccctgggggctcgagtccagctctcagggtcccggacgccacccagggggtccccatgtctgctttgggggctcgagtccagccatgggggtcctggacgccgcctcggcgtccccgcgtctgccttgggggcccgagtcccgccctgggggtcctggacgccgcctcggcatccccgcgtctgccttgggggctcgagtcccgccctgggggtccccgatgccgcccgggggtcctcacgtctaccttggagactggagttcccccgtgggagtctcggacgccaccccggagtcaccgtgtctagccttgggggcttgagtccagccctgggggtcccggacgtcgccgaggagcccccacgtctgcctttggggcttgagacctgctctgggggtcccggtcgccgcccaggtgggtccccacgtctagccttgggggcttgagtccagccctggggggcccggatgccgcccgggggttctcctcgtctgccttgggggttgggtccagccccaggcgtcctgaccaccgcccaggggcccccacgtctgcctgggggcctcaaattcagtcctgggggtcccggacgcctcccaggggtcttcatgtctgccgtgggcctcgagtccagccgtgagggtcccgaatgctgccttggagggtggagtccagctctgagggtcctgaagtcagctttgggggttcgaacccatccatcccaggggtccctgagtctacattaggggctggagtccagccttgagggtctccactgctgccttgcgggcctggatgggatccagcgggtctgagtccagcctcgggagcccctgcggtggagctctgagtggggcaggggcctgggagatgccaggaggatgagagcggcgcccccctggtccaggggacagtaagaggcagccggtctcagagaagctaccccaaaactgttacccgtggtgtgcagagcgtcctgcaaccccagccctcaccaggatttcttgcgtttttcaggaaatcggttgtgattggcatgttccttaagcgtctgcaggaagccgaggcctttttggtatttcaggaggggttgctaacccccctccttgtaggatcggggtatcccagctgctaattcccctcctaacagccctgcagcgcctggattggaggtgtgacaggtggcatttttggcccgaagtccctaggcaggacgggtggctgtagcctgcgcgtttgtgtaaattaacctccctttttagttctgtgaagggagaacgtgattagtttaaaatcacctgcgtgaaagaggctcttgattagtttaaaatcacccacgtgaaaggggctcttgattagcttaaaatcacctgggtgtttcgttttatctcagttggcctctgaatgtttatcctacagcttcctgcaagctccagtctaccttctaagggaataacggggctcgtctttctacgttactttatgtgggagtagttgtaaaacagaatgagggagaccgcggggattgtgcggaaatgtagccaccgtttacatgtcgggaggctgaggtgggaggatcgcttgagcccaggagtttgacaccagcctgggcaacatggtaagaccccttctctaccctcccccccaaaaaaaaaattttagtgtggcatggtggtgggtgcctgtggtcccagctactcgggacgctgaggtgggaggattgcttgagcccaggagtttgacaccagcatgggcaatatggtaagaccccatcatctacaaaa

SEQ ID NO: 652968 - DNA, 393 bp, Homo sapiens
  misc_feature (31)..(31): n is a, c, g, or t
  misc_feature (119)..(119): n is a, c, g, or t
  misc_feature (146)..(146): n is a, c, g, or t
  misc_feature (159)..(159): n is a, c, g, or t
  misc_feature (223)..(223): n is a, c, g, or t
  misc_feature (228)..(228): n is a, c, g, or t
ctggtctaaagaactaatgccaaatgtgtcnctggaacataaaaacttctttggttttccattaacctattctggagaaaaacaatggtgaactctgaagtaaagtggggcagcaattncaggttctttaccacaccacatgccancatttgtaacagncagtagctttggccctcccagaaccttgagtgacctgggcaggccacccatctctggccttttncttgncagtgatttttcacaggcacagagtaaactcctgcccttcaaatacctactgccatttgcttcctgatgcttaacattccacatttatagaaaaggcctcaaatataaggaccacaataataacacgtgatttaaattcacatagagatgtattggctcctattg

SEQ ID NO: 652969 - DNA, 1529 bp, Homo sapiens
agcggtggggaccgggccgcttcttgttcggcgtgggcggctcctggcagacccatcccgcggtgcagccgccggcccggtaggcgccaggaccccgagcctcggcggcggcggcggcggcggcagcgctgccttcactcacctcgtcctcgctcccgtcctaccccgttccgcgctgggtggagtccaagtctgattgcgagagtccggaacgccgcctcgggggcttgactccagccccggggatcgagaacggcgcccaggggtccctacgtctgccttgggggctcgagtcccgccctgggcgtccgtgacgtcgcccaggggtctccacgtctgtcctggaacctggagagccgccgtgggggccccggaagccgcccaggagtccccacgtctgccctgggggctcgagtccagctctgagggtcctgaagtcagctttgggggttcgaacccatccatcccaggggtccctgagtctacattaggggctggagtccagccttgagggtctccactgctgccttgcgggcctggatgggatccagcgggtctgagtccagcctcgggagcccctgcggtggagctctgagtggggcaggggcctgggagatgccaggaggatgagagcggcgcccccctggtccaggggacagtaagaggcagccggtctcagagaagctaccccaaaactgttacccgtggtgtgcagagcgtcctgcaaccccagccctcaccaggatttcttgcgtttttcaggaaatcggttgtgattggcatgttccttaagcgtctgcaggaagccgaggcctttttggtatttcaggaggggttgctaacccccctccttgtaggatcggggtatcccagctgctaattcccctcctaacagccctgcagcgcctggattggaggtgtgacaggtggcatttttggcccgaagtccctaggcaggacgggtggctgtagcctgcgcgtttgtgtaaattaacctccctttttagttctgtgaagggagaacgtgattagtttaaaatcacctgcgtgaaagaggctcttgattagtttaaaatcacccacgtgaaaggggctcttgattagcttaaaatcacctgggtgtttcgttttatctcagttggcctctgaatgtttatcctacagcttcctgcaagctccagtctaccttctaagggaataacggggctcgtctttctacgttactttatgtgggagtagttgtaaaacagaatgagggagaccgcggggattgtgcggaaatgtagccaccgtttacatgtcgggaggctgaggtgggaggatcgcttgagcccaggagtttgacaccagcctgggcaacatggtaagaccccttctctaccctcccccccaaaaaaaaaattttagtgtggcatggtggtgggtgcctgtggtcccagctactcgggacgctgaggtgggaggattgcttgagcccaggagtttgacaccagcatgggcaatatggtaagaccccatcatctacaaaa

SEQ ID NO: 652970 - DNA, 268 bp, Homo sapiens
atattcagcaactatccatctgacaaagggctaatatttagaatctacaggaactcaaatcagcaagaaattcacaaataatcctatcataaagtgggctgagcacatgagtagccaattatcacaagaagatacccaaatgggccaggtgcagtggcccatgcctctaatcccagcactttgggaggccaaggttggtggatcgcttgaggtcaggagttcgagaccagggccaacatggtgaaaccctgtctctactaaaaataca

SEQ ID NO: 652971 - DNA, 269 bp, Homo sapiens
cagtgtattaactaagtgcacattccacattgttgctatctcaaaattgttgaggacaatttgtgtcatcacttcccttccaaactgccgatcatgctcccaccccctgctcagccccttggatctgtaacctttgtcttggccttttatatgaaaaggggatctcaaaactaaggttcttatccagctcttttatttcacagatgggaaaataaggcactgtccaagtaacacacagtgacagtggcaaagtcgtgcttgcttcccag

SEQ ID NO: 652972 - DNA, 972 bp, Homo sapiens
  misc_feature (1)..(1): n is a, c, g, or t
  misc_feature (174)..(174): n is a, c, g, or t
  misc_feature (178)..(178): n is a, c, g, or t
  misc_feature (180)..(180): n is a, c, g, or t
  misc_feature (187)..(188): n is a, c, g, or t
  misc_feature (197)..(197): n is a, c, g, or t
  misc_feature (224)..(224): n is a, c, g, or t
  misc_feature (232)..(232): n is a, c, g, or t
  misc_feature (246)..(246): n is a, c, g, or t
  misc_feature (252)..(252): n is a, c, g, or t
  misc_feature (261)..(263): n is a, c, g, or t
  misc_feature (266)..(266): n is a, c, g, or t
  misc_feature (274)..(274): n is a, c, g, or t
  misc_feature (277)..(277): n is a, c, g, or t
  misc_feature (280)..(282): n is a, c, g, or t
  misc_feature (286)..(286): n is a, c, g, or t
  misc_feature (330)..(330): n is a, c, g, or t
  misc_feature (337)..(337): n is a, c, g, or t
  misc_feature (347)..(347): n is a, c, g, or t
  misc_feature (350)..(350): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (372)..(372): n is a, c, g, or t
  misc_feature (376)..(376): n is a, c, g, or t
  misc_feature (380)..(380): n is a, c, g, or t
  misc_feature (404)..(404): n is a, c, g, or t
  misc_feature (444)..(444): n is a, c, g, or t
  misc_feature (450)..(450): n is a, c, g, or t
  misc_feature (456)..(456): n is a, c, g, or t
  misc_feature (471)..(471): n is a, c, g, or t
  misc_feature (491)..(491): n is a, c, g, or t
  misc_feature (540)..(541): n is a, c, g, or t
  misc_feature (544)..(545): n is a, c, g, or t
  misc_feature (554)..(554): n is a, c, g, or t
  misc_feature (567)..(568): n is a, c, g, or t
  misc_feature (580)..(580): n is a, c, g, or t
  misc_feature (588)..(588): n is a, c, g, or t
  misc_feature (606)..(608): n is a, c, g, or t
  misc_feature (612)..(612): n is a, c, g, or t
  misc_feature (616)..(616): n is a, c, g, or t
  misc_feature (632)..(632): n is a, c, g, or t
  misc_feature (643)..(643): n is a, c, g, or t
  misc_feature (657)..(657): n is a, c, g, or t
  misc_feature (754)..(754): n is a, c, g, or t
  misc_feature (795)..(796): n is a, c, g, or t
  misc_feature (815)..(815): n is a, c, g, or t
  misc_feature (824)..(824): n is a, c, g, or t
  misc_feature (835)..(835): n is a, c, g, or t
  misc_feature (881)..(881): n is a, c, g, or t
  misc_feature (887)..(887): n is a, c, g, or t
  misc_feature (908)..(908): n is a, c, g, or t
  misc_feature (961)..(961): n is a, c, g, or t
ngattctggaattgggtaaagtgagaaactgggcctgaagactccgtaccctctgccatcttgccgagggagtctccttttagaaaacaatcaaagggttattgcatgagtctggatgaatcccactctcagctgtccacgggcccgaccacctcatctagccccctttttggnaggnanaacctgnntcccaagtnctcctccttcacttcgttacaaaccanggggaagngcccaccgtgagancgcgcnatctgaaannngtntccctttntanatnnntggngaaaccctttgcgcagaaggcaacgtggaagctgatgtttttantcatctngctgtttganagnacgattatgnagtngggntgtntagnagtnaaaagtaccttttatatatatatnttatatttatcatatatatataaaaatgtaaaaaagaggnaatagnggcttntagaaaatgattttntttaaggtttcctgtgtggnaggcacctgaaatactgtagaaaaatgttttgtgtggtgtttttgtttnnttnntgttaactnggttcttttttgnntgatcaggaatngtgctggnacgatatctcagtggctnnnaggnaatnctgccgcctgattttntctttctttcngtcccctgcttgtnctcctatctgatcaggctagagacaacaaaaaaaagatatatagtaaaaaaaaaaacccaaaaaaaaaaaacaaaaaacaaaaaaaaaaaaacaacncaatatatagatttctatagaatttccttttttcctctctnncacctttcctctgaaaggnattgttacnattttttgttnctgatttttgctgcaataaccttcttggtttcagtcacagcaaganacaaanccaaacaaacagaaaacccgnctgaaaagagtagaaaataaaaggtctgacggaaaaaaaaggggagggggatnaaaggaaggga

SEQ ID NO: 652973 - DNA, 447 bp, Homo sapiens
aaaataacatagagagtaaagaactaaccagcacaactactatcttactcataataaatcgagacttatgtagggtgtgcctagggtaagataacgcagagtgtccaatgaactcccgtcagtgccgaccgcatcctcattcatctcgtcctagctgtcccctgagaagatataagggaaaaaggaatggcagatctgttttgcatcctaatttaaccttctacacaaaatacttcattacaagcaaataaacaaacacaagatagtaagcttagaaaacaaaaggcctagaccacaaattacccagttaagcccaagtggtgacattggttttaagcctcaagaaaatgaaacttctgcttctgtaaaatcacatcctcatcaattgaatttaaatcacttagtgcattaacaatgttacaaattccaataatgtcagacatatgt

SEQ ID NO: 652974 - DNA, 1036 bp, Homo sapiens
agcgggcctctagccgcccttcccctgggcggctacgcgccgggagggtacgcggagcgcgacgcgggagctcgggctccatggtaggagcgtgcagtgacaatctgggcagatgcgcggagctttctactcatcgagccacccgtggttgccagtggatcgccgcgtctagacgtcccgtcccgtcccgcggtctggtagcggcctgtgcggctcccgggtagtgacctcgggcctcgccggacctcccgtctgccgactagtcgcttccccgggtcgctcctgctgcctcgaactctgcccgtcgctcctctcagcttcctctcgggtcgaggggcatggtcgggcggaccgggacctcgcgcacgtgacgggcggaccgggcagtgcagctagggaagccaggccgggtcatggcaggccctgcccttctagttgaactgtacatggtttcaaaggtcgctcgaaaccagaaacgctcggtagcctagcggaaccgaacggaggggtccgttttcgaatgcacacgtcgggaccggcagttgtcccttggtgcatttccctggcaatgccgaaggtcaggcgaacgtgaacagaaggcgttgacttggcttggggttgagctataggcaatgacccgggggtacccacaggacaccatgggtgggactttggtcccccaggaaggcgacggaaattgtggaagcccccttggatgggatgtgtagatccctgggcgtttttggccgttgacccggctggaaggggcaactggtattacatggcattggaacgggccttgcgcacggctccacatcacgggaaacaacaccttaagtggccccgaactctctccttggtggccatcttaagtttttgaacggcaccggaaccaccccaatagggatacccggaaacaggtcgcccctaggcaaagccaatttacttggttttaatgtggtgtccgaaaactagggggtcccaccttggagataactttaggttgcacacgccaaaaagaatctgcggcgcaaga

SEQ ID NO: 652975 - DNA, 433 bp, Homo sapiens
tggtgattacaggatccttaagacagacactcggggaattggtcacgaagtacacgggatccgtcacccttcggcccaaggatgggggagatgaaatcttggctcaaggattagatcctgggtacgctcattttccatgcgagatgcaagctccagcagctctcgctgggcctgctgcacgccctgtggttccccctcgatgcggatcaaatggctcttctcacggtcaggagggatgcgcacggacacctggtactggtcttggattctgttgatgtgggcaccgctcttcccaatgaggtgcctgtggaacttgtggtcgatgttgatctccacatagtccatccggtaaatcaaatcttggaccatgccttctatctgtgcctaggccacatggacatcctcggtagggccccccagagggtcgggctgg

SEQ ID NO: 652976 - DNA, 255 bp, Homo sapiens
taggtgctctagaggatctctcttacggcccaaactcagactactagtttgattatatgagatgacctgtggagactaccgggccattggagggttaactcagggggaaacttctccagggaatttgggaagtttccgtcgaaccacaggctactggaggttctataacaacactttggtagacacttctctcctgtcattcaccatgtattgggcaaagatggtcttcggggtaactccggaagaccaaattct

SEQ ID NO: 652977 - DNA, 656 bp, Homo sapiens
ttcctgtggatagcacaaccctggcatggcacgcaagagctcagatgatcagaaaattatctcatatctctggtgaaaaaacacagggacctgtatggggtgcacgcctcgagaatgctaacagcgagtgtcgctactgtgactgggctgcaacgttggggacctatgtgttcaccttgactgtcaagacgatgagaggaacctgcgagagccagagctctggtgcaactgtcatgtgtcaaaggaagaagatatagactagaagccagcctagtagccaatgataactgggaactgtggtgagttgaccctagcccatcgagcacagctagaggctggatggctctaagtcctcagatgacaagggaatagtcagctacctctggactcgagatgaggggagcccagctagcaggggaggtgttaaagtcactctgaccagtcacgcctatcctttttctttgcaaacctggttgagggaagcctacagcttttcacctgaaagtgaccgatgcgaagggtgcagagtgaccacagatccggtaccactgtggaggtgaaacctgatcccaggaaaaacaacctggtggagatcatcttggatatcaacgtcagtcagctaactgagaggctgaagggggatgttcatccggcag

SEQ ID NO: 652978 - DNA, 356 bp, Homo sapiens
tgctgtgttgcccaggctggtcttgaactccggctcaagcaatctgcccgcatcggcctcctaaggtgcttacaggtgtgagccacctcgcccagcccctgataagagcatttaagaggtgacagggctgcagggccatagtggctcacacctgtctgtaatcccagcactttgcgaggttgaggcaggcggatcaccagcagtcataagatcgagaccatcctggctaacacagtgaaaccccgtctctactaaaaatacaaaaaaaaaattagctaggcatggtggaatgcgcctgggtgacagagtaagactccatctcaaaaaaacaaaaacaaaaacaaaacaaaaccaaa

SEQ ID NO: 652979 - DNA, 669 bp, Homo sapiens
agcggggagtgtgctgcggcgcgagctgggccggcgggcgtggttcgagagcgcgcagagtccagactggcggcagggcccgagaggccgaccgcagcgtccctggtctctccagccctcactcggaaccgcacgtgagggcaaatccgcccggtggctggcttagcacgcggggacagccctccgaggcctccctagcggtgtgtggcgagagggcgtccgggtcgggagaagcacggaaaggtggcttcgcgaggcttgtgtggggggccggacgggcaagcctttgggattgccttggacactttgggtgtggggttggcccaaaaacatttatcgaaagatagcttacccacttagatggcaaggacaccggacaagtcaaagtcttcgcccgtaagcgggtggctcacgcctatagtccaggatgccgaggagggaggatcgcttgagtccagggagttggaggctgcagtgagccgtgatcgcgccaacgaacttccagcctggggcgacagagtgagaaccctaatcttctaaaaaacaaggaaagaaccgtctttcaacgcattggagcccattaagctggattttggcttctggtcgctctcttctacaagggtaccagggttgaacagggggggcagaccccctcatcaatgctttcca

SEQ ID NO: 652980 - DNA, 1023 bp, Homo sapiens
gagaaggaagaacagctgattccacaagatattccagatggtcatcgtgcgcctccgcccctcgcacagagaagcagcagcacacgaagcattgacacacagacccctgggggtgcagacaagggaagcaacaacagcagccgctctcagtctgtgtccccaacatccttcctcaccatctctaatgaaggcagtgaggagagcccctgttcagctgatgatctgcttgcggatcccagagataaagagaatggaaacaattctcctttgccaaaatatgcaacctcaccaaaacctaataacagttacatgtttaaaagggaacctccagagggctgtgaagggtcaaagtctttgaggaatgctcgccaaaacaacttcatgagattccagccttttactgtcctgacaaaaacaaggtgaatttcattcctaaaagtggctctgctttctgcctcgtgagtatcctcaaaccacttctccctacaccagatcttactctcaagggctctggtcacagcctgaccgtcaccactggcatgaccaccactttgctccagcccatctctatggcctccctgtctacaaacacagagcaagagcgggtatctcgaggaaccagtacagtcttgccatccgcctccctccatgcaccaccagaacccattgaggaagctgaaggatagggctcagctcaagcaatgggtgctgggagctaagaaccctgcagatcacgtgactgtggtatcatgtggtatcctgtcctcccggttggctgtgaagtgctttggctttccagtgaggtgtgacagcaaggctcctggaagaactagtggtcctctgagtgttctgcccctgcgcatgaaggccacagacgtgcttcacctgcttggccttgaagcactagctgaaacctgaaaggtctcttctttacttttggaggaacaaaaatcacattttatcacattttcatttgtttcaaattagacttgtttaaaaacaaaatacaaaaccggatccctg

SEQ ID NO: 652981 - DNA, 299 bp, Homo sapiens
  misc_feature (183)..(183): n is a, c, g, or t
  misc_feature (216)..(216): n is a, c, g, or t
gccagcaccaggcaacccggcccttgtccagggacctctgctgccttctctctggggtcaggaacctcagaggagggggctctggggactgcataggacgcagcactcggaggtgcggtgtggatgggtgggggtgagagaagagggttcttatcgcgtctcctgtgatcagcctctggcccnctggaggaggaatcctcagcgtttttcttattnccaccctgatccccaacaccaagagtgaggtgggcgtgtccaggcagcgagctcagccctggccagctactgtgatgccatct

SEQ ID NO: 652982 - DNA, 214 bp, Homo sapiens
aggctgcagtgcattcctctcctctagacactggttctcgtggcagaagctgcttgcggtaggcctggtgcaactgcagctttacagggaaccggcacctgtgccggtgcctggagctgcccgccccacggcagcagccagtgcactgctgtgtgcagtggctggacccttgactctctcactcacactcccctcaccgctctgcaccaagttt

SEQ ID NO: 652983 - DNA, 87 bp, Homo sapiens
cagtctcattttcatcttcccccagggttccacagaagttttgtttctggggcaagcagaaaaattaaattgcccctattttgtata

SEQ ID NO: 652984 - DNA, 259 bp, Homo sapiens
  misc_feature (207)..(207): n is a, c, g, or t
  misc_feature (215)..(215): n is a, c, g, or t
tactaatacaattagccaggtggtagtgagaggtgacaacgggctagcagccctcgctcgctctcagcacctccttggcctcagcgtctgctcttgccatgcttgaggggcccttcagccagccgctgcactgtggaagcccctctctgggctggccgagggggagctggctccctctgcttgcggggagctgtggagagagaggcntgggcggnccgtgccagcgcggttccgggtgggcgcggctcggcgggccccg

SEQ ID NO: 652985 - DNA, 568 bp, Homo sapiens
  misc_feature (236)..(236): n is a, c, g, or t
  misc_feature (460)..(460): n is a, c, g, or t
  misc_feature (485)..(485): n is a, c, g, or t
  misc_feature (498)..(498): n is a, c, g, or t
aggtagaactcttttaactcacttccctgtactacaattactattatgaaaagtgtgctcagacttcctctaaaacacactacagtgtatagaaagatctacggagttagagaaagaaagaagtgcaactaacaccttttcctttctttaagattagacatgttaagtttcatgtttcagtggttcacgttttctcttcaggccgttttctctttttctttttttttagacggagntccctcgggaggttgcccaggctggagtgcagtggtgcaatctcagctcactgcaacctccccctcctgggctaaagtggttctcagctcactgcaacctccccatcctggctcaagtggtctcgtgcctcagcctcccgagtagctgggacaacaggagagcgccaccaggcctggctaattttgcatggttttgtagaggcaggggtttcaaccatgttggncaggctgggtctcagaactccttgnataaaataaatgnttaattggtgggcattttggggttttccaaaatgagaattggtggtttaaaatgccaaagaggggaagaa

SEQ ID NO: 652986 - DNA, 296 bp, Homo sapiens
ggtcgacggaggttgtggtgagccaggattgtgccgttgcactccacctcccgggttcaagcgattctcctgcctcagcctcccgagtagttggcattacaggcatgcaccaccacgcccagccaattctgcatttttagtagagacagggtttctccatgttggtcaggctggtctcgaactcccgacctcaggcctgcctcggcctcccaaagtgctgggattacaggcgcgacgactgcacccagccttatgtgattatttttgagaagagaaactaaaaggaatggtcgacg

SEQ ID NO: 652987 - DNA, 656 bp, Homo sapiens
agcgggctcctccgcaaccgatccaccgcatcctggcaactgagcaggctccgccacccctagagcacaggggccaggtctgtagggatggcgctttcctgacggcgaccggggtcctcgtactgaccgcccagactagctaaactggcttttctgtggttggtgctcaactttggggacttgggacaggtttcttgatttcccaaagcttctccccttggtttgcctgggttactcgtcttcaactgaaatgcactgaaaaccaactgtgtgcccaccccaacccaaacacacagaggcccaaagggttctggctccttgcccctctgcgacagcaaccctcaagcccagaaaagacttatccttttgctgacgtatttttcagtaaatatgggctgctgtttcccacctttcagtagtgacacgccgttatcgtctaaaaccaagctggaacattacccgtcctgaccagctctgccctcccgcagtcccctgtatattccctctattccaaatgctttatgcattatttccttctcgagcatgagctctctgatacctacggttgtactcttatctttgtatactccatagtgcagcgtggtgcatgacacaaagtaggatctcagtcaatgtctgctgaatggaccatggtg

SEQ ID NO: 652988 - DNA, 288 bp, Homo sapiens
  misc_feature (224)..(224): n is a, c, g, or t
  misc_feature (235)..(235): n is a, c, g, or t
  misc_feature (260)..(260): n is a, c, g, or t
ttggcagcaatcaatgaaaacttgaacagtggggcacagtggctcacgccaaaaactgttttttttcatccgggtggtggttaacccaggtttatccaaccttgggaactaatttcacttaagcaatgaaaattgaaccaaattcgcagtttacacaccaaggattgacattttccaaaaacaattacttaaggttttaacaagttcaggccaaaaggaattancattctttggntgatttcctaatttaccattaaggntctcaaaagaaaagtctcaaaagacctc

SEQ ID NO: 652989 - DNA, 283 bp, Homo sapiens
cacctgtcgtacactcgtccccatgttccaatgatgctggtcaactgctatatacagcttcccatctttcttctcgcccagtcatcgtagcctttcttttattaaacacatgatccctagtactcatctttggaggacaaaaggcttaccatatgttagaatgatttgaatctcatagtactcacaacaacgagccgcattgaaagttgtgatgcattcatttgcagtggaacattctcaatcagtccttccactctaagtaaatattaggatcatgaacaca

SEQ ID NO: 652990 - DNA, 336 bp, Homo sapiens
gggagccgagctttgcttgtctacgtgatagctgcacgccgaaagcccgaagagggctagtagcattgcggctcgaactggtctcattgcgctctcctgcagagtcactaggaccctgaccacacctcctgtgtattcccccagtatggagccgtcgtggcgtggggctggtttagcaccagcagggccactttttaccataagccctgctgatgtgtgtcattattttccggctaacaatcgttggctatccagaaacatataataatttcaattcgttaccataaccggatgccacttcgggtaatccccgaaaacgtcgcccgggttcttgta

SEQ ID NO: 652991 - DNA, 465 bp, Homo sapiens
tttacaacgatcactgactggtggggggcatcatactaccagtcgtgtgtgtatactaaattagtataggatgatagagttgatacacgttaattgtgaccatttcttgtctattatgaataatgctgctatgaaaatctgtgtacaagttttaatgtggtcatatttcatttctttcgggcatatgcttcaaagtgcaattgcttggtcatatggtaactctgcatttaacctttgagaggaactgcctgattgttttctgaagtgagtgcaccactttacattttgtaccaccagcagtatttgaggcttccaatttatctaaatcctatgcaacataagttattttctaaccatcctagtgagtgtggagtggtataacatgatggttttgattttgcatttcccagatagcaaattatattgaggattttttcatgtgcctgttagccatttgtatttcct

SEQ ID NO: 652992 - DNA, 935 bp, Homo sapiens
  misc_feature (583)..(583): n is a, c, g, or t
taacatgaaagccattaactccgggggaattcctcggggtcccaggttacaaaattttccgggatgtcaaagtactcagctcggggatgatggggacggggtgtcaaaacagtttgtgagggtttgtgccagaaaaagtttttctctttatttcccataatgtgggtctaaggtccgttccttccagtggtctctcagtgtaaataagggtggcccagtggcaatcatgagttctgtacattgttatagctgccttggtaagtggacgagctttccaaatccctttattcatatcgacccctgggtgaagggggggtgtgaaggggtatgagggggcttgtgcatatgagggaatgtgacaggatttcattatgcacggaattgatgcgttatactcaatagagacttcaaaaattaccaatcgtccatgtgggtagtagaaaggtgcttgaggggatgcacaccaaagaagaacgggggttgcaataaggggagaggtaaactggcgtggagtagttgtcactaggaacaagattttttttagagaacgagaaacgcaaaagctgggttttggaagaaggangcgtctcgagaaagagggaccctccctttcaagcccgtggtggtgggccccctggtatttaaccacttctggacgtgctggcggggaggggacgccgttttgaaacaaggggttcccacatgtaaaagacaggtctataaatattattgcggcccgacgttccaattttctccctcccaacactcaaagcgggaaaacagggctcgtgggtcagaaacgagtgtgatgtcacacaccggaggagggacatctaatgccagcgaagcccctgtgtgacatgtgttggccacggcgtacagggaagcacaacactcgtggtttggggatcacacaggtgttgtctgacaatttg

SEQ ID NO: 652993 - DNA, 916 bp, Homo sapiens
gagtcgccgcgggaccgggggcgctgaggtctgagacgggggtcgccatgatccgtttatcctcatccagacccgggcaggcaagacgcgcctggcaagtggtacatgcgaggttggctggatgagtggagaaacaggacgctgagtcagaggggaggtgcatgcgggtggtccaccgtccgagacgccaaagcgactacccaagctttgtggggttccggggaacttcagagatcatttttacccgccgcatagtgctggcctcgtacttcgtgcgatcgtgtgtggatgtcaagtgacaacaacctggcttacctggaggccatgcacaagttcgtggagggtcttaaacgagtatttccacaatgtctgtgaacgtggacctggtgttcaacttctacaaggtttacacggtcgtggacgagatgttcctggctggtgaaagtccgagagagcagccagacgagggtgctgaaacagctgctgatgctacagtccctggagtgagggcaggcggagccgcatccggaccgggccctcctggactcgcctgtcgctatccccttctcaggccgtggcaagccgagcagccttcgctcagctgcctaggaggaagggacccagtggcgtctgggccacaagggaggggacggccgattgctctggtgcccggcgtggcatgcgggcacggggtgtccgagtacagggcgatgcgggtgcagccaaaccgttgtccgagaatcccataacggggcggcaaaaaaaggggaaaaaagggggcgccgtcgccaatcgttgaacagctggccgcgcggaaaaaaagggcatcgcaaagaggaacaagggggccacaaacagcggcacgtgacacagggaccgtcagccgaaaccccgagggcaaatgcagaaaacagga

SEQ ID NO: 652994 - DNA, 357 bp, Homo sapiens
gctcccaacaagacaggttgctttgacaatttggagtagatctgcaagcttcagactcggttgtgcattcattcaggaagtaaaggatagctagagcagtgcgtttagtgtgtgtatgtgtgtgtgtgtaaatgtttatcatacatacatagggcttgaggcaagggtgggagtgtcattgttgtattttaagtgaataaaaaattttgaagtccatttctgttctttattatctctggtaaagggaaagaaaaatatcctccttgtgtgtgcacttttctagatctttccttgggctgtcttttgccaccatggtcacctggacccttaatctatgttggagagctttgggtaccc

SEQ ID NO: 652995 - DNA, 208 bp, Homo sapiens
ggtgaggactccggcacagggacagtgatgatgacgagcagtgatgacgagcaggaaaagaagccagaagcccccaagcagtcaagaagaagtggcgccgaatgaaccgcttcacggtggctgaactcaagcagctgggggctcggcccgatgtcgtggagatctggaagatcaagaagctcattaagagctgggaggcggctcgcag

SEQ ID NO: 652996 - DNA, 382 bp, Homo sapiens
tcggcgccgagcacctctatgcatcaggacatgtgtaagaaagagctgcgttcttgccaggcacggtggcttacgcttgtaatcccagcactttgggaggccgaggtgggtggatcacctgaggtcaggagttcaggaccagcctggccaacatggcgaaaccccaatctctactaaaaatacaaaaattagccgggcgtggtggcacacgcctgtattcccagctactcaggaggctgagacaggagaatcgcttgaacccaggaggcggagtttgcagtgagctgagattgcaccactgcactccggtctgggcaacagagtgagactctgtttcacgaaaacaaagacaaaaacaaaaacaaaaaaaacaaacaacaca

SEQ ID NO: 652997 - DNA, 444 bp, Homo sapiens
cggggctgaccagaggatccccacttccagagtagttcagaaggaatggtagcagctcctctttgtacctctggtagaatttgggtgtgaatccatctggtcctgggcttgtatttggttggataggctattaatgactgcctcaatttcagaacttgttatttgtctattcagggattcgacttcttcctggtttagtcttgggagggtgtatgtgtcaaggaatttatctatttcttctagattttctagtttatttgtgtagaggtgtttatagtattctctgatggtagtttataattctgtgggatcagcggcgatatcccctttatcatttttttattgtatctattcgattcttctgtcttttcttctttattagtctgactagtggtctatctttttatcttttcaaaaaaccagctcttctactctggaaaggtg

SEQ ID NO: 652998 - DNA, 303 bp, Homo sapiens
tctagaggaccccgtcgtacagttgcggatatggtacggccggtgcgagattaacctctccccggatttcacaggcagcgagaactcacggacgccgcggaaacgcgacgctttccaagggcacgggccctctctcggggcgaacccattccagggcgccctggccttcacaaagaaaagagaactcttcccggggctcccgccgggcttctccggagaatcggtcgcgttaccggcactggaacgccctcgcggccgcccaatctcccgccactccgggattccggggaatctgaaacccga

SEQ ID NO: 652999 - DNA, 234 bp, Homo sapiens
  misc_feature (191)..(191): n is a, c, g, or t
ggtggacagctgttgaaggtagacattgcctaagaccgacttcgggggtccccggtctgcgtggggatgaacatcgacatcgccagcatcgacatggtttccgaagtcaacatggattataccttaaccatgtattttcaacaatattggagagtaaaagctcgctattctgggtccctctcacctcacgnttgacaatcgagtggctgaccactatggtgcccgacacatatt

SEQ ID NO: 653000 - DNA, 814 bp, Homo sapiens
ccttgttgttccttacgtgagcgcccctcttttttcttgtactcgccatgaggttgatttaatttgtttcccgcctcaatagcatgtgttgtttagtgatctgttgtgtggcgggcctccatcgctagttgattatacttgctgcctccccttcttgtcgttgtgtttttatctattcccctaggacttggcttgccggcacccccactccccctctggtggtggtggtgtgttttcttctatttgtgggtggtaccccacccccgcctgcgctggtttagaccccccaccctctgatctctcttttggagtggcatcactgcccaccctctgttatgtacacgcaccttgtgtccggctgctaggggtgggcgccaccctatttatatgtgtctggcgtctatatacacacacccaacagtctggtgttgtgtgggtgatcctcctcaacagaacatctatctgtgtgtgtatattttgtttgctgcgcgcaccactctgtgtgttctgccgacccaacgatgattgtctctcgtcgatgtcccgcagtgagtacaacaccactcaatgggctggtgattgtggtgagtatatactccatcgttggagaccacccgaccactcattatagctcttcctcctccccggcggagcacccccccctattactctcctcccccgcttttttttgtgacgatccaaaaaagaagagaggggttcgatctctccccctcccccccccccacagcgggggggggggagacccccttctttggggtttccccccccttttccccccttttttctttttata

SEQ ID NO: 653001 - DNA, 1349 bp, Homo sapiens
agtttgcctccttcatagacaatggtacggttcctggcagcagcgagaacaatgatgctggatgaccaatgtggatgcctcctgcagcagcagaagactgtgctcgaagcgaacatggacaacatgttctgagagctacatcaacaaccttagtgctggcagctggagactctgggccagtgatgcaatgcttgactgcttggatggctggagctttgcgcaacattgcatgtgggcctggttggcaggcacttcaatgcaacacagtcattgaggatgacgatccaatcaatgcgtaccagaagcatgtgcagcaacgcaattttgtcctcatcaatgacatggactgtgtgatgacatggcttacattgagacaatgtgtagacgcttgcgacgtctacgccttggacagggggccttgaccctggagcgaggactcaatcgttccgtcatggcaggctatattgaagcaggacgactccggggagcattgcaagtcgccaagatactcggggacaacaatcgtgtgtgttggcttgtccagtggaccaaacagtagtcgctgattcccgtgtgaaccagtggcacatgggactacaagttgcatgaggggtcaaatgggctacccagtaacctggacggggactatttctgcacatacctggcaagcactgtgcgccttgacgcgccttggagacaccaattgttacccaagactcaacgtattgaagggacgctggcaagaagccactgggaccttcggcgaacacgacacaccggagggacttgaagccctaggccgggcagccagcgagcacccaacctgacgacatcctcctggcgcggattgacaacacccgggaaacgaatacaaagacccggagcctcccaagacgcgaccgcaaacgaccttcgcaaggcggccccacacaaaaggggtcccaaataagagcagggtattgtccaccatggtgagtatggtgaccccgtacaccactttgtgacggtgaaatggtccgtgaagcactgcgatatggtgacagagagcaggtgacccacaaaataaaagggtggacgtggtccacaaaccgactccagacagtgtgctcaccagccaagctggggagagacgacagacccagcaaccgaagaggcgggccccacaaaaccaggcgcgcacatggtgccgagcagcgaacgagctgaggaacgatacagagaactgaccccacgatgacagctggacatgataacacgacaacacgcatggtgtcagcctcgatggaacagtggaaagatgacccgacccagacgagaacacggatgcgcttggacagcgcagacacaac

SEQ ID NO: 653002 - DNA, 470 bp, Homo sapiens
agaaaaaaacttgggctttaatatatttttgggggggtgaccatgagtgtgtgcgtgtgtgcaaggggaacagttgtttccagggcctcagggccgggcctttgtccttgttttttgctcatccttgcagccaatgcaggccccctccttggggggccggccctgcccctgggcaccccagttggggggggtcagtctttggtacaatggggacactttggtgtgccgggggcaaggttggggggggggccacacagcttttatcatttttgcaaccccaaaaggaaaatggccttgggcccccacaattgtgggctggactggcagggggctccattgcccggtttaaccacccctttattgggatccggttgtttccggggacactccccctttttcagggggacgtcattttatgggaatttcccccaggtagcccgggccttaaacccctttaaaaaatttttggg

SEQ ID NO: 653003 - DNA, 160 bp, Homo sapiens
actcaatatacagttacgtatgcatccggtacacttgtgctgggccgtaatcgatgcttgagattctaaattttttagctgactttgaattcatttcctgtagttgttatggacaccttctccgctgttaggtatgactaagatcatctgaagcctctgg

SEQ ID NO: 653004 - DNA, 1007 bp, Homo sapiens
catatgaattttaggatagttttttctaattctgtgaaaaattacattgttatttacattgtaatctgtacattgctttgggtagtatgaacatgttaacaattgattcttccaatccatgagcatggaatatttttttgtttatttgggtcatctctgatttctttcagcagtgttttgtagttctcttatagagaactttcctctccttggctagatagattcctaggtatttcctttttctgtgtgactattgcaaatgggattgtgttcttgattttgttctcagctagaacattattggtgtagagaaatgctactggtttttgtacattgattttgtatcctgaaactttactgagttcatttatcagctccaggagccttttggcagaatttttagcattttctatgtatagaattatattgtcagcaaagagagaaagttgacttcttcttttcctatttggatgccttttattttggctttggcaaataatttatggctgagttcccaaaagcaattgcaacataaacaaaaattgacaagtgggacctaattaaagagctttcttgcacagcaaagaaattaccaacagacaggctacagaatgggagaaaattattcacgaaataatgcatcttgaccaaggtctaatatccagaatcctacaaggaacttaaatcaaccaagtaaaaacagatagtccatctcacacatgcgccaggactaacagacaccctctcaaaggagacttccagtgacctttgaacaactgttcaaaacgttaatccatcgggcaatgggcagttcaaacccccgtgtagaatccctctttcacccagtaagaaggggattatttaacagtccgaataccgagtctggcaagtctgccctgtgcaaggccattggcaggttcgaaagattaaaagagatccctttgaccagaacgcatagggtttattcccaaaaaagacggacaaattttcgccggccaaaaagttta

SEQ ID NO: 653005 - DNA, 250 bp, Homo sapiens
gccgactgtcagcgtgaaggtggatctgctcttccaagccctgggccgcacctacactgacgaggaatttgatgaacctatgttttgaatttggtctggagcttgatgaaattacatctgagagggaatattaggtaaggaccagggtattgtaaggcagcaggagcctcttatgttgttctttacaaaattgacgtccctcccaatagatatgatctctgtgtctggaggattggttcgaggactcagg

SEQ ID NO: 653006 - DNA, 413 bp, Homo sapiens
aggaaagaaaagaccttttaccgaggaatgtgggctctttcacattattaggcccatagaagcattcaaatgatacggcaatcacatcttattctccccctttagagctatgtattcatctgtcaaaactgcctgctattgccacaagtagctatgaattaacctaataacacctcactggacacaacatcccacactctaaggcttaacaatgggtagccaatcactaatcaatgttatttctgtaaatcaatgagaatccgcggcagaactttgtatcagtccaatccttgtccccctccttttttgcctttaaaaatctgcctgtaataaaggccaagtggagctcatatccaaggtgactgatgtctgaatcttccctatcctggctcaaataaactctttacatcata

SEQ ID NO: 653007 - DNA, 120 bp, Homo sapiens
attttacagtgttagccaccgacacctggtctacctcataaatattgagctctttaattcactatacgggatacttagaataacatgctgaatatcgggattcactgtgataccgagact

SEQ ID NO: 653008 - DNA, 893 bp, Homo sapiens
  misc_feature (36)..(36): n is a, c, g, or t
  misc_feature (48)..(48): n is a, c, g, or t
  misc_feature (360)..(360): n is a, c, g, or t
  misc_feature (678)..(678): n is a, c, g, or t
  misc_feature (864)..(864): n is a, c, g, or t
atccccgtgctgcaggaattccggcacgagattaanaaatggccattnttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctctttcagatccacttcctcatgatactgtcttctaactgggcttacttaaaggatgcgagcaaaatgcaggcttaccaggatatcaaagcanaggaagaacaggaactgcaagatatccagtctcggcaaaagacaactcaattttacacataaatgtttgcagaagtgttcggcgacgtattacagcttgacaaatcatagacagtcgtctgagacagatgtgatccaccaactaatgcgatgtcaacacttactgctgctcaagctgtggatgatcttaggaaacctcacgggtaatcctttcttagacaaatatgacgctcatgtagcatttaaaggcacacttgcaaatgacgtcatacttggaattgtgatggtacattatgtaggcatctacagacactatganatgtccactctataggacctggatcctataagaaccggcatgccagatcaaggataaaccgaactacaatatgccattggcctaggtattcaatggataaagggatggattaagtcattctggcagttgcttattaacattggctcaagaaagggatttatgatggttctaagtgaataggtcaantgggcgccccttaaagaatggacgggcct

SEQ ID NO: 653009 - DNA, 234 bp, Homo sapiens
  misc_feature (193)..(193): n is a, c, g, or t
cagggcgtatcatgtcctttatcttgcttacccttttgctgccggccgtctatgcgcctgctcaagcctgcatggccagctgctgatgctggtcaagcctgcagttctgaactgcagccgggccagtgtctggcaatgggcggcatctgtgcgcgatgcctgcccttgttcacctgagtgtggagttggatcnctctagtagtctgaccttgctaggctatgccatagctttgt

SEQ ID NO: 653010 - DNA, 112 bp, Homo sapiens
atggagtcgatactcagactctcaatctagtcgtgctaaacggatacgctccttgacacatccatgtatgtagtctgcacggggaacagtgggatatcctcatcttatcttg

SEQ ID NO: 653011 - DNA, 444 bp, Homo sapiens
cggtgcttcctttgtctcatgaaatatgtgacatttccttaatcattctgttgttttcatagagtgcttatttgccctctgttagcgagaataggctagaaatacttcccagaattgtttatagccctgtaggatttgagacagatttctcatgtttcaggaaaatatcagttggagcaaagagaactgtaaaagcaaacattgaagtcatccttttagtcctcccatggactttgcggttggaggtgacatgccttgtaaacaaaacctgcaccaatatttgtctgaggctgctgtttatcatgttgttgtctctggcaataaaaatgggaaacaattgaaaagccccgtcccaagggcatattaagttacagctggactctgggatagcatgtggttactaaaggtatgtgtttgcaaattatttaaagacaaagggaaaca

SEQ ID NO: 653012 - DNA, 991 bp, Homo sapiens
  misc_feature (158)..(158): n is a, c, g, or t
  misc_feature (162)..(162): n is a, c, g, or t
  misc_feature (167)..(167): n is a, c, g, or t
  misc_feature (254)..(254): n is a, c, g, or t
  misc_feature (287)..(287): n is a, c, g, or t
  misc_feature (293)..(293): n is a, c, g, or t
  misc_feature (299)..(299): n is a, c, g, or t
  misc_feature (303)..(303): n is a, c, g, or t
  misc_feature (314)..(314): n is a, c, g, or t
  misc_feature (328)..(328): n is a, c, g, or t
  misc_feature (331)..(331): n is a, c, g, or t
  misc_feature (348)..(348): n is a, c, g, or t
  misc_feature (359)..(359): n is a, c, g, or t
  misc_feature (376)..(376): n is a, c, g, or t
  misc_feature (399)..(399): n is a, c, g, or t
  misc_feature (401)..(401): n is a, c, g, or t
  misc_feature (411)..(411): n is a, c, g, or t
  misc_feature (413)..(413): n is a, c, g, or t
  misc_feature (417)..(417): n is a, c, g, or t
  misc_feature (430)..(430): n is a, c, g, or t
  misc_feature (464)..(464): n is a, c, g, or t
  misc_feature (467)..(467): n is a, c, g, or t
  misc_feature (470)..(471): n is a, c, g, or t
  misc_feature (480)..(480): n is a, c, g, or t
  misc_feature (491)..(491): n is a, c, g, or t
  misc_feature (502)..(502): n is a, c, g, or t
  misc_feature (512)..(512): n is a, c, g, or t
  misc_feature (516)..(516): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (541)..(541): n is a, c, g, or t
  misc_feature (546)..(546): n is a, c, g, or t
  misc_feature (548)..(549): n is a, c, g, or t
  misc_feature (564)..(564): n is a, c, g, or t
  misc_feature (569)..(569): n is a, c, g, or t
  misc_feature (578)..(578): n is a, c, g, or t
  misc_feature (597)..(597): n is a, c, g, or t
  misc_feature (599)..(599): n is a, c, g, or t
  misc_feature (604)..(604): n is a, c, g, or t
  misc_feature (610)..(610): n is a, c, g, or t
  misc_feature (621)..(621): n is a, c, g, or t
  misc_feature (626)..(626): n is a, c, g, or t
  misc_feature (634)..(634): n is a, c, g, or t
  misc_feature (676)..(676): n is a, c, g, or t
  misc_feature (689)..(689): n is a, c, g, or t
  misc_feature (876)..(876): n is a, c, g, or t
  misc_feature (900)..(900): n is a, c, g, or t
  misc_feature (991)..(991): n is a, c, g, or t
ggcagggtagcttctcccgcccccacaggttcttctacctctaccacttcgccttctatgcctaccactaccgctttaacgggcagtacagcagcctggccctggtcacctcctggctcttcatccagcattccatgatctacttcttccaccactangagntgccngccatcctgcagcaggtccgcatccaggagatgctgcttcaggcgccgccactgggccccgggacccccacggcgctgcccgatganatgaacaacaactcgggcgccccggctaaagcncctgantctgcnggcnagcaccccgcnctgggccccgtctngcntggggccagcgggagtnccgggcctgtngcagcggcgcccagctncctggtggccgcggcagcctcantngcagcagctncnggtngttacctgggttngatggcagagaccgctgccatcatcacagacgcntcnttnnttttttgcnttatctctttntttcttgagcngcgtccagcnatcncgcttggcnctnctngggggnttcnccacncnncccaggatatttttnccccnatttatttnttatcttcttatacaactntncttgnggcttnggtaggagggnatagnaaggaatnaatggttccaacggaggcgccctcggaggtggggtttgagcngcacagctgagcngcctcttaaccctgctggctgggcctgaccttcccgagcccgtgggggtgggggaggccagccacctccttcctctgggactgcccagcctgtgtcgggggctttcagggtttcgtggggtttgcccggaaggcggctttcctccccctgggtgtgaggtcgcgcccgaggcttgtacccgctagtnaaggtgtttgagctggtcagcaangagaggggggtggggttccgcggaaggttcttgagggggtcttggtaggtctgcagtgaaacgtcctgaggatggagtggggtccatggtn

SEQ ID NO: 653013 - DNA, 229 bp, Homo sapiens
ctctgaacggtgaaacacccgcgcgatatttccaacgtcagagcgccgggccagatgctcaggctcctaggactcttggcctgtggctcctcgccatagacactcgaggatctatttctagcgaaagtatgagacctcgtagctactgtagggtatgctactatactagtagtctacctaggggggcagcagtaggagaacggccaggtagggcagcacaggcagtcca

SEQ ID NO: 653014 - DNA, 1119 bp, Homo sapiens
  misc_feature (68)..(68): n is a, c, g, or t
  misc_feature (70)..(70): n is a, c, g, or t
  misc_feature (81)..(81): n is a, c, g, or t
  misc_feature (97)..(97): n is a, c, g, or t
  misc_feature (136)..(136): n is a, c, g, or t
  misc_feature (139)..(139): n is a, c, g, or t
  misc_feature (157)..(157): n is a, c, g, or t
  misc_feature (337)..(337): n is a, c, g, or t
  misc_feature (350)..(350): n is a, c, g, or t
  misc_feature (404)..(404): n is a, c, g, or t
  misc_feature (438)..(438): n is a, c, g, or t
  misc_feature (557)..(557): n is a, c, g, or t
  misc_feature (621)..(621): n is a, c, g, or t
  misc_feature (623)..(623): n is a, c, g, or t
  misc_feature (629)..(629): n is a, c, g, or t
  misc_feature (632)..(632): n is a, c, g, or t
  misc_feature (641)..(641): n is a, c, g, or t
  misc_feature (812)..(812): n is a, c, g, or t
  misc_feature (1024)..(1024): n is a, c, g, or t
  misc_feature (1039)..(1039): n is a, c, g, or t
  misc_feature (1098)..(1098): n is a, c, g, or t
tgaaccagccgggcggcgcggcggctccgcagctgacggagccagttcagccggaagtaaaatcactncnatcattgagcnctttaagcgcaccagnaagatcaccaaggtggatggcccatatccatttccagcngangcctcgcttatttccgancaaggaacgattacggaggtgaaggtgaaaacagatctgcccgataactacatccataaggtgatcttgcagggcgaggccaaggaggagaagaaggcggtcagcaaggatgggaccagctacgtgccttccgaaatctgctttgtgatcggcggcgtccgcaaccagcagacccttggntcttactaattcngaatcttttgcaagaattacaattattacaacttcttccagacccacgttcggnctcaccgaaacaccgaagccacctcatgggatgnagcctcccaaatcaacaatttcatgtacacatgttatatctgctggaagaagtacaaatactacatctgtttccaatatcaccgatacctgcacgcatgatgtttttagtgtggaaggngccccttataaccgggcagaccccttctaccaaagtgtcgtggccacggacgatgtgaaagatnancccccnganccattccanaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcagtactgcncccgggtgggagccaccggatgatccagacacgggctctgagtgttcacatccagaggtctccccatctccacgcttcgtggcagcgaagacccagacgaaccagtcggggaaaaaagctccggcctccgtggtccgatgcggcaccctcttacaccgcacccctccagccacccaaacccagacgttccgcactccaaattcgggatctcngcgagcaaggcaacncagccagaggtacttgtggcaaggaaagctattcaaatgtgcatatcagctgagcagtntaaagtttgcagctcaattgt

SEQ ID NO: 653015 - DNA, 225 bp, Homo sapiens
ctccagatacatgtcaaaaaaaaaaaggtgtttgggcttccgttttgtttttgcccagtaaaaaagtcaagcaagtttgttccaggtgccccattgagctgggtatgcatttttgtttatttcaataaaaaatatttgtattatttgtccttcaaactatccatccatcccccccttttttttgtatcaggtagtttaataaaaatatccctgttttgttctaca

SEQ ID NO: 653016 - DNA, 289 bp, Homo sapiens
  misc_feature (26)..(26): n is a, c, g, or t
  misc_feature (272)..(273): n is a, c, g, or t
tcagtaggttacgctgcatctttgtntttattctgatcccttggacacacattaagtgtttcagatgtagatcactacagcttttcttttcttttcttttctttttttttagacagagtctgactctgttgcacaggttggagtgcagtggtgccatcttggctcactgcaacctccgcctcacgggttcaagcaattctctgcctcagcctcctgagtagctgggattacaggcatctgtcaccacgcccggcttttttgtatttttagtnnagacgggattttacct

SEQ ID NO: 653017 - DNA, 149 bp, Homo sapiens
gccaagagagagatcccgggtgcataactgctggcagcaccgacgaaccccaatgctgaccaaggaggagcctgttccagaactgctggaatctgaggccccgaagcttacctgtctttgagccagtgccacctgtcgggctagtcggg

SEQ ID NO: 653018 - DNA, 118 bp, Homo sapiens
agatcgacgtgcgaaagcgccgagaatggcggcgggtgcgcttataccacgggcctgcgctgtagcctgcgcgttgtgcccccatgctgcccatgctgtttgtacatgctggggtgac

SEQ ID NO: 653019 - DNA, 150 bp, Homo sapiens
gggctgtaagcatggatatgcttgggtcagaaacaggccgaggcagacagtcgggccagagtgactcagcaagtctggagcacaggcgtataaatccacttttggttttattggttggtttaggttttttttttggctgtggttttggaa

SEQ ID NO: 653020 - DNA, 402 bp, Homo sapiens
  misc_feature (54)..(54): n is a, c, g, or t
tgggcttaagtgattctcctgccctcagactcctgagtagctgagacccacagntgcatttcacccactcagcctaatttttagtttttttgtagagatgaggtctctaccaagctggtctctaactccctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaaca

SEQ ID NO: 653021 - DNA, 1215 bp, Homo sapiens
  misc_feature (1215)..(1215): n is a, c, g, or t
gcacaggtgtcgtgaaaactaccccgtaaaagccaaaatgggaaacggaaaaaggactcatatcagcattgtcgatcatggacacgtacattcgggcaagtccacacagtacgtggccatctgatctcatgaaatgctggctggcatcagacaataatgagaccatgtagaaccatacagtttgacgaaggacggctgctgacgatgggagacagggtcgtccgtgtcatacgtatggcctgggttcttggaataagaacttgcataaggctgatgctggtggaaacagtgagtaatcatccaattattgtactatactcctttcgttggcatagaattttgcatggaacccaaggtcgatagctacgtgatgatgacactagtccatgtagatagcctcccagagtagcacattggagaatcttttactccagaaggaaacaatgaatgtagcagcgggaaccgagtctcaagagactggagcttgtagcatgtgcctggaattgttcgctgcatgagttgtctagggagaaatctggaaaggcttggtaagttctccagatgatagtggcgcatgacccgcgagtagcattgccccattcgctgggcatataacaaacaacttggggatgtgaacaaatcaatacattgaaatcggaggtccgagcttgtctaagacgtacacagactcggaacttccggacgtgaaagacacgactcgcatttgacgcaggccccaggagaagcagccaagtcatgaaagggtgacaagtttgcttacaagggggcaatggttccaaggcaactttgacgattttcaaggacaaacacagtttggggccttaaagaaaaccccctataaggaaacaacggtagaaccaattatttggtaggcccgcagcattttgggcccttaggggtccttgaggacaagtaagtggtctcgaaccttaccaccaatttgggccttggtgcatgtgccccaaatatggttggccattacaacgcaaattggacccttttaggcggttgtcacacagaagagggggacaccttgggggaataattggtgacaatcccccgggtgtcaaacgagggactttcgagtctcgagattcggccccaacgcttgtgcgaaaacgccaaacgggcttggcgctatggaagcgggggtccatgggaggacccttagcctattgcccgtgaaaccgaagn

SEQ ID NO: 653022 - DNA, 456 bp, Homo sapiens
  misc_feature (8)..(8): n is a, c, g, or t
cccacttnttgagataaaaggggcaaaaccctttgtgttccactatagcttcacgaatcagcaggctacccaaagatcacattctgagaaggattcacccccacacggagtgggtattatttttcctctagtgcatttaaaatatgattggattttaaatattcattttccacacaattaattctactaaaacatggggcccagcaaatgataggttctccacaaatgtttgaggacaacctgaatgaaccagtgatgggaatgaatgaacaatatggcactgtgccctcattttagaatctgaaatgagatattcacaggcttttttttttttttccttcttcgggccctcccaccaagggaaataggcttctcattggcctactagaaaattgttttcttccaagggagttggcggacaacttgaaacttggtcctacggttatacgacctcca

SEQ ID NO: 653023 - DNA, 1015 bp, Homo sapiens
  misc_feature (47)..(47): n is a, c, g, or t
  misc_feature (84)..(84): n is a, c, g, or t
  misc_feature (148)..(148): n is a, c, g, or t
  misc_feature (170)..(170): n is a, c, g, or t
  misc_feature (179)..(180): n is a, c, g, or t
  misc_feature (245)..(245): n is a, c, g, or t
  misc_feature (273)..(273): n is a, c, g, or t
  misc_feature (416)..(416): n is a, c, g, or t
  misc_feature (440)..(440): n is a, c, g, or t
  misc_feature (526)..(526): n is a, c, g, or t
  misc_feature (542)..(542): n is a, c, g, or t
  misc_feature (603)..(603): n is a, c, g, or t
  misc_feature (639)..(639): n is a, c, g, or t
  misc_feature (641)..(641): n is a, c, g, or t
  misc_feature (644)..(644): n is a, c, g, or t
  misc_feature (647)..(647): n is a, c, g, or t
  misc_feature (654)..(654): n is a, c, g, or t
  misc_feature (667)..(667): n is a, c, g, or t
  misc_feature (673)..(673): n is a, c, g, or t
  misc_feature (689)..(690): n is a, c, g, or t
  misc_feature (725)..(725): n is a, c, g, or t
  misc_feature (737)..(737): n is a, c, g, or t
  misc_feature (743)..(743): n is a, c, g, or t
  misc_feature (752)..(753): n is a, c, g, or t
  misc_feature (755)..(755): n is a, c, g, or t
  misc_feature (762)..(762): n is a, c, g, or t
  misc_feature (771)..(771): n is a, c, g, or t
  misc_feature (774)..(774): n is a, c, g, or t
  misc_feature (807)..(807): n is a, c, g, or t
  misc_feature (813)..(813): n is a, c, g, or t
  misc_feature (815)..(815): n is a, c, g, or t
  misc_feature (822)..(822): n is a, c, g, or t
  misc_feature (870)..(870): n is a, c, g, or t
  misc_feature (908)..(908): n is a, c, g, or t
  misc_feature (928)..(928): n is a, c, g, or t
  misc_feature (931)..(931): n is a, c, g, or t
  misc_feature (938)..(939): n is a, c, g, or t
  misc_feature (1001)..(1001): n is a, c, g, or t
ccgccgcttcgccgcagcgttgagccccggggccgcccctaatttgncaaaataacgcaggagagaggagccaaaaaagttcanactgctggaggaaaaaataattaactaatgaaaaaaaagtcagggggagaccttcctgggcctncctttcgtcccaagtgccccgntctaggganntagtggggagatgcgcgcgattcatagagaccatgggcgaggaggtggggcaggaaaggcgtgtnggcagagtttagtgtttggcaaacagtngggctgggggtgggatctgggagggagccgacgcgggcgctgcgcggaagggaaaagatcttggaccctgccaccggcccataggacgactctaaaaacactttataaaaattgagaggccgacagagtagaaagtaaaaacnagtcatcagaatcaaaaactaaanagtggaaagatttttttttcttgtctaaaagagcaaaaaactacaaacagcccaagtcctgaagctccccaagacctggatcctcnactgtccccctgaaanccggcaggagcgcgggatggggagcacaagagagatgggttcttaaaaaagtcacccgctnagatgggaaaagctcttcatcttctgccgccttccncngantcncgcagcngcagaggagaganatgganaagaacggggctatgnnggcaaactcaacttcttcccctttaggactttggngatatagaggtngaaganatcgcagtnnangactgtntggaccagnccnaccacaatggcgatgaggtcgagaagccctcgnaatggnancgcaganccagttgaagagatagagcgtgcggtaaacgcctagcgcaaacaagtngtggctggtgaaggtctccgcctcgccggtcttgctcnccatgaacagctgcggcaanatngccactnnctccaggtagatggagaaggtccagaggatctccagaagggtgaagtcatgattgaccaggncgccagattggtgg

SEQ ID NO: 653024 - DNA, 1148 bp, Homo sapiens
  misc_feature (1148)..(1148): n is a, c, g, or t
cggacgcgtgggtcgacccacgcgtcgagcctcccgagtagctgggactacaggtgcccgccaccacacccggctaatttttttatttttagtagagatggggtttcaccatgttggccaggcaggtctcaaactcctgacctcgtgatctgcccgactcggcctcccaaagtactgggattacaggcgtgagccactgcacctggccagcttcgtgtgtatttatagctgctccccatcactcacatcactgcctgagctccacctcctgtcagaacagacccagcattagactcccctaagagcgtgaaccctattgtgaactgcgcacgtgaaggatctaggttttgcgctccttatgagaatctaatgcctgatgatctgagatggaacggtttcatccagaaaccatccccctgcttccctgtctgtagaaaaattgtcttctatgaaatgggtccctggtgccagaaaggttggggactgctgtcataaataacattgaatttcatgtgggttttttttttggacacaccaggcatgtcatcttccattcaaaggctagggctacagagggaaggggttagccagaataatttatccagatggcttcaacacaaaaggataacaaacgttggcaactagatctagtgcctgcaggtttgaccaggtcatgcggggtgtgtgcgtgtccaggcctccggggattttcccggggttatccagtggcgcgtgcacaccggctggattcaccggtgatcaattcttcaccatacagcgccaatccttgggcctggttttgcgaacaggtttttggcccaggtatttatcatctcggctgggacgtcgcatcatctggtgcagcgcaaccatgcacctatgcgagaagtgccctcaccggttacccacctagtggcgtgcacaatgtatatagcggaacacaccggactcccggtagggagagacttcaacgcagcatcttgtgtttcgctgggccacacagatagctggtatacgactggtgtgctgctgaagaaacccattcgtgcaaacaaaaacggcggcgctagtcatcacaatgccctgactaattcatgttaaaaagtgccacgaatgagtgattagcagtacatcacttagtctaacan

SEQ ID NO: 653025 - DNA, 85 bp, Homo sapiens
taaaggttaaaattagattttatggttacaaggggggaccccaccaagcagggtcagtgacccccaaggtaggtgctggagggtg

SEQ ID NO: 653026 - DNA, 467 bp, Homo sapiens
  misc_feature (96)..(96): n is a, c, g, or t
tagatcaggcagcccttgagcataggtgttatcgcaacacacactccacactttaaggtacaatgatagtgcaaaagcattttgcggacgaatagncatacccaccacatcacaccccagcgtttgcatcatgcggatttccgctggtgtttcgaaattaggcccggtgtaagcggcaaataccccttcagccagtggaatacccacgcgttcagccacctgggccaactggctgcgcaggtcacgatcataagcgttcgccaggctaaagaaacgcggaccaaaacgctcatcgttgtcaccaaccaatggcgattcaggcataaaattaatgtggtcagtaagcgctaccaggctgcccggtggtaccgactggcgcagcgaaccggctgcgttggtcgccagcaggaattcacaaccaagcaatttgaaagtgcgcacggcggtggtcatcacttggtcgacgc

SEQ ID NO: 653027 - DNA, 146 bp, Homo sapiens
ctgcacatggacagagcaggtagaagagacgacataaaaaaatcagttagcagcttcacacttgcttatgagcaggctcatgagaactcactatcactagatctgaccctgtgatccaatcacctctgctgggaagccacgcggtc

SEQ ID NO: 653028 - DNA, 160 bp, Homo sapiens
aaaacaatagccaggtgtggtggtgagcacttgtggtcccagctactcgggaggctgaggtaggagtactgcttgagcccagcgaggcagaggttgcagtgagctgggatcgcaccactgcactccacccttaatgacagagtgagtgagcctctgtctt

SEQ ID NO: 653029 - DNA, 420 bp, Homo sapiens
ctagaggatccccgcggcagtggagagagaaagcaagagcaagatgaggaggtggggaaggctgatgtttgtatgtgatctcagagattctcctcgtgtgggaaagaggttgaggcttcctggtgtccttcagagtaatcctgaggagtcccagcttagggagtcactattggaggcagagaggcatgcaggcggggtcctaggagcccctgcttctcgcggcactcttgcctttgatgtcttcgtgtgaatggatggcctccctactaggacatgggaggagaataacccaggtcttaaggaccccaaagtcaggatgtagtatgatcttctcaatcatctagttccctgcttgatgagaggatcctaatgaaatacctgaaaaatatattggcatttatcaatggatcaaatcttcat

SEQ ID NO: 653030 - DNA, 591 bp, Homo sapiens
  misc_feature (15)..(15): n is a, c, g, or t
  misc_feature (171)..(171): n is a, c, g, or t
cacaaccaaaaaaangacaatgacactctcaaacaaaatggacctacaagatattacaggaacgttctatccaagatatgcacaataacattctcctcatcatacatttacattctccaagatagaccatatgataggctcagaccacagtggaataaaagtagaaattanctgcaaaagaaaccctcaaaactatacaaatacatggaaattaaacaatctgctcctgaattatgagttaacaatgaaatcaagatggaaatttaaaaattcttttaaatgaatgacagtagtgacacagattattaaaacctcttgagatacagcaaaaaaaaaagtgctaatgggaacgtttatagtgctaaatgcctgcatcaaaaagtcggaaagatcacaagttgacaatctaatatcacacctcaaggaactagagaaacaagaacaaactaaacccaaagctagcataagaaaagaaataataaaaatcagagcagaactaaatgaaattgaaacaaaaaaatgcaagagataaatgaaaaaaagctggttctctgaaaagataaaattgatagactattagctagattaacc

SEQ ID NO: 653031 - DNA, 179 bp, Homo sapiens
cttttttggaattttggggtgggggtcatttttggggattatggctgccccccgggattttagtgtaggaagtgtgggaccacccttggcaaatggggcacccgtgccctgcaggtgtttacaaaatcccccatttgtaatgtccttggcccaataaaaccaaatgtcagtttccctga

SEQ ID NO: 653032 - DNA, 825 bp, Homo sapiens
caaaccttctgtaatctctaaaacaatgggaccaagagtccactgagcccattcagcaacgtttacaggtttcgttctccggaacgtccaagacctggtacacagtcagtagtgtcaatttgtgtaaagtgtggtacttgttgtcacaaatgtgtctaatataatggacgcatgagccggtggtgaggcaatacggaatagcaatcaaccagtggtcaagacgagtttgtggaagtgtggcagtctggtctggaccgtcagtgcggagcacataactcgcgttcatgagtacagttgctgcctacaagagcagataggggagcgcgacacgacgcatggtgatagagacatcactagagatgtacaaaatatacgaaagctggactgtcaagatcaccacagacgtgataaccagcagctagcacataagacatggtgagagaagcaagagcaaggggacagaccataggagacgaaccagtagcgcgatatatatcagtgagacacagattacacaagtgggcaacatcacatccacataaccatcaacaagggacatgctaagatgaaggagtgtaaagagtagacatagcggatgtcacgtgcgaagaacgacccaggacatcggggtggacccgagacccagtcgggaggggcaaccacaaagtaacacgcgtaacagagcgtggacaaggggggaagagggcgcggaggaggagaggaggaagcgggggcgcggaggagaaaggaggaaagagagggcgagggggaagggaggaggggggggagcggggacggggggggggggggagaggagaggggaga

SEQ ID NO: 653033 - DNA, 412 bp, Homo sapiens
  misc_feature (403)..(403): n is a, c, g, or t
cccccctgcggatgggaaggtgagtaccagagaggagggagctgcacaaagagatctgctcaatagtacttggaagtcttagacaaaataactctggaaaattataaggctgaggaattcccagtgttcacaaagaacaagggtaagacatttaaatttggtcaagctagagtagaaaagccactctaaacactggggcaacgaacagacttcttggggagggccatcctttatatcaaggctaacctagttctaggtctgtcctaaccaaactgatctacaagtaatttaaatgacggccaaaacatacttcaccattctttaatgggataaaatctactcaaccctgcaacattccaaatgtatgtcattttaccaaaaatttctagatatctgaaaatgncacaaatgg

SEQ ID NO: 653034 - DNA, 380 bp, Homo sapiens
agttgttcgtttggagttactgttcgaagtatttattgaagatgattacgatgagtctcagtcggacgggtgtagagaattctaagaaggtacgaagttagttttcgtagcgttgcttatttgttttctcgggttcgttcgcggtctcgccgtttcttctcgcggtggtaggattcccgaggggtcctgcgtttcgtctcggggtttaggtggggtcggcttatacctttaggttttaatagttcctaaagacgggcaaaggagtccgtttctttcgggtttttgattccggcgatctgttttattatttttagtttcgctttcgttattttcttcagcggggatcagcgaacgatccgattcgcgattctaactccgcg

SEQ ID NO: 653035 - DNA, 991 bp, Homo sapiens
  misc_feature (505)..(505): n is a, c, g, or t
ggttgatctgcagaagccctaggtagatagtcatgcagatcacagacggtttaccagtcttcgtgttcactttagtaacacttgtgaatgtgctcaagtcatcaaaggtatgcatgttcgaatagtctgaatctctcttagagatgctcacttcacagaaatcctgtggtgttaccaatgtgccgtacgttatcacattggctgagaaacgattaggacaggatgatagtcgccagagaccaagtcgaatgccgtccctggtaactactggatggatctgtgtgagtgcgctaataacagatgtgcttgacactattaatggcctcgtgagcatgacctcttgaaacactgcgacaaagtctatgatgcagtgcaacgtaaatgagtggtatgtagtattgatggtaataccggcactgtgactcttcttcgcagccattagtccatcgtgtgaacaatgagctacctgtaaagacctacaggccgacccggagaccagactccnacctgtcactggaacagcaaactgcaggcgcagtaactgatggacgccttcgtcctccgtgaactcagcaagtttacatgactgtgaaatccgtgtcactgtgtgaccgacacgtgcaaccacacgcacgtacgcatatgcgcctgaacaatccatagaacgaacgtgaaggcgtctatggttccccagtacaagatcaaaccatacgtgaatatgtctcacgaaaagaagagggagaagaaccttcgtagacgcaacaaattagataatctacccttgtacaatggggccaactccgtgggaactgtatacaacgtttcccacgacgaattgttccaacacggacattcaccacttgcctacaattaaacaattgggcggtaatcgcccaaatatatccacaatatacaaaagaaagaacccccttcaaatcagggccatccatataagtcactacagacatgcacaagaaacgggcataaacct

SEQ ID NO: 653036 - DNA, 219 bp, Homo sapiens
tgctgggtgactctaaggatcccatgcaccattccgactaaagaggtcattcacttgttactcttagctgtctagctttttcaactttcgagacgtctttcaatatcatcatctggaatagtcagctgaagtgatcgttaaggtcttcaagacctgatgcagtagtattaacattgagtgatgaatgaatattactgggagggctcggagaggagatgc

SEQ ID NO: 653037 - DNA, 146 bp, Homo sapiens
cggaccaggatggcggaggctaataacccctcggagcaggagctggagagtgagcctcgcagctggtccctgactagagcagctgggcctggccggggcagacctggcggccccggggtacagcagcagctggagctggagcggga

SEQ ID NO: 653038 - DNA, 1930 bp, Homo sapiens
  misc_feature (950)..(950): n is a, c, g, or t
cccctagccttaccagtggctgggattacaggcacgcaccaccatgccaagctaattttgtatttttagtagagatggggtttcgccatgttggtcaggctggtctcgaactcctgacctcaagtgatccaccctcctcggccttgcaaagtgctgggattacaggcatgagccaccacgactggcctgaaggggcttcttcatcttggggagttggtggaccctgtcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaanagttggggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgacttgaatttgcactctttaatgttgcgtatctgctctagtgggcaggacctagggcttaaaggggaacttcctttctccaattctaggaactgggactccaaaatgagaagctggttgtctgaagtaaccctgcaggtgtggttggggaaggtctgttttcttggatgaagggattaaactgagcaaatcactagaagtatgccctgtcccctgctcagaacactggggagctcaagagtgggctgcaatgtgcacccctcaggaatagctgtgaattgcaggtctactggctttttgctttttgtcctttgctgcaaggtaccccacgtacttaaccattctcaacagtgtaaatcagtgtcattttagaatgagatactcagcttgcttctaaagtcactgaattactgagtgagtctctcctttagagtcttcggcaaccaaattccagaattgaagagtctactactcagaggcaacaagattaaaaaaagaaaacacaaaaactgttgaggtg

SEQ ID NO: 653039 - DNA, 112 bp, Homo sapiens
gtgtgcggctgcactcagagggctcagccggaccatcctcatgtgtggggctctcatcaaggaggagactcacaggagactggatgacctgttcctccccctggtcatgggt

SEQ ID NO: 653040 - DNA, 1226 bp, Homo sapiens
gtgggatgttagccacgccgagaagggctttacacggcaaagaagtctgcgactgtagggaggaaaaacgtcagcagacaagctgcaacatgtcaagggcaatcgtgtatcagctggcagcaggccaggcaacacatgggcaacacagcagcaggtgttcaggacacagtggccgttccagcagtcaagcttgcgcactggcatggtccaccattttatccacgagggcattggaggaaccaactacgcaattttacgatcacgcttatgttattagcaaagatgcactccaagaggcttgggtcgccggtggcatcacgcacgtgtaaatcctcagcagatccagggcaagcacgaggcagggatagatcaccatgagagtcacagacggccacagaccacgccatggaccacacactggtgcaaacacccgtcatctcacatacaacatacacaaattcagctgggcagtagctggcgaggcaccgagtaatcccaggcaacatcgagaaggcctgacggccaggcagaatccactttgaaccacaggaggcgaaagatacgcaagcgaagccgacgatcggggccaaatggcaccccaagccagggagaatccagcagcaaaaacaactcacgtcacacacaaaacaataacaacgacaacaacagaaacaaacacaagcacaaaaaaaacacaggcgagaaacagaaagcaaaaaacaacgaccacaaacagagaggccacaacacgcaaacaccatgaaccaaagacaccacaacagaccacaaagaaaaagacaacacaacagaacgcaacataaaaatgaaacacgagcacagaagcgagggcagcgaccagcaaccacacagacaaccaagaccagggcaccaacaccgccaaacaaaaaaggaagaaaacaacgtggggacaccgcgcgccaacacaaaggaacaccccacaccgcaaagagcgagcaccacaacaacggcacacccaacacgacaacaacaaggcacacagatggaagaaacagacaactaggagaaaaaacaacaacagacaaccaccaaaaccagagaacaatacacagaagccacaccaacaacagcacgacaacaaacgacagaaagacgacaagagaaagacaacacagaaagaaaccaacacgaaaacgaaaagagacaaccaaacaatagcacgacgagacaaaaacaccaaacacacg

SEQ ID NO: 653041 - DNA, 1970 bp, Homo sapiens
  misc_feature (950)..(950): n is a, c, g, or t
  misc_feature (1945)..(1945): n is a, c, g, or t
  misc_feature (1956)..(1956): n is a, c, g, or t
  misc_feature (1970)..(1970): n is a, c, g, or t
cccctagccttaccagtggctgggattacaggcacgcaccaccatgccaagctaattttgtatttttagtagagatggggtttcgccatgttggtcaggctggtctcgaactcctgacctcaagtgatccaccctcctcggccttgcaaagtgctgggattacaggcatgagccaccacgactggcctgaaggggcttcttcatcttggggagttggtggaccctgtcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaanagttggggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgacttgaatttgcactctttaatgttgcgtatctgctctagtgggcaggacctagggcttaaaggggaacttcctttctccaattctaggaactgggactccaaaatgagaagctggttgtctgaagtaaccctgcaggtgtggttggggaaggtctgttttcttggatgaagggattaaactgagcaaatcactagaagtatgccctgtcccctgctcagaacactggggagctcaagagtgggctgcaatgtgcacccctcaggaatagctgtgaattgcaggtctactggctttttgctttttgtcctttgctgcaaggtaccccacgtacttaaccattctcaacagtgtaaatcagtgtcattttagaatgagatactcagcttgcttctaaagtcactgaattactgagtgagtctctcctttagagtcttcggcaaccaaattccagaattgaagagtctactactcagaggcaacaagattaaaaaaagaaaacacaaaaactgttgaggtgaaaaaaaatagaaanaaagatccgtngacctcaggggggn

SEQ ID NO: 653042 - DNA, 145 bp, Homo sapiens
gtgaattatccttcaaattgtttctttgagcttcattgaagatctacagagtctagaggctagactgtctcaaaactaaggacagaaccctgtgggcaggtgggtgtgagaaactcacacaccgcactcttcacagacccacaag

SEQ ID NO: 653043 - DNA, 1446 bp, Homo sapiens
  misc_feature (950)..(950): n is a, c, g, or t
  misc_feature (1437)..(1437): n is a, c, g, or t
cccctagccttaccagtggctgggattacaggcacgcaccaccatgccaagctaattttgtatttttagtagagatggggtttcgccatgttggtcaggctggtctcgaactcctgacctcaagtgatccaccctcctcggccttgcaaagtgctgggattacaggcatgagccaccacgactggcctgaaggggcttcttcatcttggggagttggtggaccctgtcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaanagttggggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgactttccgtatggatgcacaacaaanaaaaaaaag

SEQ ID NO: 653044 - DNA, 205 bp, Homo sapiens
gcgacgagatgtgacattctgaaatcagagatactacggaagcgacgcggtggaggacaggcacctactggtggaaataaaatataacagcgtgtgacgctcgccaaagaagaggaagcatatttgaaagatgtggctacagatacagccaaaagaggaggaccagaaccattacgtcatcgaatcaagtatatagacttagact

SEQ ID NO: 653045 - DNA, 383 bp, Homo sapiens
tgatgacaactcgacactgattgcataaacaaacacacaaaaagaaaactaatgaaaactctgcagtttaactttatctccctccttttggctatttggtttctctttagttcttattgccttcaaaagttctgtatcttcaaaagttgttgtagttacgatttcctgttggtttaccatttagcccttctactgaagataggagtagtttacatagtacaattacagtgttataatattctgtgtttttccgtgtgctcactattaccagtgagtttgtaccttcagatgatttcttcttgcttattgacatatttttctttcagattaaataactccctttagcattttcttgtaggacacgtctgatgttgatgaaatct

SEQ ID NO: 653046 - DNA, 580 bp, Homo sapiens
  misc_feature (568)..(568): n is a, c, g, or t
  misc_feature (576)..(576): n is a, c, g, or t
gagatgggatcttgccaggctggtctcaaactcctgagctcaagcaatcctcctgcctcagcctcccaaagtgctgggattacaggcctgagctactggacctggctggtagtcctatttttaattttttgaggaaccgccatgctgttttccacagtgcctgtaccattttgcatccctaccagcagcacacagggttccaatttccccacgttctcaccagctcttgtttttttcctgtgtgtggttttgtttgttttgtttgtttttgttttagacagagtttcactcttgttgccccgcctggagtgcaatggcatgatgtcagctcactgcaacctccgcctcctgggttcaagcaattctcctgcctcagcctcccaagtagctgggattacaggcatgtgccaccatgcccggctaatttttgtaattttagtggagatgggtttcaccatgttggtcaggctggtctcgaactcctgaccttagatgatccgcctgccttggcctccaaagtgctgggattacaggcatgagccaccgcgccccgctttcttgtgttttntatagtangtat

SEQ ID NO: 653047 - DNA, 395 bp, Homo sapiens
  misc_feature (3)..(3): n is a, c, g, or t
ccnatctgcgcgggtagcgccatacaccatcagcatcaggtaaggcacgcagtgcagtgccatctcgcgcaaccaccagcaaagccatatcgtgcgaggtcggtaatggcaacgggcaaagcacatccaacagaagaagcagcgaaagcagtccagcacaactccagcgcagccaagtcaatgcacgatcatcgcgcaaacgaccaaacatggcggccgacaatgatggaagcacgaaacatactcactgctggacgggatggctattgtgcctgctccaccaaggactcataaaatcaaagccttatgggaagttaaagagcgatcatgcgcttcggtcactctgcataggcgcgcataacccttcaaacatatgatcttggaagtcagaacgt

SEQ ID NO: 653048 - DNA, 274 bp, Homo sapiens
  misc_feature (195)..(195): n is a, c, g, or t
  misc_feature (201)..(201): n is a, c, g, or t
  misc_feature (225)..(225): n is a, c, g, or t
  misc_feature (262)..(262): n is a, c, g, or t
ggaaagctttaggcaccagctgcaacccatttagcagccacgtagggtgcacccagcaaagccacaggcacggggctacctgaggccttgggggcccaatccctgctccagggtgtccgtgaggcagcacacgaaatcaaaaaagattatttttttcccacagaaaccttttttttcccatgaccctttaacagnatttgnttcattcccctcaccttcccaggntgatttgaggtaaactttgaagtaaaataaaagctgngtttgagcatca

SEQ ID NO: 653049 - DNA, 825 bp, Homo sapiens
ctactgcactccagcctgggtgacagattgagacaccaattcaaaaaaaaaaaggccgggcacagtggcgcaagcctgtaatcccagctactcgggaggctgagtcaggagaattcgcctgtgggaggttggaagtggcagtgagccgagatcgcagcactgcattccagcctgggcaacaagagcaaaactccgtgtcaaaaaataaaaaagaaaagtggctaatgtggttcacgtgccgtggctcatgcctataatctcagcacttgtgagaggccaagggtgggtggatcacctgagcccaggagttcaagaccagcctggccagcatagtgaaaccccgtctctccttaaaatagaaaaattagcctggtgtggtggtgcatgcctgtaatcccagctactggggaggctgaggcagaagaatttcttgaacctggtagatggaggttgcagtgagccaaggttgcgcctttgcactccagccggggcaaaaagagtgaaactccatctggaaaaaaaaagcgaaaagtggctgatgtgacaagaggaactggaatgtaaaattttatgtaatggtaattaatttaatagttacatgtggccagtataagtatagttatagaggttagaagaaggccaaatacagttactagtgagtactaacgggaagtcaaaatattgttgggaaagaaagcaaaggataattaaggagtattaaagtagaaaatttacgagaatatagggggacataatggtccgtgggaataagttagaagtgcggaataatgtagcattaagtggtaaggtagggtactgtagaga

SEQ ID NO: 653050 - DNA, 786 bp, Homo sapiens
  misc_feature (494)..(494): n is a, c, g, or t
agcgggctcctccgaaaggtttcggaagctggtggtagctctgaagataacgctgcgttagggcatactgcggcggaggatggaactccgattgaaagcagttgctggagtggagcacgaatttcaacaatgaagtctcactctgagatcgcgccactccattccagcctgggcaacagagtgagactccatctcataaaaaaaaaaaaagtaaaggaaaaaaaagaaaatgtctttattccattttctttcctaaagaaatatattgggctggataaaggatcctggtgcttgacagtttggtgggctttttaaaagccactttataaatgttggctccagtggtttctgatgagaaatctgccatcactgaaatcttgggttctcctatttacaaagtgtgtgtattctcccagtgtgttttcaacagtattttctttacagtgtggtttcatcacttgtgattatgatgtgcctgggtgtggtttcctttngggatttgctgtgccagcagaccggctttaaatacgaatgttctgtacaatgtctgtgacatattggtttattgccagatgttgggaagtttttagctattatttcgttcagatatttttgttcttccaatgtgtcctttcgtgggctcctaagacatgaatcttagacctgtttcatattgtgtcccacagatccccaaagggtcttctcattttttgcacttttttctctgtcattcagactagattatttctggtcatgtatcttcaaatttacgtgactcttccctca

SEQ ID NO: 653051 - DNA, 281 bp, Homo sapiens
gtcccactgtccaggtgcacagcacccctctcttgggagtggatgctggccctgccgggtgaaggctttctcgtctcggtgacagttcacagcaggtggggatcgttgagcttttgggccatgtgaggtgggaacctttgcaccctgtggagcgcccagctcccaggacccgtcaagtccatcagacctgccaaaactctttcatctgggatacagctaactgcagcctgtaggtcacgtctggctctctgcctgttgatgttaataaagttttcccggca

SEQ ID NO: 653052 - DNA, 412 bp, Homo sapiens
cgatctacaggatctcccggctctgaacttaggaattctgaccgtactaaccatgctaggaaggaaaggagttgttcttttgttagggattgaggtttgggagattaatcggacatgatcagcaggaagagcacatgtgtttctatgagaattatgccgagataggtaacagatgaggatgaaatttgggcttgactgaagtaatgggggctgtctgtgaagccttgcggcagtacagcccaggtaatttgctgagcctaatgggtgtcagggtcagtctaagtgaaggcaaagagaggctgggatgaagggtgcaaaggaatagtaaagaaagcatgtttgagatccagaacagaataatgggtagtagagggaggtattgaggataggaaaatatatgggttcggcacca

SEQ ID NO: 653053 - DNA, 904 bp, Homo sapiens
  misc_feature (3)..(4): n is a, c, g, or t
  misc_feature (6)..(6): n is a, c, g, or t
acnncntgactgagtctcactctgttgtccaggctggagtgcatgacgtgatcttggctcactggaaactccgcctcccaggttcaagcaattctcctgcctcagccccctcagtagctgggattacagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaagtatgtacatatttataaatttaatattttacctggtcataaaaattttcttactaaccagactcttttacttagtgatatgtaaaatagcttttaaacctttttaagatttctgtagaaatagcatcagttcaccataataacaacaaaacagaattcatcacattaactgtatataataaagttgtgatatctcctt

SEQ ID NO: 653054 - DNA, 737 bp, Homo sapiens
  misc_feature (550)..(550): n is a, c, g, or t
  misc_feature (580)..(580): n is a, c, g, or t
  misc_feature (594)..(594): n is a, c, g, or t
  misc_feature (635)..(635): n is a, c, g, or t
gtcttacaccccggcttacctagttaactacttacctagttaactacttacctagttaaatccactggtgtaggcacagccatgacaaaactgacagtttattaatttgtgattagcattctagctattcatgttcttcaagcatgcatgaagaattccggtctctgaacattgtcctcaatacaacttctgtaaacagatgttcttaacttttttttctttgttgaaagataccttccaactctaaactttcatgattttcctgagtatttcctggccattcaagctttttccactctactaagctgtctagattttatccattttaccttgatgatccagattttgggcagttcaaaaatgagtagagagtaagggggaagagaactattcccactcccaacagataaatatcatgctcagtagacactctgtgtccagttttgttttctgctttttccatctgttccacccacttgcttacccatacataaaagcctttccttagtctcttgagaaaatatatagaaggaaagtttgcacagcagcnaaatagcctgaaatgtgctccagttctttntggttaacattatngtttagaccatatgacccaatttgcctcagacagtctcagngtgtaattattaataaaactcctttttcactctcaaaattgtccatgtgaataataaatgatacgaccagcataattatgggatctcagccagctgaaggga

SEQ ID NO: 653055 - DNA, 93 bp, Homo sapiens
tctgaggacacggccgtctattactgtgcgcgaccgcaggcatattgtggtgctgaatgcttcaaacgccctcttgagtactggggccaggga

SEQ ID NO: 653056 - DNA, 127 bp, Homo sapiens
gataatccttaagaattcagtctaaattagcaaccaggaaggaaaaatatattaaaaacaacaaaaaagtggcactgccccggtccccgtccctcgtcctccccccctctcttctcgcctcctccca

SEQ ID NO: 653057 - DNA, 312 bp, Homo sapiens
aataacggaacatgcacactcgaaggaaattttagagttttcttgaagcatggaaatacagattcagagggaatagctgaagtaaaacttgtgcaccaagataaaacaatgctcatattctatagcaactgaaacatgagggaagccaaaaaatcctgccttgaccttgggtttcaacaaggagctgatactcaaagaaggtgcacgtgagcgtgatctctgtataaatggcactgaatgtctacatgcgcatggccaaagataaaagaccatggagtctgaatgtacttttactaaaagaagaactatggg

SEQ ID NO: 653058 - DNA, 945 bp, Homo sapiens
  misc_feature (945)..(945): n is a, c, g, or t
cttgggaggccgaggcgtgtggatcacaaggtcaggagatcgagaccattgcggctaacacggtgaaatcttgtctcgactgaaaatacaaaaaattagctgggcgtggtggtgcgtgtccgtagtcccagctactcaggaggctgaggcaggagaatcgcttgaacccgggaggcagaggttgcagtgagctgagatagtgccactgcactccagcctggtgacagagtgacactccgtctcaaaaaaaaaaaaaaaaaaaaaaaaaccggggttcaatgtgggggggggaaaaaggggtatggaaggggccggggccaagggggttccgggacccaggtttttggtcaagggggaaatggcgggcccccaaataggggaggtcggtataaattgcgagaaaaaggcgagggtaaccccgggcttaaagggaacccggggaacgagaccccgggaaattaagccaggcaagaaggacgcggggccattaggtaggaacgaacagggacctcgggaaacaccatccaggacgagatcacccggtggcggaaaaacaacaaaaacaccggtcacacagcagggcggatagagtagccggaccaagaagaacaacaccatacgcagcaagggcacggctaccgcagaggggcgaattaaccaaaggggcataacggagccagaaaaggccaccccgtcacaaccaggaaaccgccacaaaccgcggccagaactccggacaggagtgggccaagggcaaagtcgtcaacgggggatcagacgataccgaaggcaagcaggagaaggggtagcacaccacggcgacaaacacgaggacaacggacgaacggacaggaaaagagacagagaggcaggagacgcagcagacccaagaccaccaaaagagggaagaaacaaaacagcacgaaaagcaagaaaacgacgcgn

SEQ ID NO: 653059 - DNA, 1371 bp, Homo sapiens
gggcggggtgagtagcatgttgtgtgaggataccgggggccgcgcggtcgctcgggacccggtccaaggaccgtgcaccaatcgaggcctcaagagacggcctgtcaggcagcagaaccttcaagatccgcagtggagacctgacgagagcgggtgaaggtgcgtaacggagtaatgatagtaaggctgacgaaggggtcgaggtagtggcccgttccactcgtagaggctcgagcactaggaaagaactcaatacgtactgtctcgtggcaaaggagtctatgcatgctgaacgcatggatccccgtaatgccacgtgggaacctgattccggccaatacgggacttggatggaatggataggttatgttgggttccgctcgattggggtggatccccacagaacacgaagagccacgggtcactaggggctcagcgctaacagaacactcgcccccagaaagggccctactagccccaacgaggtctggtggccccacagaacgttgctactcgacagtacccttttcagccgacacagggcacccggcgcaaccgtgcaaagggcaatttggtttcctaggtgctccactaagccgaaactgcccgaggaatgaagtgtaaccgaacgcaagtcccccactaatacgaagaggaaattcacgggtttcctccaaacagaaaagtccactcgcgagggagtggtatcgaagggtcccacgagactacctagattccctccccggcgtatgcatggagctgaaacccactgggggagccaataccgactgcgagcaagacccgaagcgaacccatcacaaggggacggcaacgcaaggactggacaccggggcggtgcaggtgaccttgcaccgaagacgaccggaacgagcaacagggagtgccctcctagatgacaactcacgggagggggccacattggacacggggacgaaacgcacgccgaacgcaagtagcacccgccgggcgacgttcagtcagtcaagaatgggccaacccgcaccccaaaaagcggcggcgacaccgataagaccacgcacaggaggaaccaaaacgccgtgtgaatcacagaccagagacaacacttggagaggagggaaaaccccagtggaagccgcgccgaacacaaacgaggaatcacgatggggctaccaaggggcggattaaaacaggcgcaggaaatgacaagggggcatacagtggcagcagccccccgtgcgcatcacaatgcggaccggggtaatattgcccagggaccgacccccgagcacagatatgacctatagcttgagccacatatgggtaaggaaacaaggcaaaacggacacaacggacaacagggaaccaggg

SEQ ID NO: 653060 - DNA, 1497 bp, Homo sapiens
  misc_feature (1371)..(1371): n is a, c, g, or t
gactaggcttctctataggtcgtggaaatggtgctttcacgccgggctcattagacggggctatcctgaggatgttcaggttcagcagaggcataggtgaacgatagatatcagatgactaggctcccggatgcagggctcgaacatggcactcctatgccttgtactagtaggttgtacataccatatacacacgaaggtagatcggaattcagtcatggatggttggtggtcacgagcgtgacgagtggggagaggctagcgagagagtggcatagtatagattctgcatcatgtgtagtgcgtatttcccttcattcatacaaacatgcgagtggatcataggcgatcatcaactagcgaacaggaagaatggcgagtatccgaaccacgtggtggtcgcgttagtagtcacatgctaacgaattttcataggcccataccaggtggggcgtagggtcctcgctttggcctcgacaccggggggcgtggagaaaccacacatgctcctgatagtgcacatacgtccctataaggacgttcgacaggggggactcgggttttccctgacatggaattctaatacacacctcatctgcccctgattctcacatgcggataaaaaaatcgggtctatatagcacatacgtcaagcatactcatgtcttgcaaactggctaactagttgcaatacggacccttgggttcattaaaaaggaaaccaagttatggcgcctggcgggcaaaacttcaaatgggcataggggaacctgcgagagtacaccaaggaagaaactttccccgactcttgtggggaaataacttcgaaacacaggttgactcctagtctaaccgcacgaatagcccccgttaaaagaacaaggaacaaaatcctcccgcacccattggtggtcctcccgccactcgggtttttccccgcaccgcggtgagaaacaaaattggcctcatgcggaaggacgaaattgcgcaaaccaaagcgtgtgagggaaagacgcctctcagtgccagggtccaccagaaaatttagcacgattgggttatgggggagcgctatatggcgacggaggcaattttcctcggcctatggtggacaccttggtgggccaatagtaaaggaagggacagcgctatcttcccacaggagttcccccttagagtggaatttccccctaaatggccattccattaacctttaccgtggaacactattgtaaattaggcatgggtttggccatttggaaaaccttaataatccttccctatatccacaaaaggaacaccattgccttcgtctttgagtgtgcgcccccttataatatccgtgttggtgggtctatcataacccagctnggggcggggctttggcccatattgaccatagtaaataggggcggtgggggtccttgggacggggtggatccatgaggaaaacccgctgtgggacgcaaagtagagaattctgcaatacgcttgtag

SEQ ID NO: 653061 - DNA, 177 bp, Homo sapiens
gggagcggtgatacgcgaggaagggaccaggagggacatgcacgcagagcccggggtgggcggtcgtcggcatggttgccatggtaaccctcacccccttgggtggagcagccttctatatcatcttccagacagaggaccccgaggagctaggccacttctacgacatggtgatta

SEQ ID NO: 653062 - DNA, 223 bp, Homo sapiens
aggatctggttgatgctgtcgaagttgtacgagtagcgctcttccggatcggcgatgaagtcgtaggccggatcgtcgtccaccaccaggccgtcctccgcggtcagcgggctggggtacggcagcagcacctgcgtctccgcggtgggacggccggtggtgatgcccatgacgtcgacgtagccgtcgttgaagccgaacgagttgaagtcgccgatcacca

SEQ ID NO: 653063 - DNA, 167 bp, Homo sapiens
cacgagcgccccagtagagaggtatgggggtggtttttttgtgttgtgtttgttgtgggcgctgtttgggaggcgtgtcgctgtgtgtgtgtatatacttgatgatagctagatgttgagcgtgtcagacgaaacatgaattttcttccagtacttgcgggcgcttc

SEQ ID NO: 653064 - DNA, 758 bp, Homo sapiens
  misc_feature (278)..(280): n is a, c, g, or t
  misc_feature (290)..(291): n is a, c, g, or t
  misc_feature (571)..(571): n is a, c, g, or t
ctggctcggttacactgctctgttccttgcttaaaataaccaaaagttcttcacagggaccgtgaagaacaggctctacccgggagacacgggctggtctcggtgcctgtcgggcgtctctgagcccaggcccaaggcatcggagacagcaggagtgggcacgtggcccacgggggtgggggggcagctgggggccccatcatgctgttttgggcccaagaaggcaggatgtgagtctgtggagccccccagaggaggggtgaatttcaggggtgatnnngggaaatgcnngacctcagaggcaaggcagtgacggctggctccacgacgcagccaagagatgcccgcaattctgctgctgtgcacagggcaccatgttctctcccagtcacagacctgcctgcgcctaccagacgtgcaccaagggccccggcgtgggcactgagcctggtgttgggctcggtggggatgaggacagggagggcacctggggcctcagacagggagggaggggcaggggagggacacagtccccacccgggaccaggggaccacgtagggaccctgcgtntgggatggggcatcagggtggctgccatgctgggagtgcttccccgggaacctcggtggcctcccacacgttcctgtgtgagttggggaaacaggtggctggagtcagactggggaaagtgggggcctgggatgacgtacagtgtctgtggcttagtgacagagattaaatactttcatgctcttca

SEQ ID NO: 653065 - DNA, 998 bp, Homo sapiens
  misc_feature (707)..(707): n is a, c, g, or t
cgagcgagtgggcatctctcgggacaactggcacaagcgccgcaaataccgggggctaggagatagccctaccactaagaagcggaagtatgagattggggcgcccagttgccaacagcaagattgggccctcggcgctagtccacacagatccgctgtgcggcgttgagggtaaccacgaacagtacctgtgccgcttgaggttggacgtggggaatttcgtcctggggctcatgagtgttagtactcgtataaacaaggagtcagtctgatgttgtctacacatgcgatcgtagagtagacagatgctggttcggtagccagagacccgtgggtgaacgaagttgcactcagtgctcgaagtcgaacaagcaagcaccggatacccgatcgagtggtacggacgtcgccagctagtgcggctgcctccttgggccagcaagaatgggaggccataggcgtgactccttgacggaagacagaggacttttatcaccatacacataaacggattcgtatagaagataatttctagcaagagaaactactggactgcacaaggcgaacaacacgaacatgccatacaattgtcacgcgagttcgtgccgtaggatggagccacgattcccagcgcacggggcatatgctttctttggcggtggctatcagcgtatactagaggcctggagagcagatagtagcgcgcngaggtcgagaattccgctagtggtgcttgagacggagcaaaggaagtatgggacgttcctactcgttaagcgcaagagattcaagcgccgcgcgaacaagggcaacaattagaagtcccgtatggacggtagctcatttccagccgccagttggtaagagacagcaagacacgataggcagttgaacaaaggcccctctcggtcgacgagcgctggccattagagaaaggtagttcacccgggatgagagggaggtccccagcaacggattaagcgccgggtaatcgccgg

SEQ ID NO: 653066 - DNA, 462 bp, Homo sapiens
gaggaaatccccaccaccaaaatcggagcgaacagagcgatcacaaagatctcataaagagagctcacggtccaggtgatctcacaaagaatctcctagagatgttagcaaaaaagccaaaagatcaccatctggttcaaggacacctaaaaggtctaggcgaacacggcctaaatctcctaaaaaatcaggaaagaagtccagatcccagaccagatctccacacaggtctcataaaaagtcaaagaaaaacaaaacactgacgaaaatttttaagatgctgccacttattggaaatgcgatttggattgggcctgaacgggctgttttttaaaaaaacaaaaaatcaaatgaaagaacattcctggggggtttttgtcagccggcggacgcatgtgaaaactcagggaacaactgggacaggaaaaaccggcataggaggaaaaggggggaaaaactgca

SEQ ID NO: 653067 - DNA, 408 bp, Homo sapiens
  misc_feature (221)..(221): n is a, c, g, or t
tagttcacttcgcgtcatggatgtgtgactcccacactcccgccattcctactggaacttgcaaccaagccctaccgagcaaagggcggaatggggtcaatcagaagtactgaccgggagaaaagctaaggacccacgcatggctccagcctgtcctcagagcctgcgtttcagaggcactgcaaggaacgccgaccacatgcacgtagggaccctgcgtntgggatggggcatcagggtggctgccatgctgggagtgcttccccgggaacctcggtggcctcccacacgttcctgtgtgagttggggaaacaggtggctggagtcagactggggaaagtgggggcctgggatgacgtacagtgtctgtggcttagtgacagagattaaatactttcatgctcttca

SEQ ID NO: 653068 - DNA, 162 bp, Homo sapiens
  misc_feature (31)..(31): n is a, c, g, or t
  misc_feature (62)..(63): n is a, c, g, or t
  misc_feature (68)..(68): n is a, c, g, or t
  misc_feature (89)..(89): n is a, c, g, or t
  misc_feature (94)..(94): n is a, c, g, or t
  misc_feature (105)..(105): n is a, c, g, or t
  misc_feature (110)..(110): n is a, c, g, or t
  misc_feature (116)..(116): n is a, c, g, or t
  misc_feature (132)..(132): n is a, c, g, or t
  misc_feature (141)..(141): n is a, c, g, or t
  misc_feature (155)..(155): n is a, c, g, or t
  misc_feature (161)..(161): n is a, c, g, or t
gtaccttctgcctggaatttccttgtacgcntggagaacacctcgtactgcaagaatccgcnnaaaanagcacctacgagaagactgcnctgcncctaccctgcnttgcnccaagnacccctcccttgggtncccagagcnacgcacatccagcncagcanc

SEQ ID NO: 653069 - DNA, 425 bp, Homo sapiens
cactagagctcccccgttatgcaccgtggtatgatccttctatgactaatatgttgaaagtttttgatcatgaagggatgtagaattttatcaataatttttctgcatctattgaggtgatcatatggtgtcttagtccattttgtgttcttaaaaaggaatacccgaggctgggtaatttattttttaaaaaaaggtttccctggctcctgattctgatgcctcaaaaagttcaagactgggcatcttcatctggtgagggcattaggctgcttccactcacggtggaaagcaaagggaagccaacttgtgcagagatcacatagagagagaggaagcaacagagaggtggggaggtgccaggctctttttaacaagcagcactcacaggcactaatagagtgagaactcactgatccgaaagg

SEQ ID NO: 653070 - DNA, 713 bp, Homo sapiens
  misc_feature (67)..(67): n is a, c, g, or t
  misc_feature (114)..(114): n is a, c, g, or t
  misc_feature (169)..(169): n is a, c, g, or t
  misc_feature (554)..(554): n is a, c, g, or t
  misc_feature (566)..(566): n is a, c, g, or t
  misc_feature (589)..(589): n is a, c, g, or t
atgctgaagagattttgcaattgtgcttttgaaactcgatgaagtaaagggtttcaattcaaacgcnggatagccccaaattgttccaaattaacagacaaaacaagtcattgnatccaccggttttcatgaagcttgtcttacgctggcaaagattattgaagcaagnctaaagatgtatagcatttccaataataaggcaatgactcggggggcaattgctgcaatgctgtctacaatcctgtattcaaggcgcttctttccatactatgtttacaacatcatcggtggacttgatgaagaaggaaagggggctgtatacagctttgatccagtagggtcttaccaaaaagactccttcaaggctggaggctcagcaagtgccatgctcaagcccttgcttacaaaccaggttggttttaagaacatccagaatgtggagcatgttcccctgtccttggacagagccatgcggctggtgaaagatgtcttcatttctgcggctaaaaaaaatgtgtaccctggggacgcactccggatctgcatagtgaccnaagagggcatcngggaggaaactgtttccttaagnaaggactgatctgtgtgctcttatcaccaatcagttcagacctggttgattttgtactttggaactgtaccttggatggttttgtttattaaaagagaaccctgaagttaaaaaaaaaacaaaa

SEQ ID NO: 653071 - DNA, 135 bp, Homo sapiens
gctcgccgatccgatgaggtatggccagagccctggaacatctctgggcttgacaaacctgatttcctgcttgcatagaaaaactcagtactttgggcacaaaaaagggttcaccagatactgctgagaactctt

SEQ ID NO: 653072 - DNA, 413 bp, Homo sapiens
  misc_feature (7)..(7): n is a, c, g, or t
cacacgntcgagttaatggatatatatgaatactcacagtaatagtcagtgtggaatcaacagggagaaagaaaaggcttggggtataaaggaaattctttattaaattcaaaccattaaaatatgtagcatgatttcttataacagggtttaatacctccattttctctaatagtttcaggttattaagaaacagtatgtgaactttttgggttaaaagtttcccagcataggtttaatcactatataatatccttttatttccttgcaatggctgattgtcaggccgaaatttaggaccaaggagctggaaaatattcatgagactcaggaaccaagctattactccaactgtaaggtttcattataagcacgtaaatatagttcaaagttaccacatctgtaaactccaa

SEQ ID NO: 653073 - DNA, 99 bp, Homo sapiens
aaattgcggacatcccgaggtgagcaccctataagtgcaccaagctgagtaaaaatgctggccccttcaaagagaactagactcagttcctcatccttg

SEQ ID NO: 653074 - DNA, 323 bp, Homo sapiens
cagccgtaattaatatttgatactgtgatactatttgtttgccatgctctcaattacacaaatcaaattgtattggtcacatacacatgtttagcagatgttattgcaggtgtagtaaaatgcttgtgtttctagctccgacagtgcagcaatatccaacaagtaatattcttaatttcacaacataagtatcaaaagtaaaataatttttaaataccttgtattaagcaaagcagacagccacattttctagttgtggggaggtgcaaactcaatattaggaatgtgttctttatgttttgtagactaagtgtatgtgaaaa

SEQ ID NO: 653075 - DNA, 216 bp, Homo sapiens
gcaggctgtccctgtcatggatatataacaaatgctcactatgagtgtaaactacggttgactacttgggtaatgagattatgcaagatcatgaaaggctgtagaaggaaatataccttaacaggctgatgaggagtgagccagaaaaaaaaaaataacaagttcattatcggtgtggctaattatacatcagcgttatttaagcacataaagacc

SEQ ID NO: 653076 - DNA, 177 bp, Homo sapiens
  misc_feature (10)..(10): n is a, c, g, or t
  misc_feature (103)..(103): n is a, c, g, or t
  misc_feature (119)..(119): n is a, c, g, or t
  misc_feature (146)..(146): n is a, c, g, or t
atgttttttngggacaagttaggttggcttggggaccgtggacagggaagtgcgcagcctgattgccagtgggcggaacagggtcaggctcggggaagcaggnggggtaaattcaccangtcctcgtatataaagtgggccaatcntgggaccataaaacttgtgccccacgattgt

SEQ ID NO: 653077 - DNA, 757 bp, Homo sapiens
cacaccacctgagtcgccacgccttgccacatgatcccggtggcgaccgcttgcagtttcacgtcataaccgagcttttgcttgatcacttctgccgccacgtgggtggtggcgacactgtctgaccagccatccacatagccgatgctcagggttttgctgtcggcgctggccagtgtggagctcatcgcaactaccagagtggcagctgcgcccaagagtcgtcgcatcttcatagtgcttccccgaaagtgctgcgcccggcggatgccgagcgacgtcaacctgttgttatgtggtgcaccgcgcccccttcacgcgcatcaatcacgtgggtgcctcgtcagtggagggctgacacttcgatcatcaacctgctgccacaagcgacctgctctgactgcgacctcaggtaagcaagaaacgacatcacatcgccagcaggacgatttgtaggatattcaccgacgatcccgcccgaactttgcatgtcaaaactatgcggctccactgggacggcacaaatccgggtaagatgcgcgcctttgcccccagacggcctgatcatgcccgcgactgcacgtttcccgctcctgccctatttatttgccctgatcctcggtgtgctggccctcggcggctattggtacggccttggccaaccggtggtgcgccggacgtgccagcgccagcaaagctgcatgtgcgtctaccggactcggtgtgtggatccctagagtgactgcggctgaactgg

SEQ ID NO: 653078 - DNA, 542 bp, Homo sapiens
gagttgttgttaggttctgactgaaggtaaaaggttatgtttaataaatgtgagaaaatactatttgaagcctacttttgaaaactcacttttttttttaacctaggcattaatcctttggttgcgagctactagtctgatttttacttaccagattatctttctgtctgtcttactctctgggtatctttttctgtctctgtttccccgtgtgtgtgtgcacgtgtgtgtgtgcatgtctgtatgtgcaggtgtacgtacgtgtctgcatgtgtgtgtgtgtgcgcgtgcatgactgtgtgagtgtgtgtctgtgcatgtctgtgtgactgtgtgtgtgtgtgtgtgtatgtgcacgtgtgtgtgtgtgtttctctctgtctctgctccatgcatgttctctgccctctgtctctctctctctcttattggtctatccagaatttctgacttggaacggaaatcttcacagttgaattcacgtgcggtgtctttctcccctttgctttttcagttcctccaggagtgatcctaaatggagc

SEQ ID NO: 653079 - DNA, 123 bp, Homo sapiens
  misc_feature (33)..(33): n is a, c, g, or t
  misc_feature (73)..(73): n is a, c, g, or t
  misc_feature (97)..(97): n is a, c, g, or t
cctgaagtcaggagttccttttttcttaaggantagggaccatgtttttcagggccttttgaagttgttaaancattgtcaactggctcaactacanaaatgccatcatttattatccactga

SEQ ID NO: 653080 - DNA, 391 bp, Homo sapiens
cggtgtgatctagaggatcctactcgatccgctgatccagcaagggcactcgttggtgtcactcatagtgtaccagagaaaatgaagactgactcccagcaccttcattcataacagcccaacactaggaactacccaaatgtcctgtaatggtgaatggttaaagaacctatgggacatccataccatggaatacgatccagccataaaatggaacaaacctttcactcaggcaacaacttggaagaacctcaaggaaattatgctgagtgaaaaaaaaaaaaaaggccgttctcaaaattggtgcttaaaacttagtcctatttttgtaccttccaaaaaattaccttatttccggaattgaaaaccagtataggggaatggccagagg

SEQ ID NO: 653081 - DNA, 647 bp, Homo sapiens
  misc_feature (647)..(647): n is a, c, g, or t
ctctggaccgtgttatcgatgcacctctggatcccttgaaccggaggcagaggtggcagtgagccaagatcatgccagtgcactccagctgggtgacagagcaagaccctgttccaaaaaataatcccactcttcatcccatttttacctattagttttaaaatacttccctggattcattcttattttatggttgccagactgctgtgaggtacagttctatactctccagcactaacattttagaactaattacactgtattatcatgtttaatgttaatttttatgaggtttcaaattatctattgttttaaggacaagttaggtaaaaatgtctgaagttttagatttaaaaatttagatttagaaatacttcagtgagcagagtaaataattcgatgtttgggcaaaaaccaggtcgctgaaatacatgtgtcaaaactagatgagtgagtcacgtatcatggtcacgtcggggtttgataaagattttctgttcttgtcaactctcttatctgccttcatcccgggtttgtttccagcgtgcttgattgacatgcctgtatctgcttcgtcgtctcacgctggactcctgtacatcatcaggctacgtgcgttgatggtgaatcagcgatgttgacatttn

SEQ ID NO: 653082 - DNA, 813 bp, Homo sapiens
  misc_feature (694)..(694): n is a, c, g, or t
  misc_feature (770)..(770): n is a, c, g, or t
  misc_feature (774)..(774): n is a, c, g, or t
  misc_feature (781)..(781): n is a, c, g, or t
gcccgccctagcgtggacatttatcctctagcgctcaggccctgccgcatcgccgagatccaggcccagagagaaccagagaacccaccatggccccctttgagcccctggcttctggcatcctgttgttgctgtggctgatagcccccagcagggcctgcacctgtgtcccaccccacccacagacgtgcttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggaagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggtgtgacctgcagtccctgnggtcccagatagcctgaatcctgcccggagtggaagctgaagcctgcacagtgtccaccctgttcccactcccatntttnttccggncaatgaaataaagagttcccccccacccgaca

SEQ ID NO: 653083 - DNA, 287 bp, Homo sapiens
catggtcgcaagagagaagcagctgaagccgtggtgctggtattgtaatagagattttgatgatgagaagatcctttattcagcaccaaaaagcaaagcattttaaatgccatatatgtcacaagaaattgtatacagggccctggcttagctattcattgcatgcaggtacataagaacaatagatgccgtaccaaatgcatacctggagacagcatgagttggaattattgtatggaggtattcagaaaagcatggatgaagcgcgctcttgacagaaccaagag

SEQ ID NO: 653084 - DNA, 87 bp, Homo sapiens
  misc_feature (45)..(45): n is a, c, g, or t
agggctgctggattgagggtgatgcgccccctggagtcctcactngcctcttccaggctggaagtgtccgtatttagtgctccccca

SEQ ID NO: 653085 - DNA, 767 bp, Homo sapiens
gtaatgtgaatatttgcaattatatatgtctccttctggtagagtgggatattatgccctagtatccccttgcgattactgcaggggctgctgacgtactcaaaacttctccgtgggactgttaataggcacaatggcagttatcaatggttttctccctccctgaccttgttaagcaagcgcccaaacctaaccttagtttcccatgggataattaaaggtatacagcatgggagtataccatgcactagtctagtcaatacaggggtccataactcgcaatcctttggcatttgcgccagtgtgtgaaatcacagggtagccatggtgtcatgctttatatacgaaggtcttccctctctcatgacccttgtgtgcccttggaccctttttacagactatgctcagaatctcaggtgtgcagaatatgcagctattaggtaagatggtgctgtctccctcgtaacctctaccgctcgtgccctgccgcaatttgacctactttgctgggtactgttgaccagaacaagggcccggtgctcattgggactgtaaggcaattctcagttgcactgtccattggtccagccattatacatgaaccccgtcttactttcctttcgcattgcttctgagtatgccggactaaccaaaagcccattctgtgtcattaataaacacagtactgattgtcccatttttcaagcccatcaggccaggatctgccgtacactttggtggtgctggtgccgagtggatatgcaacg

SEQ ID NO: 653086 - DNA, 308 bp, Homo sapiens
gactctagtggatcccccgtccttcatcatacctacctcttcatcatacctaccaatgggatgataaataaaaaatgctgaaagaaaaaaactgacagacagggatactatatccagcaaagttatctttcataaatgaaggagaaataaagtctttcccagataagcaaaagctgaagattccttaccgctagactggccttaaaagaaatgcttaaggagtcctacacgtggaaacaaaagaacaatgtccaccattatgaaatacataaaagtacaaaacccactggtaggtatgatgaaggacg

SEQ ID NO: 653087 - DNA, 108 bp, Homo sapiens
attataaaaagggaaactgtattaatcttattcaatcctcttttctttctttttggtgaacatattcattgtttgtttattaataaattcccattcagtttgatgaga

SEQ ID NO: 653088 - DNA, 170 bp, Homo sapiens
taaaaaactttattgaattatgagcaggatgaatgaaatgttattttaaaaacaatacatttgttaagtcttccataaaggttatgttgaaatttggtcagatgaatatttgtatgtaaaaagtatttgcatatctgaacctcaacaaacatggatttgctgtttataga

SEQ ID NO: 653089 - DNA, 176 bp, Homo sapiens
tgagtatcccccaccggcggggagaagacagaaagcatggtgaaatgaaacagaaaggtcattttttacaaagaaatggaggtcagagattacgtgacatataagagcacaagcaaagtaacatgttaaggagaggatgaagattttaactaatattacagagggcccaccgaatg

SEQ ID NO: 653090 - DNA, 170 bp, Homo sapiens
atatacctaatctctccctcactagacgtaagccttctctcactctctcaatcttatcatcatagcaggccggatgtcagaggggtgcttgggtaactctgggactcagaagtgaaagggggctattcctagtattattgctatagccattatgattattaatgatgagt

SEQ ID NO: 653091 - DNA, 838 bp, Homo sapiens
gtaacctttgccttccaaattaaagaactccatgccactcctcaaaaaaaaaaaaaaaaaaaaaaaaaaaaaaacaaaaaaaaaacaaaaaaaaaaaaaaaaaaaaaaatcgatggtgcgggcgccctgcggccccaagaaaagaggtctttcacaaacccacactgcggggggggccccggcggcccccaggaggatgagagcaacaagcgtgtgcgcaccacggcggtcgtcccgagagagaagaaccgcgcgcacacgaacaacagggggcgtgggtgttctctccccacaaaaaaaaagagcgccgcgcgggaggcaaccagagcaggcggtgcttgtgttgagaacaacaaccccccagaagagaggaacttgttgagcaaggcgctaccaatacgctgggggctctcttctatcaaagagggtgatccctccccgagcgagcagcgccgcgacatatattataaaatcagtaacccccccgcccgcgctagggggtgtacaataattagcagcacatcatcggaccggcgcagctaatatcataccaaccacgtctcgactccacatcacactgaacctcatcccgagctcagcgagccaccacaaccacgcactcaccaagaacccaaacctgccgcaactgaccgacaatcacgcaacgaatacatcaaccacaccagcacacgacccagaccatcacccccaccgacgcccgcaccaactcacccacatccacagaacaccatccaacacacacaacaacccaccatccacccacaacagcaacacacgcagccaaccacgcagcatacccaacgacacaccacaacca

SEQ ID NO: 653092 - DNA, 109 bp, Homo sapiens
tggcagttcttggtgccacgactgggagacagtcctcaggccctcccctcagggagctcactgtccggggagggacagtctttattagttcctgttcggccagcagagg

SEQ ID NO: 653093 - DNA, 293 bp, Homo sapiens
agatgcgatggacatttgggttgtttctgctttgttggctattataagtaatgctactttgaacattcatgtacaagttttgtgtgtacatatgttttcaatactcttgggtatacctaggagtagaattgctgggttatatggtaaccctgtgtttaactttttgaggagttgtcaaactattttccatagcagctgtactattttgcattcccaccagcattgtatgagggttccaatttctttttatctttcccaacacttgttttgcttttttatcattatttttacag

SEQ ID NO: 653094 - DNA, 289 bp, Homo sapiens
acaatcgggcgtagagcggatgatcctgttcagacaatcagaatacgcatggcttcaaacctactgaaaaacacagtgcatgacggctcgcccgctatacttcacggctcaccgatccatctaactacgcattcccattgaatgctgtgtccctagaagcggagcactggatcgatcacatcgggatcgttgcggctgcatcagctcttcgaggcaagtgcgtcgatgtactcgatgctcgagccggcggaaatttgccaggatggtagccctgaattgtctgaggttt

SEQ ID NO: 653095 - DNA, 356 bp, Homo sapiens
taacataggtcatctcatcaaatagacgactctcacacttgatcacattgttttatgtattcaatcttcagtatactagagaacttctagttgtgtataattagtgctaatgctatccatattccttctctattttctatgatactagaaaatcacattaagctgccttaagtggtgaaaatgtattgattctatttttgcagtattcctgcagtcttttaaatcacatacgaatactgctcccaaaattatcatcagcttctgcctcatactcttcatgacataagctgaaacaatgtgggtctgtctattaaaagactgattgtttaacatcccgacatacatagttagggtac

SEQ ID NO: 653096 - DNA, 355 bp, Homo sapiens
cgccgcgggacaaagaagtcgaagatcgactgtcatgtggcatagtggcccctttacgtagtcggagtccctctaccattgatgtgggaggagttcatccccttcaagcagtatgctggccaatacgttctcttagtcaatgtggaccgctactgaggcctgacgggccagtacattgaactgaatgcactatatgaagagcttgcaccattcggtctggtcattctgggcttgtcctgcaagcaactttggaaaacaggaaccaggagagaactcatagatccttgctcacctccagtatgtgccaccaggtcgaggctttgttcctaattttccagctctttgagaaagggga

SEQ ID NO: 653097 - DNA, 108 bp, Homo sapiens
acggccgtgtattactatgcgagacaaaaccgctattgtagtagtaccagctgctatgatcctcgggatctttattttgactactggggccagggaaccctggtcacc

SEQ ID NO: 653098 - DNA, 348 bp, Homo sapiens
  misc_feature (121)..(121): n is a, c, g, or t
ctagaggatccctgttgctaggctggagtgggagaatcctctgagcccaggagtttgaggcaatagtgaccatgatcatgtctgctaatagccactgcactccagcctgtgtaacacaggnagatccagtctctacaaaaaaaaattagaaatttagctgggtgaggtagcacacacctgtgatcccagctactcaggaggctgaggtggggaggattgcttgaagcccaggacgtttgagggctgccaatgaggctactgattgacacccacttgcacttccaggcctaaaggcaaccaggggtaccggaagctccgaaattcggtaactcattggtccatagcttg

SEQ ID NO: 653099 - DNA, 461 bp, Homo sapiens
  misc_feature (37)..(37): n is a, c, g, or t
tctagaggatcccggcacatctgacccagagatgtcngacttcctacgaccgacagtacgaatggtggtttccaaagacctgggacgcacggggaaggggagtcactgtttcatgggtacagagtttcagtttgagaacagacttttaaaagtcctcgatctcaatggcgatgatggttgcatgacaatgtgaacgtacttaatgtcacatagctgcacacttgaaaatggttacgatggtaaattttcatatgtatggtcactgcaattttcagcaacctaacatcaaattttcacggtcacatcactatctgattccatttatacacattctaggcacacatatactctcatcgtgccagcaaaacagagccgtggttgcctacggctgggcctggcaggtggccggctgggcagccggcgggggtccgaacacacttcggggtcagatgtggccgggt

SEQ ID NO: 653100 - DNA, 479 bp, Homo sapiens
  misc_feature (72)..(72): n is a, c, g, or t
  misc_feature (74)..(74): n is a, c, g, or t
  misc_feature (76)..(76): n is a, c, g, or t
  misc_feature (384)..(384): n is a, c, g, or t
  misc_feature (406)..(406): n is a, c, g, or t
  misc_feature (444)..(444): n is a, c, g, or t
  misc_feature (453)..(453): n is a, c, g, or t
  misc_feature (475)..(475): n is a, c, g, or t
agaaattaacacgtgggaaattatacaccacaaatagtacaatccatggaagaaccaagggaatggcgatancnanatgtcaggaaaggactttgtaatgtgtaggccttagagaaatagggaactgagacaagaatctatttgaattcttggaaataaaaaatgtaattaccatgttggccaggctggtcttgaactcctgacctcaggtgatccacctgcgtcggcctcccaaactgctgggattgcagacatgagccactgcacccggccaagaagtgactattgtttctccattgtgtcctcttgatgcccttgtcaaaaattagttgaccagatatgtttgggatttatttctgagctctctgttgtgttactgtccanttttccatatcctgcttttctntttttttttttggctgcaaaactttcttccccttgggnccaggcttngggagaaggctggaggtgggtnaaaa

SEQ ID NO: 653101 - DNA, 270 bp, Homo sapiens
aatagatatagtaccgcaaggaaaagatgaaaatttataaccaagcataatatagcaaggacttaacccctataccttctgcatattgatttactagaatactttgcaaggagagccaaagctaagaccccgaacagacgagtactaagacagctaaagagcacaccgtctatgtagcaaatagtgggagattataggtagagcacaaactacgagctggtatactggttccagtagatctagtcacttaattcccacagacctttaatc

SEQ ID NO: 653102 - DNA, 746 bp, Homo sapiens
aacataatgaagctggttggttgctcctaagttcagtggataaagtgatgaaagaaaatgatgaactcggggattctatctcacggcttcagaagcagatactgagcctcaaatctgccaagattgccctgagtgagagtctaatctcctgtagagaaagaactgaaatgtggaaaaatagacataagctcttatcatgttagtggctgacctgcaatgaacaggtgcatgcacagcctcaccatgcacagcctcaccaagtatctactgttaaagtgagggcattgattgttttgcaggaagtcagggaccctgaatggagggatcggccagagctgaggcagaagaacataaatcgtgacagatctcatggcatatctatcacttcccaaaattcaatacttttatacatttcttatgcctgtctttactgcaatctctgaaccataacatgtgacacgattccatggacactttatcacgtccccaattaacactcttatagtttcttatgcctatctctactttaatctcttaatcctgtcatcttcataagctcagaatgtacttcacctcaggactactattgcacaaatggactgtcaaacatgtgtgcttgaaccactatgaccatcagtatacccggaccaccgaaccagcatcatcagtgcatttcacgggcaacatggcagataactttacggtctgactgcctgcggggtcgggccgaatagagcctattctca

SEQ ID NO: 653103 - DNA, 125 bp, Homo sapiens
cggatgaacagtttttagaaaatgggctcacagcaatgcccaagttcatgctagctgtggccagcagttcccagttctgtggtttcatgttagttaccttatagttgctgtgtaattatgtgcca

SEQ ID NO: 653104 - DNA, 143 bp, Homo sapiens
ctctagaggatcgtatagacgcatctgtgaaataaacaagtttgaaactcaagaaagcattactagctctgctttagtgcctaagggtatcacaggcatcacgttagtagacagaacatcttaatcttccccgttaaaaggta

SEQ ID NO: 653105 - DNA, 794 bp, Homo sapiens
  misc_feature (313)..(313): n is a, c, g, or t
ccaccatcttttgaacagccgctcctcccctctcattcaccggccgtcgttattgataaaaagcaagccaccaggtcaacaacaaaaatcatcatcatatatgcttgggcgacacccaccctgtcctccatgattcccccgtggtcaataaccgagcaaaatgagaaacatgttaagtcctcttaaccctgtcgctctctctttctcaccgcgactagtgtctccaacacagcagagagtgttatcaccctgctggggccaaattaggccccccaacgttttcgggccgcccccccccacagtagtcttgggnaaaaaacaatcttcgttcccacatctgcccactccctcgcatcaccacggtaggcgacaacaacagtgccaggctgcatgctaacattgtatcgcccccgagaagccaacgaacttgggggatcaaccgaggggcccactaatacaaacccctcttttttccgcttcctccactcgggagggaataatacggacgcaccagtgggttatcaatataaagagggaccaaacctggggttaatgcaccgatacggtgcaagaagataagacgctcccctcgttgcttgtgtataaagacaacgtggtgccaccctacgtgtgtgcggtggacgccccctgcttgtatatcgcacagagtatggttacgcgccatacagatgagacgccgggctttatagccacattcgtgccacctaattttgttcaggcgcgcgcataaaaaagagaggtgcttttctaaaacagcccaacaatatacgaac

SEQ ID NO: 653106 - DNA, 572 bp, Homo sapiens
caggctctctacctccgtgagatcaatgttaagagtggaatcagtgggagatgatggaatcataggggtggtttccctcatgctgttctggtgatagtgagtgagttctcatgagatctgatggttttataacgggtcgggcatttccccggcgggcactcattctctctcctgtcgcccggtgaagaggtgccttccgccatgatggtaagtttcctgaggtctccccagccatgtggaacggtgagtcaattaaacctctttcctttataaattacccagtttcgggtatttcttcatagcagggtgagaacagactaatatacaagctctttggtcacataaaggtaaaccggtgccagctcagaggggggaattggaattggggagagagttcggaaagaatcatgacacataagtaaggtcttgaaaagtatgtatcagtcggataagccaaggaagaagaaaagaatattccaggaaatgggttatcacaacacaggaagagacaaaaccctggggaagggcaaacggggacctgcaaacaggcatggactcatggtccatgagta

SEQ ID NO: 653107 - DNA, 97 bp, Homo sapiens
  misc_feature (95)..(95): n is a, c, g, or t
gactagttctagatcgcgagcggccgcccttttttgtgacttttcaagaacagtgaattactgtcaccttgatggacaagtttcaataaaacttngt

SEQ ID NO: 653108 - DNA, 289 bp, Homo sapiens
taaagcacaccccagcaccttcaaatgctttctgaagtaaggctggggatggcatggttggcataaatggaatgggtgtatgggtgtgtgcaatgggtgagtgggtgggtggcatggctggaccgcatggctgaatggagtgggtcaagtggcatgaactaggcaggtcgaatggcatgggttcggcggatgcaatgagccacaatggcatgcaatgcactggcatggcatggtgtggcatgcagtcagatcaggtggcatgcagtgcacattcggtggcatgcagtgg

SEQ ID NO: 653109 - DNA, 127 bp, Homo sapiens
acccactactggctgacccactactggctctactggccccactactggccttttcttggttttgttatttctccttttggagggtactctttagatagaacaaaaccaagaaaaggccagtagtggg

SEQ ID NO: 653110 - DNA, 627 bp, Homo sapiens
agaaactgaaataatgctggcccaggaataaatacgttcctgaacatcgttaggtcttttcgaacgaagaaaaagacagaggatcgtccttaagtccctgctaaaacattccatggttgaaaattggcacttggaaggtaagcttgctaggccttgagcctccagggtgtcaatggagcttgtggctaataatattgttgtattctgggtatcaggtttaaaattgcagacaaggcccacagaatgaagattttccatgcattggcgaatacgtatatgctggttccatccactggcacaatatcgggaccatcattgcatcatctcagtatatcaatcattgaaggttgcgtaaaatttaagaaggggatgtcacttaacatttgttgagtaagtcggaatcagcatgtatattaaaacatattgtggcgaagagtgttggcagatggaaaggaacgataatcaagagattgatagccttgggtcattgactttcagataggggtggcaatgggtactatattatcgtggggtagcactttttcaaaagttcggtcaaagaggggaaaacaatcccttgagaaataagaaagttgaaaagggtgaaaaggaggaagggaaacagga

SEQ ID NO: 653111 - DNA, 801 bp, Homo sapiens
  misc_feature (314)..(314): n is a, c, g, or t
  misc_feature (489)..(489): n is a, c, g, or t
ggctgcttcgccgagagtaatcgaggtaacgcatgttgcaacagtgcttggacggaatccggtgtctcagtatgccgtcagcaaccaagtgaccgtgacgcctcaatattagtaggtccggtcctagtcacccatcgtatcatccggtacaacttcggggagagtggcctcagaatggcctgccagtagcgggcagagtcgaagccattgtacggtcaacatagcgacacagagacagccggaagctgtcggacctcagtctctattagctctgccagtaggagtgatgtgacatgcagtgttggaatatgtcnagcaggagtttggtgataaagtgaaaataaagtagaaagtgagtgaacatcacagtcaaacgtgcggcttggttgtcagactttctgttctcaattagttagagctgatttgaacagttgatctgtgaggagatgtcgcattgattgctatcaagaatagaaaagcactgtgtcnatagaaaagttctattcaacaaggagataatacaatgatagtgaactgtagggtggaacaaagaaggtagtgtgacctgtgtggacttcgacattgtgagggataggtctgctcacgaaaatcgatcaaggttgaatgagaatgatatggggtaatagtcatttgagtgtgggacgcttgaaaaagtagaactgaaaattccattggtgggaaacaagatccaatagggaatgagattggtgtccgtgaagagtcactttcgcgttgtgaagggtctataaattctgaggtagaaataacacaagaatgaac

SEQ ID NO: 653112 - DNA, 1516 bp, Homo sapiens
  misc_feature (1)..(1): n is a, c, g, or t
ncccgcttcggtatagggatgtgggcgcggtcgtgtgttccgtgtgctgtgctgtgtgttgcgtctgtggtgtggggtggcctgcgtcctctggtgctgttcgctttgttcgttcgtgctttcgtcattgttctgcggtgctctgtccgtggtcgttggttcgtttctggtgcttcgggtgtggtgttctggttggtcgctgatctctggtgtctggtgtgtcgcttcgttcttgttgttgtgtttgttgggcgtcgctctggggtggcttcgcgttctatctggccgttgtgttgtgtgtgtgttcgcccttttttgttcgctgtcgcttttggtcttctcctcttgtttttcgtctgcctgtgtttgtttttgtgggctgggttttgttgctcgcctgtcgtgtctggttctggtttctgtgtctgtttgttgtcttcggctaccatggtgtgctcggacggcggtgtgcctctcggttttcgctggttgtctgcgttgttggtggtatgtggcgttgtgtgttggctcggttgtggtgtcaagggtgcttgctgatccagagtgatgttggtggtggtggtgttaatgtggtgcgccccggtttgatggttcgagttgtgtgctgtgcgtgtcgctccttcgtctctgtggttggggtgctgtctcttttcctccgtctggcgcgtgtctcttgtgtagggggcgggggtgtgaccgcttggtgtgttctgcgttttcgcttgggtgtgtgtgtatgtgcgctcgtgcgcttgtctgtcgcgtgtcgccgcggtgtgttgcctgtgtccgctgggttaggtctgggcgagggtgtgtgaggcttggcggcctgcccctgtgggcgtccgtttggcgtctcatgtgcttgctgggtttgcgccggccctgtgtgggtcccgccgagcagtgggcatccgcgggtgtccttcgccgtggcgtcggctcccttggtgtctcctcgctggtgtgcgacggccgcgcgtgtgtgcaggcactggggcggggttgttgtatttcccttttgatgggggtcttagcgcttgtgtccccgtgggtgggtgtgccgcggtgcgagcgtgagtgaattcttgtcggggcgacgctccgtgccgggtcactttgctgcgtcccccatcctctcctatgtactttcctgtggtgcctgtgagctgtccacccgtctgaccgtggacttgtcatagggccgtcgctgtggcggggcctgtctcttgcgtcccccgggcgttcccggatgctccctgatggcccccgcatgtctgcgccctgcacgagcccacggggctgtagcgttctcctaggcgcgttttggggcatcccccttcctcgtcaccgtctcctcccgccgaaagaggcggcttttagtgggccatgtgcgctgtggcgggcattgggaggccccctcgtgactgtgtttttcataacttatgtttttatatggttgcatttacgcccataaatcctcagctgggga

SEQ ID NO: 653113 - DNA, 1100 bp, Homo sapiens
tttttcgaaggagagggagatagagcgcaagtcaccttctgtcatgctcggttctcacatcctttgctatcgctttcttctatgtctccaagctgtgctcgtgtacccaccagtctagcattggagttctcaacagttcaatcctgtcatcggcctacagggaagcctgacagtctcgtacagtcgtaggttctcatcatgttttcactatcctgactgctcggcggtgtaatcttggtgcaggtgataggctcctctgcaggtattgacctgatgcacagggccttcagacatccggcagcccatacgtgatgatgtcgagcccgtatcagcggcgtacctccgtgaacatcatcactcgtatgaccagggagaccgttcaacggtcatcgagaggtgccccaagcccgtgatttccctgccgtcccatggggcctatcaattggctgaggtctggaccttgttcaccgcttgtcgacatccgggtactgtccccaggagtgctttctgtccagggtgaaggaggtgcaccgtgtggttctggctgccaatggtagtgaacatcctgcatgcgccagccctcaagttcatctgggtaaccagagcctggtcaacgagctggccttcatccgtcccgcaagatgatggctcgacgaggccctgggcagtgggtctggtcagtccgtggtgttcccagacaaagaggtcatgcgatggatgctgccttagcgacttggcggccgagatttccagtcaagagccccgtggcggatcgacagagcaccaacggtcaaccatcgctgtattcacctgcgaccattcggtggccgagagcctcaacttacgtggcgtcctggaacatgtagcatgctgcagacccatagacctcgtgaagtaccggtccaggccacgactgagaacaaggtaactgaaaaccgtcaccttctccaagctctgagagccctcgcagtcccaggccccagccagggggccggcctaattcccgcctcatccacagaaaagggaggatgggcgatgacagtcgtgttctatgccttctgacccagtgtcccagtctataactcgttaggacaatgagt

SEQ ID NO: 653114 - DNA, 541 bp, Homo sapiens
  misc_feature (1)..(1): n is a, c, g, or t
  misc_feature (68)..(68): n is a, c, g, or t
  misc_feature (87)..(87): n is a, c, g, or t
  misc_feature (135)..(135): n is a, c, g, or t
  misc_feature (160)..(160): n is a, c, g, or t
  misc_feature (174)..(174): n is a, c, g, or t
  misc_feature (190)..(190): n is a, c, g, or t
  misc_feature (251)..(251): n is a, c, g, or t
  misc_feature (263)..(263): n is a, c, g, or t
  misc_feature (278)..(278): n is a, c, g, or t
  misc_feature (291)..(291): n is a, c, g, or t
  misc_feature (296)..(296): n is a, c, g, or t
  misc_feature (378)..(378): n is a, c, g, or t
  misc_feature (392)..(392): n is a, c, g, or t
  misc_feature (396)..(396): n is a, c, g, or t
  misc_feature (453)..(453): n is a, c, g, or t
  misc_feature (487)..(487): n is a, c, g, or t
  misc_feature (497)..(497): n is a, c, g, or t
  misc_feature (511)..(511): n is a, c, g, or t
  misc_feature (524)..(524): n is a, c, g, or t
  misc_feature (538)..(538): n is a, c, g, or t
naattacaccaatcattttacttacaaaaaatcgttttataaatcctcctcttaaaattatgttcaancccaccatggtaccttatncctgcaatcccaccacttcgggaggccaacgcacaacgatcgcttcancccaggacttcgacaccagcctggncaacatagtaagancccatctctatatttntttaaaaaaaaaaaatatctgttcaaaagtatttcagaccaaaaggaggtcataaaaactnttcatataattnctctatgagaaaaanatccctgtatggnaaggngcactgaagatctggcacagagaaacaaggggaaacagggcagtaataaaatccagccctatttttctagcatgcatttacnaccttattgatatntctntactgggtgttaatagccccctccttgtatttaaaaaaaaaaattaaaaaattaaanttaatcttttttctaataaaatcttcaattacanaatctcaaanccaaacctttaaantctttaaagcaanatctttttcatcangga

SEQ ID NO: 653115 - DNA, 835 bp, Homo sapiens
agagacagcggctcaggagtgggggagcacgggccttctacaccacatgggaaggctctggcgtgaggttttcctttgggaaggttgtttgggcccctgaagttccatctccgagagtggtgtgcagggcaggccagggcccatgctggctgcagtctttgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgaggggacaatcagcggctcgcggaaggccacgcctgggcaaggcaggacacagcgcacacagcaagctcttcttctgcgacaatctccccaggtgacggattcacaatcccaacaataaagattcacaagccacggctggcctgtgctccccatgggtgacctctggaggcagtggaccaagatgcagcaaggagaggatgcagaacagcttcttgcaggaagcacctgctccggacatccaagcgctgcctgaaaggcacgcaaggagaccgcagcggcacgacacgctggtctgagatgagggggagccccatgggccccagagcagaagctaaagcaaggccaacagggcactgccaagcgccaactcaggtcagatcaaacctgaggctgtggcctccaaaggggtctgggcgcaccccccaaggtcgcagggtgtctgagaggccagacaacctgccatgaaccatcgccggcgtcgagtggagcgaaacagcacagtgccctcaggaaaccgcctaaaatccaaa

SEQ ID NO: 653116 - DNA, 395 bp, Homo sapiens
aggcttgagcccaggagttttgaggctgtttctgatccacccccccctgagtccagcctgggtgacagaggccaagaccctgtgtcttgaaagaaagaggctgggcgcagtgactcacgcttgtaatcccagcacttgccttgggaggccgaggcaggcagatcacaaggtcaggagatcgagaccatcctggctaacacggtgaaaccccgtctctactaaaaatacaaaatattagccgggtgtggtggcaggcgcctgtagtcccagcgactcgggaggctgaggcaggagaatggcgtgaacccgggaggtagagcttgcactgagctgagatcgcgccactgcactccagcctgggcgacagagcaagactctgtcccaaaaaaaaaaaa

SEQ ID NO: 653117 - DNA, 888 bp, Homo sapiens
gaggaagcacgaaggcattgtcccacaggcagaggtcaccgtggcaaggcaatccaccaaggccagaaagggtataacgaagaaacccacgcggtctggatgtgcgggaaccctggggaggattgtgagtgcacgtccccgtctcaaccttccgagccgcctgtgaaaacgtgtagataaccgctagtggttggtctgagcacaagaactctcggtaaatcagctggctttctcacgcacggcctttgcatggggagtcattatgtaatagaaatctgtgggatactttaacttggcctgcatgggtgcttcagcgctacctgctccctctgctgacttaatgtaacgtgattctgctttcttcagatatttaaggctgcttaggttgtgtgagccttgaagtgtgatgtgtgtgtcccagcagactgtccactgtcacaggagatgcatgtcatttgtattggagatatttcatgtgtactcattctcattggtgctcacgattgccatggccatagggccacaggtgccgtatctgctgcagacatgattgtattcttgttctagaggcttttcttgttcttcgaatcattgccgtcgatgaatccagccagagccaaggggcctagatttgacctctgtcctagggctcctgggccaggtgcaggaacatctgaggccacatctgctggccacctccagtgggtgctgaccacaggatggctttgttacactcattttcaccctgattcttgcccccactttcataaaagaaacttcaaaatgcatgacgctttggagagtaagaaaatcaatcttggctgggcacggtggctcctgcctgtgatcctagcactttgggaggctgaacctgaaggatcactgagg

SEQ ID NO: 653118 - DNA, 120 bp, Homo sapiens
tagaggacccccgcggggcacaatcacttcaaagatatgcagatagcaaactaagcacattaaaaaatattcatcatcatcagtcactcgtagaaaggtaaatcatagtcacaattgcgg

SEQ ID NO: 653119 - DNA, 396 bp, Homo sapiens
tgacttcaatcaggctcttcatcctggggtattcccacacttagataagttttatggcagaatttagtatattaaccatcactatcatttggcacagtgcgtaccaagacttcaaaatgaaactgtaaagtataaagtgtagaatttatgcattcaaggtttcaaaaatcatttccttgtgtagtcatttgggtttttgcatcattcttccagtgaagtcgtcaattctcatgcatcttctcatagtcatgcaaggatagtcaataatggtatggttggtggggcagcatggtgtctggctctgtcacccaggtaggaatgcagtggcgtgatctgggctcacggcaaactccatctctcaggttcaagcaattctcccggcctcagtctcccgag

SEQ ID NO: 653120 - DNA, 1002 bp, Homo sapiens
  misc_feature (1002)..(1002): n is a, c, g, or t
gaaactattcccagttgtatccacggaacagttctctcaggacaggatatctgggtgtactctgagaattgacactcgctgcactcatggtcttgggcaatacacgaatgttgaggctgttcatgccaggcatacttatgcgcagcagcctatgagaagtataagctgggcattggaacctgatcaacagctgtcctatgtaaatgccattgagaaagtcttcaagagtgtgcaatcgtaagctggtgttaccttcacataagagtggcatcatggttgactatacctctaggtatccctcatcaccatgttctctttctgccaggacctatcacgaagttatgcatgtaaggctacgagaaaatcctctttctcgtccttgtactcgattaattaactggttaccagttctcattgaagttcagaatccaagcgtcacgtgccgttaaccggatgaaggaatacttcatatggcttgagccgggattcagtgataaccaaagctagacgtagtgatgatgtgagtagaattcgaccttacgatcgcaggatgagacccaattgtggcggtaatgtgtgtagcgcctttataggatactacataagcacttccctttttactctgggcgtggtcgcaaaggccttttgcctcgtttgtggcgctttttttaccgcaaagcactaatccagtagcttgaagttgcttggggggaaggaaaccagagccaatgaagccacgatcacgttcgcgtgaagcgtgcacttttttttgtctgggaatgacgttcctggcggaacacacgttggttaaactttttaaaacaacaatgttaaagaacagtacgcgtagtgatgggcctttttccacgaaaggtgggcatggtccctccaaggtgaggttctttaagaaatcttaattagtccggccaacaataattcaaagttttgcagggtttgcaaagcaatattattaagagcctcgtccatggatttatgaatatn

SEQ ID NO: 653121 - DNA, 1043 bp, Homo sapiens
gcacctcatggttcgttagacagtatctactaagaagctaacacgtgctgggtccgtgttcccacagaatatctcattgagtcctcagcatggtgtctgtggggtggaagcatctatcattcccattttatagttcacaggaaacagaggcgacctgcctagggtcattcagctactaagaggcagaaccagggctcaaacccaggtagcgctggccccaggacgcccacaaaatgatgacgctcgtctgcatagaccagcacatatgatgcttgcacgcagtatggaagacatgcatacatcgtccccgtggacgacggatcttcgcaggactcatgggaccatgcgctatccaagatatctcatccaaggacttcagctcaccagcacagcaggtttcgagcttgctcttgcctgcacaagaacctcgaccaagcacaacttctagtgcacaaaccaggcgcgctgtaggcgtaaggaaaaggccagtacaggcactcgatgctcacggagcagcagggcccagatgggaacgagctagatcaaccccaagtactgaccacacagacaacctcaccacaacacactcgcacgcgacacagacgcaccagcgaacaaaacacctagacggaaagaacaccacaagaacacactgacgcagctacgcaccacaccgcccaacacaacagcacccaggcatcagaacacgagcgaatccgggacccaacccggacctgaacaccacacaatcctccccaaccctcacaacgcaaccaaacagggaccagcccccaaaggaagcagacccctggcaccacggacgacgcacccacccctcaccaaccacaaccactgactcaaaactcccacccacagcaccatccacgcgagcgcaagcgcaccgcaacacccgcggcacaagcgaaactcaacataatgcaccccctccgagccaacctcacaaccacaccaaacccacgcacaccaacccctcggctgccaacaccacaagacctccaccccaccgcaccaacaacaaccaa

SEQ ID NO: 653122 - DNA, 258 bp, Homo sapiens
ttgtgtgagggattcgatacaaggctcagttaaagccacaaaaggggccgggcatggtggttcacgcccataatcccagcactttgggaggccaaggcaggtggatcatctgaggtcaggagtttgagactaatctggccaacatgatgaaaccctgtctccactaaacaatacaaaaattagccgggtgttatggcgggtgcctgtggtcccagctacttgggaggctgaggcaagagaatagcgtgaaccggggag

SEQ ID NO: 653123 - DNA, 470 bp, Homo sapiens
ttggtataattatttactggagaaacaggagacaggaggaggtagacaggatgctgagaagaaagaagcaggggggggatgaggaaaagattgggcaaaaaaaaaaaaaaaaaaaaaaaaaaaattttgggggccgccctgcggccccctggaaaaagcttttcagaaacaatgctttgggggcgccggcggccccaaggatagggataagtgggacattgggggccataccgcgtgttcccaagaggagaggatccccggggcaactggagccataactgggctgggggggttctctctcccccatataaaacaacccgccgcggggggggaaaaccgagccgcggctcgtggacacaaactctccacagaggggggagaatcacaggagggtaataacgggagtcctcctattcccaaggaggcttcgaggaagaccctgaatataaattacccccggcgggtgggga

SEQ ID NO: 653124 - DNA, 494 bp, Homo sapiens
  misc_feature (41)..(41): n is a, c, g, or t
  misc_feature (154)..(154): n is a, c, g, or t
  misc_feature (157)..(157): n is a, c, g, or t
  misc_feature (161)..(162): n is a, c, g, or t
  misc_feature (164)..(166): n is a, c, g, or t
  misc_feature (168)..(168): n is a, c, g, or t
  misc_feature (170)..(172): n is a, c, g, or t
  misc_feature (175)..(175): n is a, c, g, or t
  misc_feature (178)..(178): n is a, c, g, or t
  misc_feature (181)..(181): n is a, c, g, or t
  misc_feature (193)..(193): n is a, c, g, or t
  misc_feature (196)..(196): n is a, c, g, or t
  misc_feature (198)..(199): n is a, c, g, or t
  misc_feature (201)..(201): n is a, c, g, or t
  misc_feature (206)..(207): n is a, c, g, or t
  misc_feature (222)..(222): n is a, c, g, or t
  misc_feature (231)..(231): n is a, c, g, or t
  misc_feature (239)..(239): n is a, c, g, or t
  misc_feature (243)..(243): n is a, c, g, or t
  misc_feature (248)..(248): n is a, c, g, or t
  misc_feature (255)..(255): n is a, c, g, or t
  misc_feature (259)..(260): n is a, c, g, or t
  misc_feature (268)..(268): n is a, c, g, or t
  misc_feature (271)..(271): n is a, c, g, or t
  misc_feature (273)..(274): n is a, c, g, or t
  misc_feature (283)..(284): n is a, c, g, or t
  misc_feature (286)..(286): n is a, c, g, or t
  misc_feature (291)..(291): n is a, c, g, or t
  misc_feature (294)..(295): n is a, c, g, or t
  misc_feature (298)..(298): n is a, c, g, or t
  misc_feature (309)..(309): n is a, c, g, or t
  misc_feature (313)..(313): n is a, c, g, or t
  misc_feature (317)..(317): n is a, c, g, or t
  misc_feature (321)..(321): n is a, c, g, or t
  misc_feature (323)..(323): n is a, c, g, or t
  misc_feature (326)..(326): n is a, c, g, or t
  misc_feature (330)..(330): n is a, c, g, or t
  misc_feature (333)..(338): n is a, c, g, or t
  misc_feature (341)..(341): n is a, c, g, or t
  misc_feature (344)..(346): n is a, c, g, or t
  misc_feature (351)..(352): n is a, c, g, or t
  misc_feature (354)..(354): n is a, c, g, or t
  misc_feature (358)..(358): n is a, c, g, or t
  misc_feature (378)..(379): n is a, c, g, or t
  misc_feature (385)..(385): n is a, c, g, or t
  misc_feature (391)..(391): n is a, c, g, or t
  misc_feature (394)..(394): n is a, c, g, or t
  misc_feature (398)..(399): n is a, c, g, or t
  misc_feature (401)..(401): n is a, c, g, or t
  misc_feature (411)..(411): n is a, c, g, or t
  misc_feature (413)..(413): n is a, c, g, or t
  misc_feature (416)..(416): n is a, c, g, or t
  misc_feature (421)..(422): n is a, c, g, or t
  misc_feature (428)..(428): n is a, c, g, or t
  misc_feature (443)..(443): n is a, c, g, or t
caggccctgtggaagaatccagagcaggaataattggattntttccagccagtgactttcaggaggaccacatatcttcaatgtcttcacattgtatctgaaaaatgtatctgaagcactcaaacaccaagtctactcaaatacgcttcccaancancttnncnnntnannncgncgncgnccacaccagcancgncnnanaggannccaccaccgacaagnaggagatcnctaccgcngggnccaanaacggcngggnngctattcnacncnnccccaacannancgccnccnncgnccaactcaacnccgncacncaangnaanaaangcnnnnnncangcnnncgccnnanccanaaataaaaccaacaacaaanncagagngctccncanccanncnaacccctccncnacncgacnncccacnccccacccacccccnccacttcagggccccaataaccacccaccccccagccaaacccacccccac

SEQ ID NO: 653125 - DNA, 663 bp, Homo sapiens
aatcgaatccgttggcccacttgaaccttgtctttttagaaccacctactctgaataatggcacccgccttaatccacgtacacaaaggctcaggcaaaaaattcttcatctggagggtgagttcacattcatccaggtcgtgcctaaccttcagcctgggtccaaggtaacttccactctcacacaaaacataactcagcatgttgtctctcatatgtggattctgacaatgggccctcatagacactaggcagagtttcaccattctctgccgcttgttgagggtatgtggtctagggtaggtctagcattaggattagtcctcgatgtagatgatggggtcatcagtccagcaaagttgcatggcacatgcagacctgtgtatttgacatgctcgggcagcacatgtatctcagaccttaaagtttaatacaaattgataaataattccagtacctgcctgttccagttgaacatgtatatatgtgttagtctcaagtttcagacatatttcaggggagataaggtttcgaaggatgcaagggcatgctcgtatacaaataattaaagcttcataggtctcaatgtcccacatcccgagagattaatatgacctatcctcctggtaaccctatgaacaccttaaaataaacttgtatact

SEQ ID NO: 653126 - DNA, 169 bp, Homo sapiens
  misc_feature (66)..(66): n is a, c, g, or t
  misc_feature (85)..(85): n is a, c, g, or t
ggtcttgaactcctggccacaggtgatcctcccacctttgtctcccaaagtgttgaggtaaaaggnatgagccaccgcactcggncaatctaatttttaaaaacaccttttcctcactgggtggagcacgtgctacttttactgggaactgaatgaatgtgcaactcta

SEQ ID NO: 653127 - DNA, 1322 bp, Homo sapiens
  misc_feature (48)..(48): n is a, c, g, or t
  misc_feature (213)..(213): n is a, c, g, or t
  misc_feature (994)..(994): n is a, c, g, or t
  misc_feature (998)..(998): n is a, c, g, or t
  misc_feature (1000)..(1000): n is a, c, g, or t
  misc_feature (1055)..(1055): n is a, c, g, or t
ggcgccccaaccaggataggtgctcccccccatcttatgtaggtaggngtgttagataattagtaagcaagtgtcggggggtgtgtattaattccccgcccacactatccgggtgggtttgtgttgttcctcacactccagcgtgtgtgcgtcctttcggtgcgggaagtgaagaaggaaagtaattgtccctgtcgggagagaattgttttnggtgggggccaccaaaaggaccctgttgttagatgacccacccaccggcgtgctccttcgttcttcaagcgggcggctcttggccagcaacagccatccacccccttcggccttgtgtgttaagtaagtggaagaattcctcctcttggtggccgccacttccttcgcccccaccaacagcgcattaatactagtgttgtggacgacccccccgaagtaggtggacggccttcgttgatgaaatgttttcttcctctgcttcaccgctcctccaccattagtacggccctcctgatgttatagccccaccagcgttcgccccacaggctcttgtacttcgtgggcttctcttgtagtatagagatgatagagagcccgtggtagtattgtcggtgccccacagagatactccatcgcttcaccgcggagaggggcacactcgtcgagagagagtgcacacagcgcccgcgcgctctctcgagagaggccctcataaagctctcgtgagcactctcgcgctatcttctcgcgagagagatagaggctcctctagcgagagagtgctcgttcacagagagagctcttcgagatctgtagagaggctcgagacacatttctctctccacagagaggtgatcacacagcgcgcggggcgcgcccactctctgtagacactctcgagatgtgagagacacctcttctctctcgttggacaacacacctctctccgactggatgttcttgtcctctcgccccatctctctcttctccgcgcgctctntttngnggagatgagcaagagatagagatatagccccagcggtctctctttgtttattgtnggggccctctctctaaggccacaaaagagccccgcgctcgatctcggagaagatggagaaagccaccacggagaaggaaaccggcaccctcgagtggtggattcttggcacactctctcccacatgtgttcttctacaccacagaaagctcttgtggtggaattggcccctctgtgggtttacccggccaaaaacccccagattctcctttttagttagtataccggaccttaatataaagagggaaaaactcttgccttccacgta

SEQ ID NO: 653128 - DNA, 760 bp, Homo sapiens
  misc_feature (365)..(365): n is a, c, g, or t
gcgtctccatttcggtctcaggtgtggagtcggcaagaagccagcgcaagagggaagcggagttatagctaccccgagtccgcggagccggctcaggtgcactagccccgccccgcttctttcctccatgacgccgaagatcgacgggtcgctcatgcgcgggtcctcggtaggtatctgttgcggcagtcgcgcaggacgcccgggcatctacctgtctagggccaggagcgccgctacggtcctgtctctcttgtcgagttggagcaaggtggtgacagaacggcggtagcgtgctggctttggcgtgtccggttgcacccagtccggaggctctcgccgaatggatcaagcaagtctggaanaactggactagtgcgagccataggagtctggacaccaacacgaatcataagacactagtgatagtctcgtcccgggggtgatgcacggtcaataaacgggcattggcgtccgaagagacaaggctcccgttggggtggaccacgcctgaatcaagccccgtggggacgcagccaaggcacttggagttcccttcggaatttgcttagccatttgggaatcagttattggggcgtaccaacctatgcaaaacgattgcggcccagggaacccttttgggattcccccgttggagaaccttttggggcatctggacctctgatgactttcggtaattcgcctacgtaaaaacgaaccccttggggggttggaacctattcccaactagggggaactc

SEQ ID NO: 653129 - DNA, 138 bp, Homo sapiens
gaggttagagatcgagccttcctggataacacagcaaaaccctgtctctactgaacatacagaaaaaaataaattagccgggcactgtggcaggtgcctgtagtcccagctactcaggaggctgaggcaggataatgg

SEQ ID NO: 653130 - DNA, 4994 bp, Homo sapiens
cccggaaggaagtcgcgtgctgaggggtgtgacggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgtgaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcagaacattttgagtcaccttgggagattcaggatggggagagcaaatttgaacaaaaggtttttcttatatcctgagattgaggggtagggggtgtccaacctgtatagcccatgggttgtgtctagaattaagtggagggcagctatctggagttaacttgcaagcatattggtgccctccatgaccacctctggcttaggacttggccctgttatgagctgacccccaccccccaccccccacccccccccccgccaactcctatacccatcttccctaggtgaatctgtgaatggtcctttctggcagcaatccctgccttctttttgggcccatgcccagacttctggtttaaggaatggtcccagagcttgggccagcttgctcagaagttttgggagcattgagcctgcctagaaagatacagtgttagctccccttacttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataacc

SEQ ID NO: 653131 - DNA, 671 bp, Homo sapiens
  misc_feature (2)..(2): n is a, c, g, or t
  misc_feature (25)..(25): n is a, c, g, or t
  misc_feature (35)..(35): n is a, c, g, or t
cnccagtcgcagcattgagaaccgntcagatgaanaagaagctgcagacctcccaacaaagcctacagtgatctccaagtttggatttgccttagttggatgacaaagaaagcatcaacaatatccatcaaacttggatcaaataagccaaaagaaactgttccaactcttgctccaagcactttttcaggagcagcagcttttaatgaagatgaagatagtgaaccagaggaaatctccagaagcaaagatgaagatgaagaatattggaagggatacaccaacatcagctggaccaaactccttcaataaaagaaagcatgggttttttgataaccagaagctatgggagcgaaatataaaatcttatgttggaaatgtcaatgaccaagacaattaaacgatgttttgaaattggggtgtggggtgggtgtaaacttaaaaggaacagtttccttttttaaagaatggtataagactatttttggagccactttttttttctctttcattttttgtttaaatattgagctgtacactaataagttagggttcaaaattagaggtaatttatgttttatatacagatttcaagacatttgctaattttgtagtttcatgtgattagtttccaaaggttacagataataaatcagaaatggtaccttttt

SEQ ID NO: 653132 - DNA, 211 bp, Homo sapiens
tgtatgatgacgggtgcctgggagctgctggagcacgatcagctgtggcttgccctcggccgtccatatctctcggtcggtttcccggtgccagggtgcgttgcctgggtgtgaggtgacaccacagttctggtgtcagcggtcatgatgctaggatcgtgtgcctgccgagttcccggcttgcattgggagtaccgtacgctcaatactt

SEQ ID NO: 653133 - DNA, 985 bp, Homo sapiens
gagctctggagcctcatgcgaagcggatggagtgagtgctgcagctgtgctgacggcctgagtactgctgtgtgagatgccagtggtgccagctgccagcctcaacatgcctgccagaagtacacgaggaaccgtgcggcgtgcgtgtgcgtgtagtgccctgtgttgctgtggcggctgtgcgcgggagtgagctgcggagcggccagcctgtgcctgtgtgcgctggtgtggcatcatggacgagaaggtgttcaccaaggagctggaccagtggatcgcagcagcctgaacgagtgcaagcagctgtccgagtcccaggtcaagagcctctgcgagaaggctacaagaaatcctgacaacacaggacactccatacgtgcaagaggttcgatgtccagttacttgtctgtggatgatgtgcatgggcaactttcccatgattcatcagttgcgcaacctgtcctagcacactcggctgcgcacaatcacgcaaggatacaaactctacttcgctcactaatgggccagactctcactcgtctgagcacgacggcgactcattactctcccgtcagacacacccagcttacacgtgctttgttagctctctacgcgttccgcttcaccgttgaacctgcagtcagccgattccttctcgacgtggacatccactgatgacgcacgagcagactcacaccaccgcttctacctgggcggcttccatcctaactcgcttcgcacacctgctcctcacacgaaacacactcctcggcacacactcgccaacacactgctacaccgcgcacaccaacctacttccattacggacgcaatccttccctctcatgcaccgatactccctcacccctacgtcacccttgccccctcggggttgtggacttgggcgccccggactcctccaatggtccctcccccctcgcgtctggttcctccttgccggccagaccctcactaagagtac

SEQ ID NO: 653134 - DNA, 808 bp, Homo sapiens
  misc_feature (391)..(391): n is a, c, g, or t
  misc_feature (471)..(471): n is a, c, g, or t
agcgtgaggagccgccggcaagggggcaacgaggaagctcttaagagcgcggccggaaagcagttgagttacagacatcctgccaaaatgatttcttcaagagcccagactggtcagtaccctgatggcctcaaggacatcgtagctcggagggaattaggcagagctgttctcggaaacgcaaggccatgcgaaacgatcaacaacgtgttgcagctagctgtattgttcaaggaacttgactatgtgatagagggaatagctactatggatataacaagatcgtggattaacagcgaagtgttcagtcaagattaggagtacgagagaagtgggtcaggaaggaagcgaaaccacgagaagaacattagaagtgtttaacaacgaaccnaggaagataacagtcgtgtaggaactcgtaagagtagcctgacccagtatggagaaagatctacacggcacgagacgagngacatagtgttagacgcagaacacgaactagtaagtgacgaaagaaccatgccagttttcacatcgagtttactggctgtgcgcaggcacttgagcaagagcggaaggcaagattggtggtcgtttctttccaagacgcaggcaccccgtagagactagtaccccacccatcatcaccaccgtccaacagcatgtctcgacaatgagtttgcgctacgtcccagcgtgagccagctcagggtagctgctcagatgttagcaatggcgaacaagtgaacgaggacgagcacaccatgttctaacatgtggaccctttattgtctaactgatgagaatg

SEQ ID NO: 653135 - DNA, 436 bp, Homo sapiens
taatcagctcggcgcatatcatcatatttaaatgtactacatatgagaggctgcatgacattcacttaaagtggtgaaatacattaacctttaataagtgactcagactgatgcctgtgaagctgaaatctattttctggtcctaagctgtttccctgtgtgtacaattccctcggaatggtaggcagctgccatttagaactctgtgatgaataaagaaaaatctatatggaagcagaaatactatagaaatattatactctccaggcaaagaaaagtgggtgattgaggcaaatgcaccgataatttggggtcagggagaacacttgtctgaattacacagaaaatgttttcataaccttcaactttttaatcacagaaacatgcactaatatgcaaaacaagtgtgacagaatcatgggataaaagtatttac

SEQ ID NO: 653136 - DNA, 341 bp, Homo sapiens
  misc_feature (54)..(54): n is a, c, g, or t
  misc_feature (286)..(286): n is a, c, g, or t
  misc_feature (307)..(307): n is a, c, g, or t
  misc_feature (320)..(320): n is a, c, g, or t
ataccacagttgtcaccattttcttctttttttgaggcagagtcttgctctgtngcccaggctggagtgcactggcgtgatctcagctcactgcagcctctgcctcctgggttcaagctattctcctgcctcagtctcccgagtagctgggatttcaagcacgtgccaccatgcccaactaatttttgtatttttagtagagactgggtttcaccatctttactggccaggctggtctcaaactcccaacctcaagtgattcgcccgccttagcttcctaaaatgntctgggattacaggcatgagncacaacaactggnttctaattgtttttggtttta

SEQ ID NO: 653137 - DNA, 362 bp, Homo sapiens
ctttgtgtcacttcatgcttgtccttatgcgttcaccaagtgttcactggatttgaaatacagtcatctacagccacatttttctccaatgcaacatgtctactgagtggaatcaacaattatacccagcatctgtcagcactcaacaatacctttctgcatgactctttccataatgcggctgctgtctgtgattacgctcagaattgtctgcaaaaatcgtcggcacaactgacctagcacagctcaaagcatgtcaacatgactgactgcagactcacttcaggaaagtatccccagtgccgctatagtgctgctgcccagtacaaattcttcattgttgcctgtgacccccctcagaa

SEQ ID NO: 653138 - DNA, 205 bp, Homo sapiens
  misc_feature (56)..(58): n is a, c, g, or t
aagcttcgctacatcgaggccatttccagcgacttgagcgccttttctatatactnnngagtgaccgagaccgcggccggaccgagggttttgtaatgagaggaagtaggacagggcttatctggaaagaagtttggaaccctggggagaaattagttaaaaagaggtggaatctagatgagctgcctaaatttgagaagatttt

SEQ ID NO: 653139 - DNA, 140 bp, Homo sapiens
ccttggggtctggacgcaacggcggcggagcatgaacgcccctacagccttcgaggtcgttcttgtctcttcgagggcgagaaggaagatcaaccattaacaagggacaacaagggtacccaattgcctttttattcacc

SEQ ID NO: 653140 - DNA, 349 bp, Homo sapiens
  misc_feature (44)..(44): n is a, c, g, or t
  misc_feature (84)..(84): n is a, c, g, or t
  misc_feature (259)..(260): n is a, c, g, or t
gacgaaatgttcacgactcaccatggagtttgggctgagctctngttttcctcctttcttctttaaaaagtgttcaatgtcgantgcagccccttgaattttggggaagccttatccaacctggggggtttccaacaaaactcccttcacaattcttgattcaccctccctaactatggaatgcactgggtccgccaatctccaggcaaggggctggagtgggtggcagttatatcatttgatggaaagaaaaaatatnntgaacactccttgaagggccgattcaccatctccagaaaccattccaatgacacactgtatctgcaaatgaacagcctgagaattgaac

SEQ ID NO: 653141 - DNA, 181 bp, Homo sapiens
caggctcgagctcgtgggtggcagtgtgcgacgatttttgcagacgatgctgagcaaatcagagacagcagccacattctggaaacagtcatgcatgaaaggtatcttgatgcttacagtgccgctatagtgctgctgcccagtacaaattcttcattgttgcctgtgacccccctcagaa

SEQ ID NO: 653142 - DNA, 953 bp, Homo sapiens
  misc_feature (5)..(5): n is a, c, g, or t
tagcncccacatgaatatactagaaataaaactaaatgggacgtcgaactaagtacggaatctttatcacaatatcttggtgaccactggtaatacgacctccgtcagaccattctttcgtggacctatgcccccttttaccgtatcttctaggtcccccgtgttttcaaaacatcttttggtgaaaaacacacacaaaaccttggatcccacagactcccaaaggcgttttttttttacagcaaactattggtaacccttttaagaccccttcgtcagtaagcccttaagaaattctttggaaccaacacaagttttccctggccaaacccataagtggtgtcttacccttgccccccgtcccctggggcaggtgcttgtttttaacccgagtgccagagccgcccccccggggctttttcaacacgggtgaacagccccccaccagcctccagggggccaccgtgccaaaattcatatatattagctggggtgacccttacatggggccaacgcacgggggcggtttgcaagccaccccagttcgtgctcattatctgcaaggagcgtccacccttttcttcagttgcccgagaaagatttcttcgtatataattttgcggctaaaaagatttctactgcatctaaaagtttttcctatacgacccccaaacaatagatattttcttgagccccccactgtccatcagaatccagtcctactccacactaccgactctttaggagatcaacccctttatctaggcacccaaattcattgagagaacgcattaatctccatcccaccactctctgttagggctctaaaagaacacaaccacccactctgttgcggtatccaccaccagacagcagcacaattatcaccgatcttccccttcatcccccatctgccggtttttttcaaaaccattctttcaacccacaaaaca

SEQ ID NO: 653143 - DNA, 223 bp, Homo sapiens
agggaatctatttcttactgtttactcctccactaagtaccacacggtggtgactgtagtagctgagagagtaactcttaagcgtcatatagggcaattctttccggcttgattgatttatatttgcagaatggctttagcttttcttgtcccttgtcctttccataaaaattcggaataagcttgtaagtgtctacaaacaaacctacctatggcacaagcg

SEQ ID NO: 653144 - DNA, 173 bp, Homo sapiens
tccagaagagtgtgtagtgagtgtgtgtgtgccgattgtgtgagtttgtgatggtgagagagagagagtaagtgtgagagcgcgtgagtgtgtgtgcgagtgtgtgcgtgaccaagagggggtaagagtgtgtgtgtttttgtgtgagagggccgagagtgtgaaacccgttt

SEQ ID NO: 653145 - DNA, 131 bp, Homo sapiens
ctcggtattaaggatccctaaagggagtcgggtatcaaatgcagctgatggagatggagttgatgagcacagcctagtgatcgatacactgaaggaggtagatgaagctcgtaagtgctatcggtatggtt

SEQ ID NO: 653146 - DNA, 580 bp, Homo sapiens
aacattgacacgggagagcccttgactattgctggcatccgaggtcacaatctgtcagttatcctaaagagcaacgaggctttcttgcctggaagacctgtataacacctatggcattgcttgagccaaatagaatcgaactttgatgtgacgggtatctgatgaaacacagaggggatgtaactgatggaacctacccgatgggactatatgcagatgagtgggcaagcccactgaacatgcgacgttgttgcactgagagagcgcggagcctatgtttacatctgcctcagctgaagacacacacttgatgcatagttgaactggagctaagaaagaggatgtctctccatgagccgtgtttgtaccaatttcgcagggccttccggagctccacctgtgatctgagagattatgttaataacaaaaaccagagcatctttcttcattacccttaaaacgaccgttggaaccactgctctggccatatgccatgtaaccagctttcggctgatgcactagttgtagaacatgcacactcgcaaggctctacagatatatttgcctaaatgtgaataat

SEQ ID NO: 653147 - DNA, 157 bp, Homo sapiens
  misc_feature (26)..(27): n is a, c, g, or t
  misc_feature (34)..(34): n is a, c, g, or t
  misc_feature (36)..(36): n is a, c, g, or t
  misc_feature (42)..(42): n is a, c, g, or t
  misc_feature (44)..(44): n is a, c, g, or t
atgtgtgtgggtcatggcacaccatnngtgggcnangtgcangnaaaccatctttctccctctactcacggaatttctgtctattaaggtgacagaaattccgtgagtagagggaggaagatggtttcttcacgtgtcccacgtcgcttccacacta

SEQ ID NO: 653148 - DNA, 125 bp, Homo sapiens
aggccggtagtcatctgcactcatctacaaggcatcaatctgcgtgtggcatcaacgtaaaagtctacagctagggatcttcttgaagcaaggttccaagcacaaaactagtatgaccggaggct

SEQ ID NO: 653149 - DNA, 193 bp, Homo sapiens
accggttagagcggtctcttggcaaaagaatcctcagagccttcacgcagagacatcagccttcgtcagcccaacactcctaagatctccatcagtgaagtgcagcgtgtcatgccacagcccttctagagccagcaagcaaagacgttccaacagggtgcggcggcactgactggtcgtcatcagaccgctc

SEQ ID NO: 653150 - DNA, 1527 bp, Homo sapiens
  misc_feature (26)..(27): n is a, c, g, or t
  misc_feature (34)..(34): n is a, c, g, or t
  misc_feature (36)..(36): n is a, c, g, or t
  misc_feature (42)..(42): n is a, c, g, or t
  misc_feature (44)..(44): n is a, c, g, or t
  misc_feature (112)..(112): n is a, c, g, or t
  misc_feature (164)..(164): n is a, c, g, or t
atgtgtgtgggtcatggcacaccatnngtgggcnangtgcangnaaaccatctttctccctctactcacggaatttctgtctattaaggtgacagaactgaagggcctggcnaaccatgtggttgtgggcagtgtctcctgtgagaccaaggactgtttgccgncctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtgccaccgcatcctaccacaagcctcgcaccatcccatgcaaagccccatccttataaatgtaagcccttaccactgtgcagctaaggaaataagcaaacccactctacccagggcccactcaccaaaaagctgcaaagagcccacacaacctggcccaaaggaagtaagaatgaccacgaagagcgcgagaagaaccagcccaggagatcgcacaatagaacaaatgaatgcgaaggcaaacaccataaagggagacccaagaaaacagcaag

SEQ ID NO: 653151 - DNA, 135 bp, Homo sapiens
gatatcccctcctccagccgatcagcagtattaaagtggatctccagcctgcacagcagtattaaagtggatcatccagccatgcacagcagtattaaagtgtactcatccggcctgacaagcagtattgaagtg

SEQ ID NO: 653152 - DNA, 1475 bp, Homo sapiens
  misc_feature (26)..(27): n is a, c, g, or t
  misc_feature (34)..(34): n is a, c, g, or t
  misc_feature (36)..(36): n is a, c, g, or t
  misc_feature (42)..(42): n is a, c, g, or t
  misc_feature (44)..(44): n is a, c, g, or t
  misc_feature (112)..(112): n is a, c, g, or t
  misc_feature (164)..(164): n is a, c, g, or t
atgtgtgtgggtcatggcacaccatnngtgggcnangtgcangnaaaccatctttctccctctactcacggaatttctgtctattaaggtgacagaactgaagggcctggcnaaccatgtggttgtgggcagtgtctcctgtgagaccaaggactgtttgccgncctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactaaatactaccgtatggccaccataattaccccatactccttacactattccgtcattacccaaactaatgaaaaagaaaaaaaacgccgggctctaatcagcggggggacacgaggcagtgaagtgggccatgtcattggcgtcctgacccacttcttggcccaagtggccacctgccgcccccaatgggaccgataagtcgacagccggtaccgtagactgcccgcgaccagcagcgctccacccagggcggcacatcagacaactacacaccgcaccagccagaacacaccacaccacatacacagctaagcccgcacgagcacacacgaaaacgcaca

SEQ ID NO: 653153 - DNA, 1223 bp, Homo sapiens
  misc_feature (26)..(27): n is a, c, g, or t
  misc_feature (34)..(34): n is a, c, g, or t
  misc_feature (36)..(36): n is a, c, g, or t
  misc_feature (42)..(42): n is a, c, g, or t
  misc_feature (44)..(44): n is a, c, g, or t
  misc_feature (112)..(112): n is a, c, g, or t
  misc_feature (164)..(164): n is a, c, g, or t
  misc_feature (1197)..(1197): n is a, c, g, or t
atgtgtgtgggtcatggcacaccatnngtgggcnangtgcangnaaaccatctttctccctctactcacggaatttctgtctattaaggtgacagaactgaagggcctggcnaaccatgtggttgtgggcagtgtctcctgtgagaccaaggactgtttgccgncctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttgcacaagcacctcacccgctagcctgtcctctcccgatggggactactctatgagntcgaccctgttggtcatgcgagcctt

SEQ ID NO: 653154 - DNA, 133 bp, Homo sapiens
cttttggatgtgggtcttgaccacgtcacgcgacttcccaggaggccatgccctagtgctggggctcccagactggtcctctcccagccccacagagagagccctaccccgccccgacactcaccggcccagg

SEQ ID NO: 653155 - DNA, 1271 bp, Homo sapiens
acctgcgcggtatgtatctctggagcggcgttcttttatctccgtccgccttctctcctacctaagtgcgtgccgccacccgatggcaagattcgactggacatggaccatgagccccctgcaggccccagaactatcttctacggtctgtgcaactaacaggccgacaaagcattatcactttaaggtggataactgactgaccaactgagcaccagttatatctttacagaaccgcgtcagcttatacgggcgctgtgtgcacacacggcctgagctatgcaccatcgctcgcacacgcccgaggccacactgacattacgaaagcgccaggtccaacttcaacagctaacccacctgggccaacctctctgcaccacctgctcctgatacgcgccccaaacgggcctaataccccattgggagagcgccatatcgaaaccattaaacgtcccccaaacccaaagcctggcgctccttcctatacggggcttctgacacgccgcaacgctagagcatctcccagcgggggctcaccaagatggcaagctaacttctacgactggggcccaccatccaacccctatacaccaataacggcccttggctcgaccacgcctgaaccgcacctgcgcaagaaacgcgtcccacgaacaccgaacttgaccgcgccacgcgaacgctacccgggcaccgcttcaccacccccctctcctttcacaccgtagcactaagctcctgcggcaacaacagccgaggctatcttaggccccccattggactatccggcgtgcgaccacaccacaccgcgcggctctaccctcccccaggcatacactccactcgctcttcactacaccccttacgggtcattggcgcctagaactcgccacaccgaccatgacctcgaacccgaactggagattagcacccggcaacaagcacacgcggacacgacctggcacctcggaaacccgcgacggcagccggacaacagacaccgccacccttgcaccctccctccgaacccttacctctacacctgcccccacccctctacaccccaccacacctcaacccacccccctcctatcccttaccacaatcattgactacaatcaccccaatactcattcacccccccctagaacctaacaacacaatactgacaccaccacatccccttctcaacactctacccctacacaatttagttccaccaccaacttcctccccacactacactactcaacccacaagccaccacgcaa

SEQ ID NO: 653156 - DNA, 988 bp, Homo sapiens
  misc_feature (12)..(12): n is a, c, g, or t
  misc_feature (32)..(32): n is a, c, g, or t
  misc_feature (41)..(41): n is a, c, g, or t
tctctgggtcantctggactggaatacaggangagaagggngcgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtgccaccgcatcctaccacaagcctcgcaccatcccatgcaaagccccatccttataaatgtaagcccttaccactgtgcagctaaggaaataagcaaacccactctacccagggcccactcaccaaaaagctgcaaagagcccacacaacctggcccaaaggaagtaagaatgaccacgaagagcgcgagaagaaccagcccaggagatcgcacaatagaacaaatgaatgcgaaggcaaacaccataaagggagacccaagaaaacagcaag

SEQ ID NO: 653157 - DNA, 256 bp, Homo sapiens
  misc_feature (56)..(56): n is a, c, g, or t
gcttagtagataagaactatacaccattttagaggaaaaatatattatctaatttngaaatgttgagtttcagggtaatattagtacttggatctatgtccatgtcctagattttttttcctgagcagatgtttcatctttaaggagaaattaacattaatacattcatgttagctaatagcaaaatgtgggtgccatttgacatatatacacgggatattatttatttagtgataggaggtgtgttcacaggaaa

SEQ ID NO: 653158 - DNA, 1025 bp, Homo sapiens
  misc_feature (5)..(5): n is a, c, g, or t
  misc_feature (161)..(161): n is a, c, g, or t
cttgnggcacacatagaacacattgtttccataaagacagctgtttccgttcgctattctccgggatttgtgctcaccacccgtcttccaccagcgggcgccgtggttttttccgaccgtgactgaagaacatacatcaaggtgtttcttcctagaacacngcttggggtgaactcagccgctcaccacctgggggggtgagaacgacccaccacacagactagtctttgtgggtggagtaggcccacccctttgttgtgtgcgagtgcccatgtatccatctttgtctcctccccggagttacttttttccttcttggtggtgggtagaggatttttctcccctgtctctctgctcttcctccctcaactgcggcggcgtgtttgttctccacaaactgtttttttttcacaaatgttcgttgtgttcactcttttgggaggcgcctccttctatttctccctcctgttttttctccgtcctcgctctccatctgcgcccgaatgttcttttattattgttggtggcaattctttctaagaccagactcgctctgtgggagtgtaatataaccccttgctctactcacgcgcgcgggagaacccttcctgttgcgtggttcttctctggtagatagactaactctctattcttcacacagttggtttctccccgcggaggagcaccacaacacctctcttgggggcgcccccgtggtgtgtgaggcagcgcgtcctttggtgagtgtgccccccttcgccccccctttgatgagcacagcacgtcttctgtgtggttgttgtgagcacacgcgttcttctttcgagtgtcttctcctccggaactttcttaaaccactcctttggtggggccctgacttcatgaagttgatctctattttctctcagggtgttcctcttactttctcttcccttaaaaaaaaggcggggggggggggccaacccccccccggtttttccccctccccccaaaccctttttcccttggggggccccccccccaca

SEQ ID NO: 653159 - DNA, 1887 bp, Homo sapiens
  misc_feature (1078)..(1078): n is a, c, g, or t
  misc_feature (1126)..(1126): n is a, c, g, or t
  misc_feature (1138)..(1138): n is a, c, g, or t
  misc_feature (1274)..(1274): n is a, c, g, or t
  misc_feature (1379)..(1379): n is a, c, g, or t
  misc_feature (1388)..(1388): n is a, c, g, or t
  misc_feature (1407)..(1408): n is a, c, g, or t
  misc_feature (1418)..(1418): n is a, c, g, or t
  misc_feature (1433)..(1433): n is a, c, g, or t
  misc_feature (1480)..(1480): n is a, c, g, or t
  misc_feature (1482)..(1482): n is a, c, g, or t
  misc_feature (1484)..(1485): n is a, c, g, or t
  misc_feature (1488)..(1488): n is a, c, g, or t
  misc_feature (1494)..(1494): n is a, c, g, or t
  misc_feature (1507)..(1507): n is a, c, g, or t
  misc_feature (1520)..(1520): n is a, c, g, or t
  misc_feature (1522)..(1522): n is a, c, g, or t
  misc_feature (1534)..(1534): n is a, c, g, or t
  misc_feature (1630)..(1630): n is a, c, g, or t
  misc_feature (1634)..(1634): n is a, c, g, or t
  misc_feature (1638)..(1638): n is a, c, g, or t
  misc_feature (1645)..(1645): n is a, c, g, or t
  misc_feature (1654)..(1654): n is a, c, g, or t
  misc_feature (1666)..(1666): n is a, c, g, or t
  misc_feature (1699)..(1699): n is a, c, g, or t
gctaagagaacccccacaaagggttcctttgtgccaaaggaaagggaaataatttgggctccccctggagtctaattgaagggtgggctccccggggaaaagaggaccttgtgccccgcccaccgggaaaatgggagcctggttctttagccggaaccctggttaaacacaagggttctgcgttgctcaaagaataatgttcccccaaacccagggtaacaattttttgccgatctaaactgtcttagcgcccacaaaatttgggccccccctgggtgtggctacacaatggaattggagatgagtttagtttaaatggttaaaaagggtccctgttttatagagaaaaggggaaaaattggggatatacattggggccccaccccacatgtgccccccgggcacactatttggtaagaaaataaagtatagggatttcctccacccccccggtaagttttggtacacatggagaggccacaacgcacaaacacaccccacagaaaaaatgtgggtggagagaaaaccacaggaaacacaaaatccttttctgggtttctttttaagagtttttatatagtgggggtgcactggggtttctaaaagccccagaacctgagagaattcacatttgtgccacaaatggggagaaacacacgcgtaaaactcgtgtgttttataaaagagtttttttttctggggtagagctctttaggcgcttataatgcgctaaaagagagaatataaaatgagcaccttgggggtaaatcttatattgtccttttctctaagagccaccacacttaaggataggagaaaattaaaatccttttgtcacatgcctataatgagattaaacgctggttttggtgggaaattgctttttataaaggaaagttaattataataatcaataaaggttaatataattaaataattttgagaacacacacgggggagaagtgaaaggaatttgtcacatttaaaaaacccacagtggttttgactttttctgttgagaatgagacacactgtgccctgtggaaatttttgcacagagaagtgtttatgctttgtnagcatttcaacttgcattattataaagaggtattaatgcctcagttangtgtttgtcaangtactggctgaggattctatctcagctgtcttttctaactgtgtaggttgagttttgaacacgtgcttgtggacatcaggcctcctgccagcagttcttgaagcttctttttcattcctgctactctacctgtatntctcagttgcagcactgagtggtcaaaatacatttctgggccacctcaggaacccatgcatctgcctggcatttaggcagcagagccctgccgtcccccacaggntctgctcangtcctcatctcatttgctnntgtaaagaantgggcaacggggaanggagagagcaattgaggcagttgaccatattcagttaattaattatntnanntgntttttntcccaaagtccancagtctctgaaantnagaacagtaggnggtatgagataatcaggcctaatcatgtgtgatctctttcttagtgagtgaatgttctatcccaaaagagggattatatcttatagactggtctgngtcnagantctgtanttaccccanttttattggaancattatactaaagttccagtgtattttttggtnacaaaattctttcgttgaaaaaaaaacgcaaagcagtggggaacctttacacattaccaggggcttaattattaaaaacaaaagagagaaaaataaggaacaagatggatgaagaagaaaaagactagactaaatagagaagagagagccaagagaaaatattgggggggggcggaagaaaaaaaggg

SEQ ID NO: 653160 - DNA, 199 bp, Homo sapiens
actgctagtcagctgcctcttcctgtttgcttgggtgttggctccggacggactgtccctctcgaaccgcctcctttggggctgcggtggggctggggaccctcttcagtgccacctcagtgttgcacaggaatgtgtagtagccctctgagtcacctagaactggaggccagaggaggaaggaggacgatgacgaaga

SEQ ID NO: 653161 - DNA, 969 bp, Homo sapiens
  misc_feature (501)..(501): n is a, c, g, or t
gccgtggccggggacggggacggggcggggccggggccgggccgtcccccgagtggcggcagggcttgggaggacggggcggctgccggcgagcgcctgtcagcggttgtgcggcggcgccccctcgggggggaagcgggtcccttttcccggtcggggagagcgccggggccggggccctatgggggaacccgggggccaacgggaaaagtcgggaaaaagaggcattggactgtgccgtggcccattcaccccccgggtattgtacatcaagtcggagaaaggtgactccgaaaattctgggggcaaatttgttggcgaagacgcggatgtgtctaactaacttcagggcacaaggggtgtcacaggaaaggttcgaggaaggccagcgccatcacggtgggggcacggggcacccgggggacaacactcagtggggcggaacaccacacaggccagggtgtgtggacctccaagaaacgtggacaacagcaactggangtggccagagactaacattcgcgaggaacgcaaccaacgcagggacggcgcgtgcagaacgacggaatccctcttctaaacccagaaactaaggggtgtacaaccccgagcactttgaattaccaatctttggcccaatttaggtacaaagcaggtcatccaatttttcccaacacaacccgggttaaccccaaaggttcaccaatttccttccttagataatatacggggtgaaatctcagacccccaccaaggaatttgattggacaggccacgtcagtttttcgggcagaaaggaggctacaaaggaactttagggccatcagattgttcaacggaacacatttatacagcgcgcgggaatcatcccacaggtcgtcaaggtgttgtccccgtgttcgaatggatgagaccctttaacttgtggttggcaggtgtttggacaacaagttgtggccaattaagggc

SEQ ID NO: 653162 - DNA, 447 bp, Homo sapiens
ttttggcacatgtcagttttgtttatataaaatgaagagactgtctctctgatgatgggtttaatgaaaggcactctgctttgggtgtgggcggtccaggattatgtggtaactattgtctgttagttacctggatattttatttttctttttggatcttgcaaggggaaaactacaagtaacaagttttataaatttaatttaaattgttacaggttttcatgttcaggacaaataatttttcaaccttcgatgatatccttgcagcagtttgttggtaaggtgactttcacctagggcagctgttgcatgccaattttttttttttgtgtgtgtgtgtgaaaacacttcagaattgaattaaaagatgtaaatttaaaattggttgtgtatctaatatgcccaggttcagtaaataaacaattctttttaaaaacaaaaaaaaaa

SEQ ID NO: 653163 - DNA, 142 bp, Homo sapiens
cattcagaaaatcggttcaaatgatacctcccctataaaactgtcactgaaatccctaagctgtatgtcctaatttttctcccatagtatcttgactctgcctacataacatatggcattatgatctgccccttccagcaat

SEQ ID NO: 653164 - DNA, 177 bp, Homo sapiens
tttaaaaaaaaaaaaaaaaaaaaaaaaaaaaaaaactttagaactgggtcagtgctcatgcctgtaatcccagccagcactttgggaggctgagatgggaagatcacttgagcccagaattagagataagcctatggaaacatagcaagacacttgtctcttacaggggaaaaaaaa

SEQ ID NO: 653165 - DNA, 293 bp, Homo sapiens
gggtttttaaaattgggggtttttttttccaggagggggggcccccggggggggcccttgtttttttccagctacccccaaaaaggggggccttttttggggcttccaaaagccaatttttttttttaggggaaaaagggtttttttaatgcccccggccaaattgtttggggggttttagcccccttgccccccctttttggggtttttctcccctttttttgttttcccccccgtttcctgaaaagggcccccagggggaaagggaaaaaaaagggttttgcccccttgga

SEQ ID NO: 653166 - DNA, 109 bp, Homo sapiens
gtatcatgggggacatgtgtcttcgagaaggacggatcaacgccacggtgtgaagctccagcccacagctggctccaggacctgcacatccactcccggcaggaggagg

SEQ ID NO: 653167 - DNA, 779 bp, Homo sapiens
ggagaaagcagaaaaaggagctccctggttccgcaagatcaccaatgcaagcatccctgctccacaccaagccgcagcgctttcttcgccttaacgcgctccattgtcatcatggggagacgtgggccagggctcatcccagcatcacagccacagcgctttccccgccgaatctcccagctcataggctacctggttgacccccgaatgctgtgcattcagtgggcagggaattcatcacagagctagctcccccatgctccagctgtgcccatgttcccacagccggctctgtggcacacacggcccaagctcccttccactggtctggcacccaatgctccagacgccaggtacctgctctccacaggcgcaaggtcagcaggcagcatcccacgtgtcaccaactggcccgagacccctttctcccctgaacccgcaacagcttcacctcagcaggtccccatcgcccctgtctggccatgtagcccaggcctttcccacaaatgcttcacttgtcacactcacctgggcaggcaactctcacgggccaagagtgcggagccacccgtacacccactactcaagagggtgcagtcggctgagaagctgccagcagcaactggccgctctgagaagaagctagccagttctcgcaagcacagctttgactgccccaatctgacctgaaagaaggcactggcggcccaggaactgaaccccctggaaaaaaggggacccagatgtactggccggccagcgggccgtgcaggaagggg

SEQ ID NO: 653168 - DNA, 207 bp, Homo sapiens
cttcatcagacaaagactgggcacgtttttatttatcagcaaaatcttggagactggtcagctatcacggtcagtgaacttccaacaatccaaggtacattgactgtttcgttctttcgtcttttacacttcttggtgcataaattaatggcttgataaatagtgaaaagcaccaggcagcgttggttctcaagaaagatgcaacaa

SEQ ID NO: 653169 - DNA, 234 bp, Homo sapiens
ccggtgacctcccccagggcctccttgcacagcccagtccaggttgttgtgccaaatcccaaccagccacgcctcagcctttcccagtttttccctgcagtcctgcagcagcagcccccacccccaagcttggtgttaagccctggtaagaaactaagggggatgggttgttggggccagaagggtttttcctccagcccctgcacactcccacccaggacagcccccagccca

SEQ ID NO: 653170 - DNA, 139 bp, Homo sapiens
tcagaaacttcatttttgttttttttccccatggaaaaatcctcctggagcccccagttttttaaacttccagcaaaggtaaaatcctgggacttttttccctgttttccaaaaattccctttaccccctttagagcca

SEQ ID NO: 653171 - DNA, 152 bp, Homo sapiens
gagcttggactggcggtcgttacaagtcgtgagtggtagcggatacaattggacacaggataggtttaacaccgtggtgagggggagtggggtataaaattttcacagaggggatgtttaatccacttgaggcgaggtgggggggtgaaatc

SEQ ID NO: 653172 - DNA, 112 bp, Homo sapiens
ggaataaaagtgtaagtcagtgctgggagttctcatgtaccttcccatagtcttctctgatgttaatatcttacataccatggtacagtgatcaaaaccaagaaattaacat

SEQ ID NO: 653173 - DNA, 367 bp, Homo sapiens
gctcgacggagccgccgccaatgatccaagcatcaacttgctgatgtggtgaatccgggtgctggttatcgttgggcgttaaaggcgtgttgcccgcgaggtaagagccgcatccagcgacggaacccaaagcgcgccatcgcctttaagaggcgcggctgaatcgctcgtaatactgcggctgatgacgatattggtgcgctcgggcagcggtcgaaaacgcggtggaaaagactcccaggtgcgccgccccatgatgacgggcttacccatggtgacggttttgaaatgcgccaggtcttcggggggcacgcagggccatggtgccgtcgcgcccaataatacccgcatcggtctgcgcccaaat

SEQ ID NO: 653174 - DNA, 953 bp, Homo sapiens
gatggtgggaatgggccagaaagacagctatgtgggggaatgaggctcagagcaacttgagggtaataatgatgatgatataataataatagccactatttaaaaaaaaaaaaaaaaaaaaaaaaaaaaaaaaaaaaaaaaaaaaaaaaaaaaaaaaacaatcaaaaaaaaaacaattgtggtgcggccccgcgcacccccagcccaagaaaaaggcttgacagaccacacatgcgttgtgagggcggggcggcgagccccagcgaagtcgaagcaatgcacacgacaccaccgcggaaaccaagagacagaccgaggcgcgaatgaacaagctgcggtgggtaaatacccaatgaaaaacaagcgacggccgcgggacaaacgaatctgtattgaagaaaacaaacccaacgagggctacgacgagaaaacactcgtggaggaatacatacaacaaagacagggaaccacacgcaagcgactacacaaaaaaaaaaagccacacaacgcggcggtgaacagaccacaaccacaaaagcgcacaacgacaagcaaccagccacacaaacagcaaagcaacaacgacaagtaagaagacagccgcaaaaaccagaagatctagataagagagacgacacgcaatcagcgggcgcagaagcaccagccagaggaaaagagaggcgcggaaggacagagaagcagacggagagaggggagaagacgcgacagccgcaacgcaaaggaagagaaaagcaagcaaatgagaagacgacgcgacgacgaaaccagacgaagcccaagcagagcaaccgaagacgcacgagaagcacgaggaggacaaagaaggcgaagataggcgccagacagaaaaaggagagaaggcaggacaggactaggagaggagaaagggagagagaaaagagagaagagcgacggacgaagacagacgcgca

SEQ ID NO: 653175 - DNA, 639 bp, Homo sapiens
  misc_feature (159)..(160): n is a, c, g, or t
ttcgtttttccaccccctggagataattcttgtgaaagccattagaggggcgtataataaaggggaagggttttctttttttagggagaaaggccttttttcttcttccgatatatatacaaaaaattaagcagtggtgaaaagtgccgtggttatccnnttttttgttaagtaagtgttggccaacaaaaacttccattggaagatgtggttaatttggaactggttagttttaaacgggttgtgggccaaaacttttaaaattagggtcccatattaccttatcctttccaaagtatatactcccaaaactgtgtatggcccgggtcccgtcctatctctgattgcagtttgtcttttatactcaaccaacctgtttactcgcttgggttgccgcccacggccttttgcctttactcctgggggcacatttcgatgtcattcggtctgccatctctttaataacaatgttccactctctcctcctttgtggtaaacgggttcacaaatcccgacatagattaagtttacatccttgccccatatgaataaaaaaaggagctgatgtgggacccccctcataccaggtggctgtgccctgttcatatatttgtggatgcatgtcaatttaggccaatg

SEQ ID NO: 653176 - DNA, 194 bp, Homo sapiens
tgctcgtcaatagcggctgcacttcgggatgtctgatccaacatcgaggtcgtataccctattgttgatatggactctagaataggattgcgccgttatcccttgggtaccttgttcccgttggtcacagttattgcgatcaattcgagtatatgtcgttcgctatttgatgacgcacggtgggggtactcgag

SEQ ID NO: 653177 - DNA, 3061 bp, Homo sapiens
aaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatatttgctttaaaatatatttggttatttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataataaaaaaaaaa

SEQ ID NO: 653178 - DNA, 2062 bp, Homo sapiens
ccagtggtgcaattactatttgctcaccaagaccctgctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatatttgctttaaaatatatttggttatttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataataaaaaaaaaa

SEQ ID NO: 653179 - DNA, 140 bp, Homo sapiens
  misc_feature (134)..(135): n is a, c, g, or t
  misc_feature (139)..(139): n is a, c, g, or t
gggagaggaggaggagtttttttccccggggcggggggagggggattttttttttttttgtggagggggggtggttgtgttgtgtgggtgggtgtgggagggggggcgaaaggggggtgtgggtgggggggggnngggng

SEQ ID NO: 653180 - DNA, 875 bp, Homo sapiens
tagacggtcccccctgacggtgctgacagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataataaaaaaaaaa

SEQ ID NO: 653181 - DNA, 103 bp, Homo sapiens
tcccaactcaggtgctgagctgagctcgagatgtgatgcgccacagcttacgcacaccgaggagcgtgctgttcgtgtgcggcgactgtggccaggcttcgtg

SEQ ID NO: 653182 - DNA, 989 bp, Homo sapiens
aaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtatttggtattaaatcctcattagaacaaccacctgtttcactaataacttacccctgatgatctatctaaacatatgcattttaagccttcaaatacaatgttgggccg

SEQ ID NO: 653183 - DNA, 876 bp, Homo sapiens
ttgtgaatgttctatattcaggagtaattacatgtaataaataatttctccatatgaagggaaaaacctcttctaagtagatttgttaaattacacaatagccactatcatcactgtactttatttcatttcctgtcactctagatttccagtactcataaagagcccaagcctctcctagaatttgaaaaatcaagttactgtaaaataaggcctcccaaggttgccacatttaaaatcggagatttcagtattaaatatttgtaggcctttgaagcagatgaaacacggtatttttgtttcagtagtattctcaggttgcctcaaatactgaaattaaatctattccctacaccatccatcttcaaacaccatccatcttcaaagtttgaactaatcatcagcaacttgaagatgttcagaaaaatgttaaaatgattataggtgttttagtgcatgaaggtcagtgtgatattctggaagcataaaataatgtattgaatgtttactctcttagaatatgtatgtctagagctaaagatatatgttacattcccgacattgtttcttgtgaatgtttaatttgatgaatttaaattctgagaataatagttttcagtttcaattaattcaagaactgtttctgggtaacttcctatacttcagctacatggcattgaaagaggtcagataatttccttcaaccataaggttttctatgataacagtattaaaaggcttaaattatagagaatgtatcctatgaaccccaaactaagaaattcaaaatcaataaaataatttcttcaggcaattcccaaatatttgaaaattacagattctgaaaaaatgcatagggcagagaaaaatatcccc

SEQ ID NO: 653184 - DNA, 948 bp, Homo sapiens
  misc_feature (948)..(948): n is a, c, g, or t
tataactgttaccttacctgtgtggtgtacaccacaacaaaatgacctagatgattgaagcccctcgcccctcagcagggatgaatgtgccttggttagacggcaggaggtagaggtggttgtgtctagaaggagctctaggagcttggcatcgtggcagcctgtggtcttcctcaaccctctggttcctggagtaagggcacatcatgatgctcatcatgaagtcttccaattatacgcgtcgatctgcctactttatagtaacgcctgctgtggggcacgcaaaggtgatcgagctcgaggagaagagcttcctaatcatagatggtcaccattcagatgcaagaagctccatgagccccgactgagtaaacctctgggggttgtacatacgtccactcgaattcgggtcagacactagtgcagtgccgtgggttaggtgtctcgatctcttaagtgcccctacgtggggtacgaggagcctgtgggtcgtagtcccagctctatttcaagggcccagggaacccattaggcccctggtagtctagtggcccatgcacagtctgtagcctgaggcccaggcgtgctgggacctgaaccttttccccctggctcctgttcacaggcgggattggactgtacacgaacgtcgctcagctgtgccggttgaaaaggcagcaactcactggccaaggaaggcgggcgaacggtaccccactggacacgggtacaagcacgctaggcgggaggggcacgccggaatccgactgggaagccgcgggggaactaggcacgcggcacgcggccaggggaaccctttctaaacaaacagccggggggcgcgcaccatgcacggcggaagcgccgcggggggacaacacccgcgggaggcgcgaaaaacagcgagcacacacggcggccgaaggggcacacaacacagcaacaaan

SEQ ID NO: 653185 - DNA, 281 bp, Homo sapiens
catcacggtcaatttagaccccggactttcgggaaataaaaggtgtaattaccttttactcggatcataatctcccaccggtctaagaggttatttattccttatttagagggcctctatggccaggtgccgggaattattatatgctcatcactttatgaagaataaaattggtctttccggccttaaagttacattcgttcttccgctcaaatccggatcgggtccattaaagagtgttcgcagacaaagtttcggaaagattagagaagaatcccccc

SEQ ID NO: 653186 - DNA, 208 bp, Homo sapiens
cggagactctctccatctctccgctagcatgaggaagagtccgggcacagagagatggagagagacctagttaggaaaaatatattcaggcggaagagatgtactagatttcacattatggcagttactaaagaagcacgtgaacatgacacatcaccttcacctttgggatatggaatttgataagcagttagcccaccagcaatat

SEQ ID NO: 653187 - DNA, 1262 bp, Homo sapiens
  misc_feature (264)..(264): n is a, c, g, or t
ggaccgatcgcggcaagtatgggaccggctccgcgccagctaactgtgattaccggggtcgcgggttcagtcattatacatgagatacttactactgtcgccatgtggcaaacagacattcactactacataggcaatcgacgcggatggtgcggacgcgtaggactctgtcagttgaatcccgcgagctggagacacgactccgtcaatcaaagagtagcgcgcgtaagtgtcgacagacatcatgaggttgatacactaaanttgcgagcatgagatgacccgatgtacatgaatggtcatcgtaccgatgccacagcgttggcgaaggcagggcagggacagaggaccgcaacatgcaacgaaggaccatatctaatcgattgcctaggactggtctccagtccgtctgggagtcatggtaggaattcactttgaagacgattcgcaattccatggatgaactagaggtgcaaacagtcgctgcaaaggccattttgggggaacctttctgcgccaacggtcttgctaccgaaaggcgtatcgagttggtacacacgtccatttacttagcaatcttgggggcactggacactttcaccaacgataacaaggggccccgtccgtttgggagtacgcctaagctaacaaggacacgtacgaaaacaccttggggtaaggataggcctagtgaagttgcttcgttgttcatactcagaggagtccctcgggggaaccagaactcatacgcacctttgtctacgcccccttatgcgctacctgcccacgtcgaagactttggactgaccggcacgcaaaggactgaatagacaggggtcccggcgcaaagtgaaccctgcagaggacccagctgaatagtgcctttgcaattgttcctccctaatttggccacttagcaccaattccccggtgtggaatgacagccattcccgggaaatgcacttgcttaaaagcacgcaggatctgggcccttggcgcagcccgggacaacagcaaaacgccgagccttgtaacagcccgaatgcccccaacactgaacacaccgcccgcacacaagcaccacccggccatgagccacacaagaatgacacagcacagcaaccccaaaccgggaaaccaccctccgctcacccgcaccgactcacgcacaaccgacgacgtgactggggagaaaagacatcacggtctacaatgtcacacacactgacaaacgtggccagaacgacccacaacaccacctg

SEQ ID NO: 653188 - DNA, 1007 bp, Homo sapiens
ggcgcacgcagggtggggggagggagcgcacgagtgcgcgcacctctcccctcgtccaccgtgccgcctcttcttctgccgttcctggtgctgttgtgtgctcgttgtgcggaccttggtacctctttgtgtgaagcggcagttggaggagactcgggcgctcgcattggccgaggaaaagcccaagggaagggagtcaaagaactggagaacagaccgaatcatattacctttggaacggtggcgggcgccagggatgcttcctgtggtgtgcaggttcaaacgaattagagaaggccatacaccccatttaagtaaccttaattgaacggccctattgtcgacccgacacgggacttttgtccacttggacggcgcaacggaatccaggtatccccgtatttggacgggggcaaagccaattccaattgaaacgagaacacaccttgcccggtcttggcacactgggcggattgcacggaattccaccttgttggttgtccccaacagcaagaacggagagggtggtccacctgcaagacggccacccttgttttttaacttccaagaaaatctgttcttaaaggcccaaggattacttctccaatttacgaaaacttgcattgggtcttccacccaacatcctgactactaccggtatagttcctctaattctgtcatttcccccctttccccattccttttgttgttccctagtagtggtttttgtgcaccagcttttgccttctttttttctaaccacaccgccactggttgtttggtctgccctccaggtggagcgggtggcgcccccgtttggttcttggtgaatcccccctttcccaggggcggcccttcggtcttttttttttcgcgagtttttgcttccggtttcccacaggaccaccctttaatcgttgcgtgccgggatcgcgttctcttgggaccgggtccattggcgggtcggggctgtgggtccccactcttgcggctttgtgaaaaagggc

SEQ ID NO: 653189 - DNA, 370 bp, Homo sapiens
gtcacagacctatagaatacacagtgagtatgttcgagatgtttatacacaacaaatccatatgtgagaagtaaaattctagctaaaaagagcaagaagattttaaagaaatttgatagaatttctagaaatgaaacatatactaataatatttaaagctcaatggactaaacagcagacgaatcatagttgaagaattggtgaattaaaggatagatctaaagaaattactcagaatttatcccagagatgggaaacaggaaagagaggttaggaggcatagcagaagacatctagcatcagtccagctgggggttctattaagaaggatcctgggaactaagggtgagcgacggtttatgaacgaaaa

SEQ ID NO: 653190 - DNA, 215 bp, Homo sapiens
cgaatcttctcaatgggataacggctgagctccagccaccccgcagtcactttctttgtatcaacttccactgttgccatcgcttacatgacacagtgtttataacgtgtacatacatcaacttattacctcatgtagttatttcccgaaacaaagccctgtggaagaaaatggaaaacttgaagaagcattaaagtcattctgttaagctgcga

SEQ ID NO: 653191 - DNA, 370 bp, Homo sapiens
cacgaatgtggaacatccggcacatgcgcgcagtcagctagtaacacttgcccttgttggagactgatcatgagcgacagcaaaaccttgcgacctatcatcgaagccgcccccttgaagcctcaacccacccagaacgtgcatggctgggagcgcatcggctcggtggccggcggggtaatgatggtgggtaaaggcttgcgccgcggcgggattttcggcttgatccaggtggcgattggtggcgtggcactggcccgtggctttacagggcacagttcgctcaaggacaaacttggaacaggggccgccagggaaagtgaacagcgttgcgccaccaaagattcggaaacggggatcgggttgacag

SEQ ID NO: 653192 - DNA, 371 bp, Homo sapiens
  misc_feature (22)..(22): n is a, c, g, or t
ttttcgggggggtgggggttcnttccttccttccttctatccttccttcccctcagcctctctgctttagtgaactttctcctagttttttgaagaagttcatcaattcaagcttttgtacatgggatttcctaaacctgaaatgtgcctcccgttttgtccaaacagacacgggctccactctgccccctggctcacacctgcttaacctgtcaagtcacatctgaactgtcactcttcagagggtccttctctggcaccctaatgtaattgagatcatcctattattctctgctctagaacttcccacttccgggatttctcattcctgcctaacctcttgtgtgtctggtttttggccatcgatttca

SEQ ID NO: 653193 - DNA, 920 bp, Homo sapiens
  misc_feature (1)..(1): n is a, c, g, or t
ngtcgaactcaagtaccgcggccttgtaaagccgtttacacatgcaagtgggaaaccgtgggggggaacggccccccaaggtccccagggcattttggccaccgcgggccaagacccaggggcaccccaacggtgtagggggggaacaaacaaggaacggatgtattcccggcccgtgaacaaatacacatccggccatgagggaaagtcgtaaccacccggggggtccaacacaaagcaacaaaccctggccaaggccccccgggtatacttcatcgcacccactgtgcaaaggccactttcatgcgcgctcgggccctttttgggacgacacatcaatctcggcgcgtcgcccaagaaccccgttagtagccgggcgagtcttccgccccctatgggttttgggcaataccgggggaagctttttactaggaggccccgtgttaaccgcggcatttgccccccgacgcactgtatctttcccccccggcgtgtcttccgttctgtttttaaagcccacttttgttacaaagtgcgggcaatcctcgctcccgtcaaaacaaggctttggtggtgaggcagcccttcctcttcagcttgtttttttattgaggcaccttcttcctcagtaatattgtccccgcaaatactccttggatgtgccttactcccccaccctcttccctccttaagacgctccccccaccctcctttacaccaggctataaaaaaatagactgacatttcgtgtgcattatactgcctgagattttctgtcacaatcatcatatctctttacatgcaaggtctgtattacatagaagtttctaaaatttctgtgttatccgccaccctcgatcaggggtgtcgttcacctagtcggcaaaaaaaaaataaccctcctcatcccacataacaca

SEQ ID NO: 653194 - DNA, 404 bp, Homo sapiens
ctgactctacaggatcccccggaggcgttgaatggccaattggatccaacagttgatacaacaagacgaggttttgtatttatcacctttaaagaagaagaacccgttaagatggttctggatgtaaaaagttccatactgtcagtggaagcaagtgtgagatccaggtgcgtcccagtccatagaagtctatcagcagcagcagtatggctctgggggccgtggaaatcgcaaccgagggaaccgaggcagtgtaggtcgtggttgaggtggagtgtcagagtcagagttggaatcagggctacggcaactactgtaaccagggctacgggtaccagcagggctaacgggcctggctattgcggctacgagtactcttcgctatggccattcaacgcctccgt

SEQ ID NO: 653195 - DNA, 198 bp, Homo sapiens
gggcctttaagctctcttatatcttatctctctcactcatgtatgcatacatgccagagatgcatacacaggtgcctatgcaagttcatttacgcctcagggctggtccctgcccaaagggtgtgaccctcctaatcctctcctaggtggcggggctggtcccttgacaccctttctccccttccgggctagacctta

SEQ ID NO: 653196 - DNA, 1175 bp, Homo sapiens
cacttggcttctgaaggcctatcaggagctgctggcaacagtgaatgagatggacttatctccagatgaggctgtgagggagagcagccgcatcatcaagaacaatattttctatgtgatggagtaccgagaactatatcctggaactattatcagaaagtttgatgagagatgccagcgcccgaatcgtattccattcgatgacctggctggagaccagaccacctcattcctcaaaatgtggagcgattctgtcggagccgatgggaacctggtggtgcagaaaaaacaaaagaaaagaaggaagacgaagacagaaggtcctagaccaggccatagtatctggtactgtcccatctagcccagaagaagaggaggcatgtgtggacaagcaccatggcatgagccaagcaacacgagcagtgaccccagaactactagagactcagcatggaactccgaaggaacacactatgactgcggacacagagcgagccaagtggcaccgcacacaaagcgagagacagcaagaccaatggacgaacggaaaaccaaagcactgaaaccatgacaaggacaaggcaccaacacgggacacaatgacaacatccatgacacggacaagcaacggaaacaagatcgagcgaccagacaggcacgaatgcagaaagcaaacaatcagagcacagatactctccaaaagggcacaaaagaaacacacgaaggatgacaccacaactcaaacactaggaacacgaaccacacgaaaacacaagcacaacaagaacccgcgagcaacgacagcaagacaaggcaagacacacacgagaaacgcagacatccacacaggcaacagcgacagcagaaaagaagaccagagagagagcaaaccagacgacgacaggaggagaacaaaagtacgacagagacaagagagcgacaaccagacacaaagaacaaagaagagcaaagcaacacacagaggcaaagaagaacaagaaagacagacaagaacaagacaaaaacaccgacagaacccaacaagcaaagaaggccgtaagcaaaccagaggagaggacagtgagcaagagacgacacgcggtagcagaagaaaatcaacagcaaacccaagccgaaaagacagtaggaccgacacgggcgcacggtgccggagg

SEQ ID NO: 653197 - DNA, 887 bp, Homo sapiens
cctcatgtctgtgctagctgtaggttcacggcccgactggtggaagatgtgtaaatgcggcgccaggtacaaagtatgctggcctgtgatggcaatgagattgacaccatgtttgtggaccgtcgggggacatgctgagcccctaggggacacgaagctggtgatctgctgtgaggggaatgcttgggttcctattgaagctgggctgcgtctccacgcccctggaatgcttggcatattcagtcctgggttggaatcatccgaggctttgttggataggcacgggggtgtcattcccgcacgaatgaggcttaaatgccatggatgtggtggatccagttatgccatctcagcgaactggtgcttccaggcacccaggaacgatcatctatctagcgactctgtgttacctatctgggcgtgtttcacttgacatagatggtgccatgcgcatgttccgtacctcagaatgattagtgtccattgatcctggtattgcctccttttgactggacctgtgtgccctttgggtcttgaagcgtcactgccagacagcatggaggggcctggttgaccatggaccggtgacggcagcagtctctattctaaacaagcgcgagactccacgctgtgtcaagataccatgggtaccttgtacttgccgtgatccgtgagaaccaatggaatgcagatcattagcactcgacgggttcctgatggaccatctatgtttcaactcggagggccatgatcctcctggttgaatgctccgtgacagcgatcggcatagcccgggttgatggcagaagcgagggtctttagcagtggtgaggcagtggttggaaggcctgctcgacagatcggaggaaagctcatttataatcgat

SEQ ID NO: 653198 - DNA, 575 bp, Homo sapiens
  misc_feature (239)..(239): n is a, c, g, or t
  misc_feature (320)..(320): n is a, c, g, or t
  misc_feature (336)..(336): n is a, c, g, or t
tgcatcaacgcgttgggagctctcatattgtcgacctgcaggcggcgcgaattcactagtgattgtgagctgagatcgcaccactgcactccagcctgggtgacagagtaagactctgtctttaaaacaaagcaaaacaaaaatctggagttggctagtcctggactagtatggccgaactatagtcatcagagacccagaatgccttcagcttgttgctctgccaccttaaatacatngtcccagcacctggtccaaaatgactgctcaagctccagtcatcacatccacgttccagccagtgggaagaggaaagggcnaaggagggaacctcanccttcacatggttagtcacgtgaccacactctatggcaaggaagcctggggcatgtgagctcttttcccatggaagaaagcagggtaagcgggagagggaacatccggcagtctcaccagggggtcacagctgccaagttagatctagttcagaaacagaatgtgcaaggcttgttgagtatggggaggaactcacacgcaagatccacgttcccagcccctgcaccgtccgtgacggg

SEQ ID NO: 653199 - DNA, 131 bp, Homo sapiens
ctagtgtggaagctgacgttatttccgtgaggtcatgacacatggaagtggaatcctagccactggctgcggagctctcgtgatgaatggccagagtgctgactgacatgcctgggtggaccagtgagctg

SEQ ID NO: 653200 - DNA, 320 bp, Homo sapiens
tgcatcaacgcgttgggagctctcatattgtcgacctgcaggcggcgcgaattcactagtgattgtgagctgagatcgcaccactgcactccagcctgggtgacagagcgaaactccatctcaaaaaaaaaaaaggtaagatggtgggattaagactagacttgcagtagtcatgatgattgtgactgggtaaattagcctataaaaagacagatgctcagatttgatttttttttttttttttttttttttttttttttctcctctctttattatttcgcacgcgcccccaaacccggattaaaaataaaaaaaagggc

SEQ ID NO: 653201 - DNA, 763 bp, Homo sapiens
  misc_feature (560)..(560): n is a, c, g, or t
gggggacttcaatactctactgacagcacaagacaggtcatcaagacaaaatgtcaacaaaaaaacaatgaatttaaactatatcttggaataaatggacttaacagatatatgcagaatatttcatccaacaactgcagaatacacattctattcaacagcacatggaactttctccaagatagaccatatgataggcaatgaaatgagcctcaataattttaagaaaattaaaattacatcaagcattcttttggaccacagtggaataaacatggaaattaactccaaaaggaaccttcaaaaccatgcaaatatatggaaattaaatagcctgctcctgaatgagcactgggtcaaaaaggaaatcaagatggaaatttaaaaaatcttcgaactgaatgacaataatgacacaacctatcaaaacctctgggatacagcaaaggtggtgctaaaaggaaagtgcatagccctaaacagctacatcaaaaagactgaaagagtacaaactgacattataatgtcacatatcaagcaactagagaaaccagaacaanacaaacgcaaccccagcagaaggaaggaaataactaagatcaaggcagaactaaatgaaattgaaacaaatgaagaacaaaaaaaaataaacaagatagatgaagaagctgtttctttgaaaagataaataaattgatagaccattatcaagattaacaagaaaggagagagaaatccaaatagctcacttagaaatgaaacg

SEQ ID NO: 653202 - DNA, 220 bp, Homo sapiens
cctttcatctcaataaagctgaaaaaaaaacctgggaagctctaaaaaaaaatgagccatcaagtcacaaaaagaacacggaggaacctaaaatgcatactgtaagttaaagaagtcaatctgaaaaggttacatggtgtatggttccaactatatgacattccagaaaaggcaaaactatgccgacagtaagtaacaagattagggtttcccgggtttg

SEQ ID NO: 653203 - DNA, 170 bp, Homo sapiens
ccgcttgtatcctggcacttggagctgaggaaggaggatgcttgaacccgggaggcggaagttgcagtgagctgagatcacgctactgcactccagcctgggcaatggaatgagactccatctcaaaaaaaaaattttttttttttacccataagtgaaaatgaaaagtt

SEQ ID NO: 653204 - DNA, 904 bp, Homo sapiens
gtcctttccaccttgcgccgctgcagaatggctcccgcatgagaagggtggcgagtaagaacactgggccgttctgccatctaactgaagatgagtaacccggaggaatacaccatcaacattcacaagcgcatccatgcgagtgtggctttcaaggaaggcgttgcaaccctcgggcaacgtcaagagagcattctgggataattcttgccaatgaaggatgatggcgagctctcacgatggtgtcgcagttgaacacccagagcatcagagcaaaacgctgtcatgggtccattcacggaattcagtgacagtgtagcacaataacacgaactccaggtgttgactgagactgttccatgaaacgagacgttcagctgagcgaatgaaacgaattcagccctaaagggtaacgctaatagtacattatggtatagcgcattatagtaaccgtggtataaccaacaattttcccagaaaatcatacaggaccatggtgcagactcgttgcgaatgtaagaaacattagatccggctgtagaatcgagtcaacagcttcaacaacatacaccacgtttgtatcaacataatcctgcggtaacaatgatcaggccacatggatatacaaaatggagcagaaaacatggagcaacaaacggagatgcttatccgatcagccgatcagcactaaccggagaacttgaacaagataacgtaaatattattcaagtacagacaccactgctgacttaggacgcgcaccgcgcggtgggtgcaccctacgctaacatgacacacagtagcacaggtcacaccatataacggctggcaccgacagaatacacattagaaaaacctgaccacaacaggtcgaagccagcacaagagtggaatcgcacaacac

SEQ ID NO: 653205 - DNA, 146 bp, Homo sapiens
attgcattccagcctgggtgacaagagcaaaaattctgtctcagaaaaaaataaaataaggaaagaaacttgaaaactaagaatttgggtgaatggcttgtggaagtgactggatccctagaatagccccagccatggcacttcag

SEQ ID NO: 653206 - DNA, 1338 bp, Homo sapiens
tggcaaaaaacaaaacaaacaatttttattttaatccaagaagttaatttcccgagggtgttgaaagaggaggcccacaagtttatgtgtgtgtttaaaaaaaacacaatattaacaccttcgtgctaaccccaaggtgcgtgctattatagagtgcaacacccacctttaagacacagacaaaagagagcactgtgaagcacacaccacactgtgaagagacacccgagcccccaccgcggagagcctctcgagagtatcagcgtgactatcacaagaaagccaaaccctctcccttctatctacagagcgaaaatctcgagcgtggaatctccccgatttgtgggagaaaacagcacagagtctccagctgtgtgtgtgtgtgtagagaagccacacgcagagaagagcgcgtgagagagagtgtgtgcgttgtctcaaaaagacgttctctactcagagacagagaaccctctcctctgtgtggcgcccccacagtatggtgtccacccgcagaacaacctctccaagcagtagaaggtggccactctatttgcagaccagaattgtggagcagaacaccagcgcagaacctgctgtgtatacctggtgaggagaatatctctcccccacagcacagaacacaacagcacacacacccgtgttggtgaggtattgatgtggtgggctcaactctccacttattagaaaagagttttcgtggccccaatctctcgacagacccacagccacaaaggggttatctataatataggaagcacgacgggaagattataatcttcctcgccgcatgattatcttacacaacgactagtagaaggaatagcaggatataatcatcattctccaggaggagtattcagccgcctacatataattaagggccgcctccaattgtagacatccaatatatagtgggaggatacatagcgcggcggcccagaagtataaatataatgttctccaccccaattcatcttcttgtaagacccacacacaacgactaataaaaaagaagacgtcgtcccccaagcggaggcaaaactagtgggggccgacacaccagggggcagaacaatctaagtgggagaggacacgccgccccacaccatacgcaaaggagtcataccgccaacatagaggcacaccgccccaaggtaggcgcctccttccagcggcaccggcgacgatatataacaaaagacacacaactagacgacaaataaaatacaacagcgattagaggggatgagagaaaacgcgggggtacgaaccacttctaagaggaccccgcccttgcgagagacaagaacaacc

SEQ ID NO: 653207 - DNA, 167 bp, Homo sapiens
  misc_feature (5)..(5): n is a, c, g, or t
  misc_feature (121)..(121): n is a, c, g, or t
  misc_feature (157)..(157): n is a, c, g, or t
ctgcngggaatcagctgacgctccgcattgcagctgcggagtcagacggcgctatgtacgccctctccctcctggccagcctcctggccgcggctctcgccggcccggtccttggcctganagactgccccaggggctcggcagtgtggtgccagantgtgacgacg

SEQ ID NO: 653208 - DNA, 761 bp, Homo sapiens
ggtgtggtgtgtttgtgttgtgtgtgtgtgcggtgtggggtcgtgcgggggttgctagccgctaaggaaatgttacttttgtagtaaggccgcctgacctgattcgccccgcgacttccatcgcaggatctaaacgtggtcaccttcgagtagagaggcccgccgccccccgtgggcagtgccccccgccgatgacacgcgctttttcacccaccccaccccagaccctgagaatttgcaacaggggaggaaaaagaacccggacttcccaggccctgctttttttcttaaaagtgactttaaaaaggagaatttgttgtgtatttttttatttaccaatttgatatttttgtgacataattgttagggtcagccctttttaatgatctcggatgacccaaccccgccttcggagcgttctctgtcctacttctgactttacttgtggtgtgacccatgttcaattataatctccaaggagaaaaaaaacccttgtaaaaaaagccaaaaatgaccaccaggaaaaacaatcttattccgagccattcccagtaacttttttgtgtatgtacttagctgtactataagtagttggtttgtatgagatggtttaacaaggcccaagataaaaggtttctttttttttccgtttttgtctatgaagattgctgtcttattttttttggcctgtttgatgtatgtgtgaaaccatgttgtcccaccataaaccggaattttattttgctgagttgttctaacca

SEQ ID NO: 653209 - DNA, 1650 bp, Homo sapiens
ctgtagttaagctaataatcaatgtgtgtggggggaggaattaagtcccccccccgccggtggttgttcgtgtggaggtataatgatggcgcgactgctttattataaaggtagtaaatatggtgtggtgggtgcaccacatatatttgttggtcagcaatcagagaggagaaatgttggctatgcacgcttggtcggtccgcctcctacctagtggtagggagcgctctcgcttgactacattaccctcgccacccttcttgttgtggtatgggataagtaagggggctgccgccccccccccgtcttgatatgttgcacacgcgggtgggtttgcatctacccgggcgctgactggtggggagggctcctcaatcctttctccccttcttctttgtagtattaatctgccgcggcggcgttcggtggtataataagtggccgccgtctcttcctctcgtctgcggtgattgtgtgttgcccccccccggttggttttctacatccccccagaggggccccctcgttgtggggctactgcaccctcccgtattatcaattcgaatgtgttgctatctgtcatcggcgacggtgggcggctggtttagtaggagcagtggggggcgccgccccaacaacaagaggaggcgactgcaacgacgaccaccacgacgagaggcgacgccacagtacgcgccacatgagagagatatgatataagccacgacaagagaagactactggttgtttgtgcggcatcacgcggcgcgccgccgcgagaggagagaagagaagaagacgcgggtccttggtggggcgcaacacaaagagaggtgagataacgtctctctccgctcgcgacgatgagagaagagacccccccccctgcgtggtctctctctctggtgcagcacccacagagagagtgtgatacacacacgcgggtctcgcccaccccccgctgctgcgggtgggagagagacacacacagcagagagagtagtacttcttcagcacgctgtgtgtgggtgtgtgagtgtggcgacacacacagcacacacagctgggagatctctccctctgcagagcgctgtggtgtgtgtttttgtgtgtgtccgcgcgccccactgctgtgtgtgtgtgttagaaagagggaggaggtctctcctctctctctcgccactgtatatacacacagagagagaaagcacacacacacacgtgtgagaacactgtgtatgagttccacacacgcgcagaataactctcgccaccacacctcgctgtgcgctctctctcacacacacacacgcggagatactctccgcgcaaaacacacacagaggcgcgctctgtgtgtgctataaacgtcgggtgtgagagaactgtcttcacgggcccacttccacacgaggcacaaataaccagtggagatatcccccctctcacctcggggggggcacaattgtcctcgggtgtctctcaaattgtttggggtgctcgtgattccccccacgtgcgagaaaaggccccaagggttaaaaaactttccccttaactggggttaaataacacccccttgagattttttgatacacaaaaaaatataattgaaaatataaaccaccaattttcccttcccaaaaaaaa

SEQ ID NO: 653210 - DNA, 111 bp, Homo sapiens
aggcaagctcctactctcagatgatctaaaagatcctatttaatttttacatgctccaccctccagttctatacaggcccactgggttggcaaggcaatgtttctactggc

SEQ ID NO: 653211 - DNA, 1455 bp, Homo sapiens
cgcggtagattactcctgtaatcccagcactccttgggagtgccaaggtgggcagatcatgaggtcaggagttcaagacaagcctggccaacatggtgaaacctcgtctctactaaaaatacaaaaattagctgggtgtggtggcgggcgcctgtaatcccagctactcgggaggctgaggcaggagaactgcttcaacccaggaggcggaggttgcagtgagccgagatcacacaactgcactccagcactgggtgacagagcaagactcatgctgtcttacgcaaaagcacagccaacgaaccaacaaacaaaaacacattcaaccacacccactggcaggcgaacaacggcccacggaaagcaccacaaacaccaacaaccgatatggtgcaccaccgggacccagaaagagacaagcgtcaacacactggcacacacagcctagaacccaagagcaacacccagtggacagatgactaagaagtgcaggacatcatacacacccactccaaacaacgtcgccgcgggtaacacaagaaacggtacatgcaaaacaaacaccacaaactgagacacccgcagcaccaacacaagggcaccacacacaaacagggaatagccaacaagaacgactcatacaacaaagccacgaaaccagggacaaccaaaacaacagaaaacacaaacaacgacacctgcacaagaagaaacaaagaacgagacagaaacaggcaaaaacactcgatacaagagcgcgaggacaaaacagcacaacgacaccacagcaacgacgcgctgaacgcgagcgaggagacgcgagacggagaggagggtaaggggtgagggagaagggacgtggaggagaacgaccggagaggagggggaggagaggatcagggcagcggcctcccgcaggcacgagggagggatgggaagatggaggacgaggggtgaggcaggggaaggaagaggcaagacgcgagatcgagcgagagggggaccagtggcgcgagcaagggagaagagagtcgaacagccgtacagagagacagagcacaagacggagcgagaacccgcgagccaggaggagcagcaagcgcagacagaaagaagacaagcaagaagaagcacacgaaacagaggggacgagacgcacccagcaaaaacaaagacggagaggagccaggaacgagcagcgagcagacaagaaccagacagaaccaggccgccagcgagacgatgaacgaaaaaaggaggcaagcgagagcagaaggaagcgcaagcgaaagagacgacagacaaagaaaatagggagcgcgagcagcgagcagacgcagtgcgaggagtcggggcaagcgaagcatgcggaagcgatggacaggacgaatgacgacgatcggaccgtcagcagaagaagaagcaaagaaagagtagtgcgagcaaggcacatcc

SEQ ID NO: 653212 - DNA, 231 bp, Homo sapiens
  misc_feature (128)..(128): n is a, c, g, or t
catacttggtcggactgtctatttctgaagcagggcctgagcatctcgtcccacagctcagtaccccctctaactggatgactcacagagttatatttccagcagagactctggctctggacaacaanccatatattccagcggccaacttgtaattccccttggatgcattgaacacacaacacgacacggccagagccaggccgtcctctcttctgcaaggaaaccacg

SEQ ID NO: 653213 - DNA, 331 bp, Homo sapiens
tacattaattaatgaattatatacatttacaggtcgtaatgcaaaccgcttcctactcaatagcaagtaacagcccacggttgttctggtccaatgacatcagctaagaaaggaaactgggtcctacggcttggactttccaacccttacagacccgcaagacaaaacagctggttcttgccagcctctagaggacgtcccagaacactctgccctgacacgctcataccctgcacagatcataggctgctggccactctgactcaccaagccacagacttgtcttccacaagcactttcttacctttgccattaagtgacctagccacac

SEQ ID NO: 653214 - DNA, 381 bp, Homo sapiens
aagatttttgaaggagaggaccttccggacccagatttgtgattctttggctgtggccccattggatgggattttaaaagcctttattgagccttggccaatttgttagcttcatagggatgggcctcctatctataaagcccctctatatgtggccccctaaatgggcactttttggccctaaaatccgtctttgaaaatggtaaattgagaaacccgtttacttaccttttatgggttgggcccttggatttctttctgccaaagatatttccttttcagcccagggccaaaggttttttaaaaggatatgtcttttttttttattccggtttgtttttaagcccctttttaaaggaggtttttcctttagttaaaggt

SEQ ID NO: 653215 - DNA, 475 bp, Homo sapiens
gccctgtagatcggttcctcactagtcagcaggttgccgtgtgcttttaatagaaaacctgctcatgcaccctcttgactcttgtcctgctttcttccttaaggggaacagttttctattctaatttattcatcctagtattgcgggtaatgtgtccttaggtgcaaggttcaagttccctccctggagaggaatgtcgaggattcgaatttacattctacagacctcatcccttttattttttcttactgtctccaaaatagtactgtgaaaggatatccttgaatgagttcttgttattggtcctgaatgaaaccccaagcttgatgtgttgggtcattggtttcataactgcagaaaaactcgatggttttggtggctgttagcactctacccctgttccctcacccagttcttagctagagatttaagagtgttatcacttggatacctgactggggagctggacggctgc

SEQ ID NO: 653216 - DNA, 620 bp, Homo sapiens
agtggtagaatgaactcacacggaaggttcaaatgagaatgtgtgtctagcagatgttcatttacaggctatgtgagatggtactggccgcacttgaaaaatcagtgttcctgcatttaattgttcaaccgttaaagttgatgggaggccattgttttggaccagtctcctgtactaggtcccagcagacctgggggtgtgtgtgtgtgtgtgtgtgtttgttgctctgtcacccaggctggagtgcagtggggtgatctcggctcactgcaacctccgtctcctgggttcaaggaattcatgtgcctcagcctcgtaagtagctgggactacaggcgcaggccaccacgcttggcaatttttttgtattttaagtagagatgaggtttcaccatgttggccaggctgatcccgaactcctgacctaaagtgatccacccgcctcggcctcccaaagtgctgggattacaagtatgagccaccgcgtctggcatgtcgtttcatttataagagacagggtctccctctgtttcccaggctggagggcagtggtgtgatctcagctcactgtagcctcaaactcgtgggctcaagcgatcctcccatctcaacctcccgaa

SEQ ID NO: 653217 - DNA, 141 bp, Homo sapiens
acacctggcactatccctccctgcccatgctgtgtatgctggtcatgctctagtctccgtgaggtgcacgctcccctcaccttatggctcctcccaagctctgccatcttgccattcctagtgtgggctgcctggggtgaa

SEQ ID NO: 653218 - DNA, 847 bp, Homo sapiens
  misc_feature (477)..(477): n is a, c, g, or t
ctccgttccgggggggggttttattatttatcaccacgaggcgtcttcttttgtggtggtgaccccctcctagtgtgctgctgttgtgggggaccgcccttactccttactcccttgggtgtgttgtgggcacctctcgctattattagtaggaccacccccggggggcgcgcgagtttctcatgcaccttctccgggagcattctttttatccttttgggctcgccgtggggggcgcgcgggggatatacacataagatctgtcgtcagcccaccgggcgaacacagcgccgtgattgtgcccccacttatgggcgcttatattttatagagggggacacacccagtatataggaacaaaaaggttgtgttccccaacaaataccaacagggcgttgggtgtaccccggtgctccgggaatttttcctcggggggtctacttccgccagagtttatagggttttggggcgcacaanacacgaaagaacaaaatgagagaacggtggggacaaacgccctgggggtttcactgggcacacgggagttttttaagctcctgcgttttccatgccacgcggtgtgttcctggccttattccacgggctttctgagttttgtgagcccaaaagaacagggggggtccccttccgttcccaacaggcccgggggcggcacaacctcctgggaaattgggagagggttgggtgcccccccacccagaggttcccccaaggcccttttggattcccggcctcagccctaatttggtttgggataagtggaacttcattttgaaaagaggggaatttgtccaggttccaaacccattaaatttgtagaggggga

SEQ ID NO: 653219 - DNA, 107 bp, Homo sapiens
tctctatatacgtctcatctccttaccgtcctcatatacccttacgtctggtattcttactggtatgtgagctgggcctaagccataaacatattttttattattat

SEQ ID NO: 653220 - DNA, 613 bp, Homo sapiens
tttctgatactttactttctgtcaaaaatcaatatgcagaatggcattgcaataaaaggtttcctaaaatggtcaaaaaaaaaaaaaaaaaagaaaaaaaaaaaaaaaaaaaaaagaacaaaaaaaaaaaaaaaaacaaaaaaaaaaaacacaaaaaaacaaacaaaaaaacaacaaaaaaacaacacacaggcgacgaagcaacacagaaaaacaaagacagaaggcgagtgtggcgggccggccccgcgcggggccgggggggggggtagtcccatagagcacctgtggtggcgggtgggcgggccggtccgccccgcaggccgggcgggcgaggaagacgcacgcaggctcagcggagagcagaagaggaagcggaagcgaaaaaacagcgcgggggggggtggcacctactctacatagaataccgagagcagagcggggggcggagcagcaagcccgggtgggcaggatacacaaaaccgagaggtaggacgagctggggacggaggcgacggtaggtggggtggataacaacaaacagcgcgccaccgcagggaggggggccaaaaaaaacaagaccgccgcgcgggggggggcggtgggaggagat

SEQ ID NO: 653221 - DNA, 866 bp, Homo sapiens
  misc_feature (263)..(264): n is a, c, g, or t
  misc_feature (334)..(334): n is a, c, g, or t
  misc_feature (780)..(780): n is a, c, g, or t
  misc_feature (800)..(800): n is a, c, g, or t
cagaaacataaactacatagaaaagacatgaaagccagccaggcttggcttcgaatcccagcactttggaaggctgtggcaggagggttgcttgatctcagaagcttgaaactagcctaggcaacatggtgagccctcatctctactgaaaatcagaaaaattacccgggtttggtggtgtgagcctgtagtcccaggaatcagtggatgaggccctaggatgtcataggcctgagaattccatgctgcagtgagctgtgatnntgccactgtactccagcctgggtgaaagagtgagatcctgtgcagaaacaaaagaagaaaaaaagagatntgaaagcctatatattgaagactaccaagtactgcttagagcagttaaagacctttggaatagaaaatgtttcttcttgcatttcaagattgcttttgttttggggggacacactattttttaggaatatgaagttcttcttaggcattcctgtaaaaaaggccacttcttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtacggcaccttcttgaacaaatttattcccaggcatattattcttacaagtgctattataaatgaaatcattgtgtcaattttcttctcagattgttcattgctaacacaactgattgtttnctgaaagtttgctgaattcncttaactctagtagtgtgtgtatgtgagtgtgtgtgtgtgtctggcctctgtgtgcatgtatgtgt

SEQ ID NO: 653222 - DNA, 131 bp, Homo sapiens
actcgaagtcaaatcagaaaaggatatgccccatcctactcccccatcctccatcccactcagattctatcccaagtcaggcactggacacctgctgaaaaggctgatgaggggctagacaggagtggggc

SEQ ID NO: 653223 - DNA, 214 bp, Homo sapiens
  misc_feature (3)..(3): n is a, c, g, or t
  misc_feature (7)..(7): n is a, c, g, or t
ggncggngcgaatagatcacttgaggtcaggagttcaagactagcctggccaatatggtgaaacaccatctctactaaaaatacaaagattagctgggcatggtggcatgcgcctgtaatctcagctgttctggaggctgaggcagcagaatcgcttgaacccaggaggcagaggttgcagtccccagcccggcccggccccagcccggcccgg

SEQ ID NO: 653224 - DNA, 723 bp, Homo sapiens
gaccccaggggggggggggagaaaaagaaaactctggcgttagaggatatagaaaaatataagtacaatggttacaaataacgcagaacttcaaaaacaaaaaaatcacaacccaaacaaaccaaaatttaaatgatcagaatgggcagcacaaagaaaacgccctctcctgacttgtattgggggcagtctgaacgcccccagaaaattgtgccaaagagtttagaaaaataaattttcaataaaaggtaaaacattacacacaaaacggcaaacttcaggtaactatttggagattgcaaacaggataaattaaatggttcaaacaatctgataaaataaccattgggaaactggtgggccttctggtgcttatattggattggactacaagtggggaatgggagctctgtggctgcacttcaaaagcaaccaacaaaacaaaaacaaaaaaaaagtgtgtgtgtgtgaattacccaaaagactaactagaaagtctgtgggatgaaaatggcacttggaaaaggggtaaaatttttccactgaacgttgaaggttaataaaagggtgtaaaaagttcccgggtcaaacacgtggaaatatacagttaaaaaagggtgaagtggaatgataaccattaaaatcagaattaagtaattgcgcgcttatacacagaagacagggaatcacgaaattaagaagctttcagatagaaaggaagtg

SEQ ID NO: 653225 - DNA, 858 bp, Homo sapiens
agcggggaccgtcgggcggaacccagcctcggcgatctgtcaatgtcatgtcgccccagtgggcaggtccccctttcgggaggaagttagggaaggggatttctcataaatcacctagccgcgcgttccttctagctcccttccttagcagccgcgtaggctcaggtaggagggcccgcgagcagagtcaatcatgatcgtcgacaccccggggcagcaggctaggggataccaggacgagacaaaggaggacaccagcgagtgggaatgacggagtaggcagcaacgaaagccaaaggcatatgaaagacaagatcgcgatgaacagaagactcaagaacccaggagggaagagtgaggagccacggaaggcctgcgtaaggagtggacgccacgatataagacaccacacacagactaagggggacgaatggcaggagacgagcacagatgggacacgtgcggaggacaggaacgcagccgagggaacaacgcattgacacgggagaggcaagggaccattggaggggccaataagtaggaaataggcgcacaaagcaagggggaacaacccaatgcaagccgaacccattggcccttttggcgggacatggagagttcacaccgagagacgagattcccccacaaagaccacataacgagggtcgagaaaacgcccgcaagcaggcgcaaaagtacatccaaaggttgagtcggcgagagacaaggacagggaaactatcgggggaaccacacaataggatagtagcggagaaaaataggccgcaggaggaaccagaatcacacaggccacatgaaccagagaaaagccaacgagcagaggccaacagagcacag

SEQ ID NO: 653226 - DNA, 662 bp, Homo sapiens
  misc_feature (74)..(74): n is a, c, g, or t
  misc_feature (651)..(651): n is a, c, g, or t
gctggggcagaggcatcataagttaaaatcataactttcattttataaaaaatagtttgaataattgttttatnaatctttaagtgcttacaaagagcaggaaatacatttaaaatagtctttttaacacagattcatttgtacaatgtggtcataacatatgtccggaaattgacatttcagtagtctatattcttttctcagcaaattccacataaaatttaactaatttacaattcaaaataagattttaactgccaacaatgtcagactagttgtggttagtacctgaatatcaagctcttctccattttatatattgtaccaaaattttaaatacagctcagcagtgataggtactaataacaatacctgactacatggttaccacccgtgactactgcattgcagcttaaaacatgctttggtcagtaaatttaaaagatatacatcaaataacaaggccagaaaagttgttttagaatttcctgaccttaagtaaactttaaatacattgacaaggcaaaaaaaaatatgatcaaatatacagaaaggtttctattttttcaaccatttggcattttatattattcatttcgctgtttaaaataatattttatactcctgtgcactgattatcattgctctccngaataaaacta

SEQ ID NO: 653227 - DNA, 330 bp, Homo sapiens
  misc_feature (74)..(74): n is a, c, g, or t
tgctgggcggcctgtgcgtggtgcggcgcagcgcctcgtaacgccgtggcgtggcggcgctgcgaggaccccantgcctgacgctggtggggccggccgctgggcgggcgccgctgtggccgccagcctgctctgcgcgctgcgcgtgggcctctacatggggcagctggagctgcacgtggacctggtgcccgaggacgacgcgccgcctccgcggaacgccccgactgagcgggtcggccgccaccccagtgcgcgatcacgcgcggcgcctcggccggtgcacagcgcccgagcactgggacctcaacctcgaccccccctcctccc

SEQ ID NO: 653228 - DNA, 115 bp, Homo sapiens
tctatatttacatatgaacagcctgagagccgaggacacggccatttattactgtgcgactccctttggagaggtcgatttctggggccggggaaccctggtcaccgtctcgacg

SEQ ID NO: 653229 - DNA, 453 bp, Homo sapiens
  misc_feature (444)..(444): n is a, c, g, or t
aaggctaccatcaccgcagctgagatcaagcaagaagatgtatataagacttggctcagggcataccttatgcaaggagcggcaagacatgatcaagaacgaagtgccttccactgaatatgacctatctgaccaagagcatcaaccctctgggtggcgtttgtccactgatggtgaagtgaccaatgactcttgtcatgctgaaaggctgtgtggtgggaaccaagaagcggggctcaccctccgcaagtccttgctggtgcagacgaagcggcgggctctggagaagactgaccttaagttcagttgacaccacctccaagtgtggccatggccgcttccagaccatggaggagaagaagcattcatggaccactgaagcaagaccgaatgcaaagaagacgagctactgccagacaacataactggggttccatagcctgnttgtcctca

SEQ ID NO: 653230 - DNA, 311 bp, Homo sapiens
tactgggattcgcaggcatgtcccaccatgctcagaataatatttacttttaatcatgactaagatagtggttactacttgagtatgctatggctccagactgaatagtagagcccagtgcagtcatatcagcgcgtaaacattatgctgttatgcttaaaaatatgcgtggacctgggccttacacgatagttacaaagtctcactaaggatgtctcgaggtagctgtattaggttactgttgcagtactgcatatgaagaagatacgtggaaagctgggtacatttatataagaaaaatgaggtttaag

SEQ ID NO: 653231 - DNA, 342 bp, Homo sapiens
gatgccttgaagctggtatctgatatcaccactggattgtacaactcgtagctgatttcgacctgctattgaagttaactgattccccttggctatttgtttaataccccgtacatatctttgagcttcaaccattaattacgtgtggcttggtcacttcgtggctaaggtaagcaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtcca

SEQ ID NO: 653232 - DNA, 600 bp, Homo sapiens
agacaagataacccttgtaattgtggtgtatacagtggtgcaactgggctgtgtggtgtagacagcgctgcagctaggctgtgtggtgtacactagagttcagctggactgttgtatgtcgacagagtatcacatggtctctgtggtgtttacagtggagcactggactgtgaggtgtctacagcttaaaccactggtcggcgtggtgtagaaacgggtgcagataacctatgcggtgcatacagaggagcaccaggcctgcgtggtgtaaacagacccaggttcggctggtctctgttggagaagcaactgatcttaagctatgtttattgttgcaataggcctaaatattgacagtgtgacgatgtgctgaataatgttgggcagatatataacaaccgcattgatcggggctatcttagcatgcgataaagggaagtgctttccattccaattatcattggctacaacgatgactttgcataaggatatgtcacatttagtattttgttgaaccaccctggagaatggagtttgtagtgggccccttataccttaagtgacccaagggaggatacccccgtaattccccggggttgg

SEQ ID NO: 653233 - DNA, 346 bp, Homo sapiens
caactctgaccgataccgggagtgaggcgaagcacacgctgacgaggatcggcggccggtgagggggaagcacgtctgtgctctctgtgcagttgaagcaagtcggctctggcgctccacgtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggca

SEQ ID NO: 653234 - DNA, 417 bp, Homo sapiens
  misc_feature (70)..(70): n is a, c, g, or t
  misc_feature (73)..(73): n is a, c, g, or t
  misc_feature (111)..(111): n is a, c, g, or t
accatacaggaatataatgtcaggcatgcttcttctatagtagcgggtataactctcaaacggatttagnatntcatcaaattctcttcagcatcaactgaaataatcatntggtttttatccttccttctattgacatgatgtctctggctccttgtggtgtgtatgatgtatcagacattcatccatgttatagcacatattagtactttgttatttagtatggtttcattttatagtattctattgtatggctatatcacaattaatttatccattcaccttctgatggacatatgagattctttcctgtttggattatcataaatgccgacgacagaggatcttcttccatccacctgctgatgtaccattcgtattcttgcccgtcggtatatcacataaatgccgactaag

SEQ ID NO: 653235 - DNA, 335 bp, Homo sapiens
gcgcttccacggagctgccttttttttgtggtgtacctcgcaccttcacgaggctgggtaggctccactacccagcaatagcgggctctccgctccatgtgtggataagccaggggtattagaaagggagtggtccacggtcctacaccagcttgcagcttgccggccatattaccttgggcacaccatacccccagctcagggcctggcttcttcagtaaaataaataggactggacttgatcagtctcttaacagccatcagaagccacggtcaacccacaagccacggtcaaaccacaagccacggtcatcccacaagccacgtacacccac

SEQ ID NO: 653236 - DNA, 317 bp, Homo sapiens
  misc_feature (156)..(156): n is a, c, g, or t
  misc_feature (191)..(191): n is a, c, g, or t
  misc_feature (226)..(226): n is a, c, g, or t
  misc_feature (232)..(232): n is a, c, g, or t
cagtttggtgggtcagaaatttgatagcatcttggcccagccgtggtggctcatgcctttaatcccggcacactgggaggctgaggcaggcagatcacttgaggccggggagttccagaccagcctggctgacatggcgaaaacctgtctctactnaaaatacaaaaattagccaggcatgatggcacgtncttgtagtcccagctacttgggaggctgaggcatnagaatnacttgagcccaagaggcagaggttgcagtgagctgagatcatgccactgcactccagtctgggggacagagtgagactctgtctc

SEQ ID NO: 653237 - DNA, 689 bp, Homo sapiens
cacgggttgtctgcgtagagggggcaggcggaggcttgaggaaaccgcagatacgtttctctctttgagagatagagatgtagtacacagtacttaacaaaatatagtcaataggttacttgaagtagtatgcttagacgatgaagtatgtaagcgtaacttgtaatgagcttagagatttccacacgtagaagatatatgaacgacttagaaagactagtcatgaggcaaggataatggatacaaaggttgctaaagaacatgatgcgagggtgtgatatgaaacgttctatcaaggtgtaaaaaatgtgtgtcaacgaaatgtgagaggaaggattacagagtcccctgaataatatgcagatagaagaggccatgcttttaagattacgatgatggtgacttatacagcttgaagtgtagtgttcacacagtgtgaggtgattacgactaggtttggaaggcgactcttttacacaggagatcaaccgcgaaggtgattcacagaccttgagaatccatgtaggcaggggagaattggcgtcattgaaaggctagttaacggcatttactaagacgcgcagagatggcctggttagtgggagtggtcggatgcagacaattggccgaagataaaagtgaggtggcaaccttgggcaaccgaagttcggaggctaaaaaggattcaa

SEQ ID NO: 653238 - DNA, 839 bp, Homo sapiens
  misc_feature (663)..(663): n is a, c, g, or t
  misc_feature (676)..(676): n is a, c, g, or t
aatcctcctcatgtccgactcagtatccaaagaacagacaccttgggatgctataaaattgatttgtgaagcaatgaggaccaagccatatgtccttctatgttcgagcccgacaaagggtcaagactttgctcagtggtctcttggcaatggcatgcccagtcacaaagtaataggaggagactacttggtctgcttgactccctatggactgcccaggcctctgccatggtcggttctggcattactaaggtggcagagttttcaggaaggaacgatgctgtataggttaggtgtgtcgaccgtgggcgcttctggctgcccctacgttatcttgtgctggtgggacaggacacagcagatcccctcgagttggggcatgctctgcacaggtagacatagttgtcccgaggattggggacggtttgcccctcgtggccgtggagtgtggtgcgccctgacggagtcgtcgttctggtactgtgttaatgtctctgattggcagtgaggctcgtagaggtacgactgcccgctaggtgggcagctgactcgcgattggtgaccccaatgggcgttttcgtccaccctaatagttagcggtggcattggtttgtaggtaacacttgctaacaagttccccacactggcgacactagtttaagntagacatcaactntaattgatttcccaaacaagagaagacgctctatcccctgcgggactttgaaacgggcgctctaatatccgaaggagccccacaagccataccttaattaacaacgggcggttttgtcaagtccctcgaatggggccatgcccatgttggccattgccaattg

SEQ ID NO: 653239 - DNA, 811 bp, Homo sapiens
  misc_feature (3)..(3): n is a, c, g, or t
  misc_feature (73)..(73): n is a, c, g, or t
  misc_feature (76)..(76): n is a, c, g, or t
  misc_feature (87)..(87): n is a, c, g, or t
  misc_feature (105)..(105): n is a, c, g, or t
  misc_feature (129)..(129): n is a, c, g, or t
  misc_feature (133)..(133): n is a, c, g, or t
  misc_feature (136)..(137): n is a, c, g, or t
  misc_feature (185)..(185): n is a, c, g, or t
  misc_feature (193)..(193): n is a, c, g, or t
  misc_feature (202)..(202): n is a, c, g, or t
  misc_feature (208)..(208): n is a, c, g, or t
  misc_feature (217)..(217): n is a, c, g, or t
  misc_feature (219)..(219): n is a, c, g, or t
  misc_feature (258)..(258): n is a, c, g, or t
  misc_feature (263)..(263): n is a, c, g, or t
  misc_feature (273)..(273): n is a, c, g, or t
  misc_feature (277)..(277): n is a, c, g, or t
  misc_feature (291)..(291): n is a, c, g, or t
  misc_feature (308)..(308): n is a, c, g, or t
  misc_feature (310)..(310): n is a, c, g, or t
  misc_feature (335)..(335): n is a, c, g, or t
  misc_feature (377)..(377): n is a, c, g, or t
  misc_feature (379)..(379): n is a, c, g, or t
  misc_feature (399)..(399): n is a, c, g, or t
  misc_feature (401)..(401): n is a, c, g, or t
  misc_feature (403)..(403): n is a, c, g, or t
  misc_feature (410)..(410): n is a, c, g, or t
  misc_feature (426)..(426): n is a, c, g, or t
  misc_feature (430)..(430): n is a, c, g, or t
  misc_feature (436)..(437): n is a, c, g, or t
  misc_feature (485)..(485): n is a, c, g, or t
  misc_feature (500)..(500): n is a, c, g, or t
  misc_feature (506)..(506): n is a, c, g, or t
  misc_feature (544)..(544): n is a, c, g, or t
  misc_feature (550)..(550): n is a, c, g, or t
  misc_feature (651)..(651): n is a, c, g, or t
  misc_feature (790)..(790): n is a, c, g, or t
tcnggccatcaggagaccaggccagggaggtgcactggggtggttctgccttgctgctggtactgataacttnttncttcagttcanctacaatgatctttcccnctgaatcccagatcttgatgctgngggntgnngcagcacacagccagtagcggttagggctgaagcacagggcgttgatnatgtcccnaccatctancgtgtnaaggtgttngncttcgttgagatcccataacatggcctggccatccttgnctccngaagcacagngggntccatctggagtgncagtcaccgtgttcagntngcctgtgtggccaatgtggttggtnttcagcttgcagttagtcaggttccataccttgtccagcttntnccagccacaggtgacgatgntngngttgctnctgttgggcgagttgngganacaagnnacccactctgagtggctctcatcctggacagtgtatttgctcacaccnagggtattccatagnttgttngttttatctctagatccagagacaatctgccggttgtnagaggngaaggccacactcagcacatccttggtatggcccacaaatcgcctcgtggtggtgcccgttgtgagatcccagaggcgcagggttccatcccaggatcctnagagggcaaactggccatctgaggagataaccacatcactaacaaagtgggagtgaccccgcagagcacgctgtggaattccatagttggtctcatccctggtcagtttccacatgatgatggtcttatctcgagaggnggagaggatcatgtccgggaa

SEQ ID NO: 653240 - DNA, 137 bp, Homo sapiens
gaactggtctccaaaaaacgtcacttggtacttagacggcggcaatcaagatgggaagtaaaaagaaaatatcccctaagtcaggatcagattctatcatgcctggccaccagtggtaacctgtatggctcagcgct

SEQ ID NO: 653241 - DNA, 232 bp, Homo sapiens
  misc_feature (15)..(15): n is a, c, g, or t
  misc_feature (41)..(41): n is a, c, g, or t
  misc_feature (51)..(51): n is a, c, g, or t
  misc_feature (78)..(78): n is a, c, g, or t
  misc_feature (149)..(149): n is a, c, g, or t
  misc_feature (186)..(186): n is a, c, g, or t
ccttctacttcgganacagctacaccgggtcgagcagggantcgagctganaacttcggggctcagcaccctctcctnaccttcgggtccacctcggcccagttcgacatgcccgcctcccttagatgagtggccccaccgcactgctnacccgggtcagccagcttgtgtgcggcctggcagggnagaagttacagctataactcagctccccgcacgccgcaagcctccc

SEQ ID NO: 653242 - DNA, 112 bp, Homo sapiens
tcaaacacgcatcttttggattggactagctgagcaggtgctgggtcactgtggctcccagatgccacacgggagctctggcaaagctgtcacatggtctgtggctcagcta

SEQ ID NO: 653243 - DNA, 179 bp, Homo sapiens
cctgttgctaggctggagtggacgtggcgtgatcttggttactgcagcctttgctccccggctcgagcagtcctgcctcagcctccggagtagctgggaccacaggttcatgccaccatggccagccaacttttgcatgttttgtagagatggggtctcacagtgttgcccaggttgca

SEQ ID NO: 653244 - DNA, 137 bp, Homo sapiens
gactagaggatccctcattccagttggtgcagctatcttcacccgctccgcttgtcttcttaatcacatcttttaaccctgtcagctcagtggaagcttcagctgtgggtgcccagatcttcacatcatggtctagg

SEQ ID NO: 653245 - DNA, 671 bp, Homo sapiens
atgcctctgatagagacttccaacctgtatatctcgaaatcctgccaaggttagtttgaagacgctcgtgtggtcacaaatacctggaccgtttctgtgtgcacatgattgaaagccgtattctatgagagaattttcatgatctgggtagggggatggattagtggtgtagctctataatccctagtatattgtgtaaagcgctgtgcaattagtaatctgtatgtacatgagagcgtgaggaggtaggagatgtgcctggaatagcaggatgaggaatatgagattggggaaggaagtagaagacatcgggcccagattgaaagatgaagaagaaggattgtgaaaaggaagactcaatggaaattccgtgcacttggttttaactggttgttactgattgttgactttgcgtcggaagatatcgggtacagcaatgtcgtattgacacgtatactagaaggctgttgaagaggtattagcgttgaagacttcagagtgctggataggactatgagtacgactttggaatttgaatatgagtaatcgtgatattttttacacatgaaggtgttgacacgtacgttctggatgaggttgaatagatgaatttgaaccttatgatatgagggaggcaaattatgggttgtaagggtgcagatgggtggaaa

SEQ ID NO: 653246 - DNA, 175 bp, Homo sapiens
aggcatcagtaggctgtcttgggctcccgaacagtatcatggcttatccacagctgacgatcgtggatgctctccttgtcctggatttgagagggataaaggagacaaggctattagtcttcgatgagctgcctagcttctcattgagctggtggtagtggcggaagaaagggtc

SEQ ID NO: 653247 - DNA, 293 bp, Homo sapiens
  misc_feature (13)..(13): n is a, c, g, or t
  misc_feature (57)..(57): n is a, c, g, or t
  misc_feature (91)..(91): n is a, c, g, or t
  misc_feature (192)..(192): n is a, c, g, or t
  misc_feature (219)..(219): n is a, c, g, or t
  misc_feature (259)..(259): n is a, c, g, or t
  misc_feature (283)..(283): n is a, c, g, or t
agtaataccatgnaagtaatacctatgtcccccccgaactgttttacctcctgaagntccctgcctacttttgcctgagagagcctaaggnccccatcacagacaaaatcccctattacaagataactcgactaccccattttcaacagagaggaagatagtggtggtattccctagaattctaattgcaanagaggcatttttctggccgagtgtggntgtcacgcctgtaatcccagcactttgggaggctaaaagnaaacttgaggccgggagtttgagnccaacctggg

SEQ ID NO: 653248 - DNA, 957 bp, Homo sapiens
gcgccagcaaccatgtccaagggagcatgcagtaggtattgatcttggcaccacctactcttgtgtgggtgttttccacgcacggacaaatgtctgagtataacttgctcacatgattcaggggataaccgtaaccgactccaagactagtgtcgaccgtttatcggtacacctgaagcgtgatgactcgcgtgactgcctgcagtacgacatcaagattgcagatgtaacctccatcgaacacagatttttcgatgccaatacgtctgagttggatcgcacgagttcgagtgactgctgattgctccagctcttgatactgaagcacattgagcccgtttactggctgagtgacactgactagctggacagtgccccagaggatccacacggtagaagtaccaaggcgagaagagccgaagaagccttcagtatccgagaggcaggatgatcattctattggcttcgtgaccaagaggatgcaaggatcacattcgcagacatgccatacctatgggcaacgacatgtataccaaagtgctgatggatcagcagtgaccaggcattagcttgtcacacatgaactcatcaagacgtacagtggctacccaggagaattgcttggaacactaattgcctggatcatcaagtgtacgttagaccgttcattacgttgacgcccaaacttggctgcttgactacttggactatacgcgcattcagaccgaaacaaaggctatggcaagacagtcaacacgaaacacgatgcgtcaatcatattgaacccttggcgaaggataggaccacattattagactgatgctcaagtcacattcacctacattgcgcggaattgcgaaaatccttatgagagaggttcaatagagtcttaccaggcattggaaggaacaagccccacatttgcggactggcgacagacccgacatttaggcacaa

SEQ ID NO: 653249 - DNA, 223 bp, Homo sapiens
  misc_feature (183)..(183): n is a, c, g, or t
gagctggtaccccaccgcaccggtgcgaggacatggtctgatcagctggaacggtccagcgccgtgtcgcggccgggttggcgcgcacggtcagcgaggtggcgcccggctgccattgcaggaccttgcgggcgccgtcctgcgccgccagggtgaccgaatgctgcgcggtgaacaccaggncgtacgtcaggatcgcgtagaacaccaggaaaaacaccac

SEQ ID NO: 653250 - DNA, 796 bp, Homo sapiens
  misc_feature (39)..(39): n is a, c, g, or t
  misc_feature (263)..(263): n is a, c, g, or t
cctcgtgttctgcccgccttggcctcccaaatttctggnattacaggtgtgagccaccatgcctggcgccatatagattttatcaatacaaaatacaggatattttgacaggccactttatttagaattggaaacaaaagtttccaaattgtttgaatgtgctaaatgcttttagctttatttttctagtctgaacctttccagtagcctttcagtaagatgtaaatattgaaattaaatgtaatatttactgtggtatatanaaccagaaactccagaactacttgtgttagtcatgaaatcactggcctagagtttggtagcttctaacttctattgccagtactgctaaatcttctttttttttctttttctttttttttgtgagtcatttggtgaggctcttgatcagtaattttcatcttcagtttgtagatatcttaagtctcaggtgtgcaattagttatacttgaattataaatttaaggattgacggaaaaaatcacccactgccaagctgttactgccctgaatcaggggttttcctggaacaaaaaactactagacataaaaacaccgcgaaggccttttcctttaaaacccttggggttaaaggctgcgctctttccccggtcccactttaccaaattcaataggctcagctttcttcaagtgcgcgggttagtaccctggcgccccaaatgtattttagacggggcttatattttgggcgttttcccagcggagggaacaacggggggatacccaaacaaaagggttcccccattgtggacga

SEQ ID NO: 653251 - DNA, 474 bp, Homo sapiens
ttctagaggatccctgtcatttactccatgggcggaatgcaatgaattggaacggaacggactcgaatggaatggagtgtcatggaatggcatcaaatggaatggcatcaaatggaatggagatcgaatgcaatggaatgctatggaatggaatggaatgcattggaatggaatgtcctctaatggaatggattcgagtggaatggaatcgaatataatggagtcgaatgaaatggaattgaaaggaatgggatcgaatacaatgcaatatactggaatgtaatgtaatgaactcgaatgtaattgactggaatggaatgtacatgaatggaatgtaatcgaatggaaagtaatccaatggaatagaatctaatgcaataaaatcgactcagatagagtagaatgtaatggaatggagtgcagtgccatggaatggaatggaatggaatggaatggaatggaatggaatgcaat

SEQ ID NO: 653252 - DNA, 896 bp, Homo sapiens
taagtaaaatcttttttatccaaaaaaaaaaaacccccaaaaaccaaaattttcccacccccacccgggagggatttggttagggggaggtgtctgcccacccaccctcgggcccccaccccttgtgttttgggcaccaatagggggtttggggtattggcccaaaaattaaaagtggtctgtgtgtgtgttttggggaaggaatggggtgcaaagactggtggggaagcggttgatggggagagggacagcacgaggtcataccgggcacccccgagggggggaggccattccatacctatttccttgttggctcaacccccgcgtggaccaccttctgtgcccatcacccaggacctaccgtctggctcgcctgggtgacagtcaccatttggagggtgggtgcccccccgcgtgtgctctggtgtccggaaatatccctgggctcaaattccccctctcttccagcctgttgatccccgggtatcaccgcacattttctggcccccgagtgtcagccccattccctgtaaaatctgccgcggtcttggccacccaggacccccacctcacgtggcgtgttgttgaccactcgttccccgggtactggggccccccagggtggggggaattccccgaagtcttagaaaaagaggaagccgaattggggatacccgggggctgggggcccacttcgggtggcacccaactcttgtagccggcgttgttttatgccccaaaaaaaaaaaggcgggtatgcaggggattgacagacccgtagtctttgagggtgaccttccgttagaagttgctataagagccaacacggtgttgttgcaaggcccaagaaacctttgtgcaggccccgaagtgcacacaaaacagcaaattgatca

SEQ ID NO: 653253 - DNA, 141 bp, Homo sapiens
ctgactctagcaggatccttagaacggagctggaactacaggcgcatgcactacatctgactaatattttattgtttacagagacaaggtctcactatgttgccaggatgatgttgaactcctggggctcaaagtgatcct

SEQ ID NO: 653254 - DNA, 186 bp, Homo sapiens
caaaatcatttggtatgttaacctaaagtacgtgggaacccatacattaaatcctaaaagtctcagctaaaagcgcaaatatctagttacatatttattaataataactaacttttattgagccctttataaatgccctatactggtctgtgtactttgcgtgtcttactcaactcatttattcaa

SEQ ID NO: 653255 - DNA, 1655 bp, Homo sapiens
  misc_feature (218)..(218): n is a, c, g, or t
gcttactgcgcccacctaggctgttgttggttacgcactagtcgaccatcgttctcacctgaggggctgcattcgatagcatgttgcatgcattactcgctatctgacccgaggcatcactgccctatacggagctggcctcccgtggtagtcgactagtatcatgctcgcggtgaagatcgctctgaatcccaacgactatctcgacttccatgccnagtagtagaccgaggtgcaacacagccgagacctgggggagatcgcgcatatgacacactgggtgaccatcggtgctaggagagatgagagcgacctcaccctccggcctctaggacttgcggcatatcactcctccatagcgctagtcaggagatagagaggagcttgggcgtcaaagagcgagtggtcgctatgcaggaacgagaggccatgcgtcgaaagcgctctgcctaggcaagagaggtagaacgcactgacgcacgtggaagtcgcactctaaccccgtcgatctctacacccctcgttggccacgtagaagacgtcgcttcaccccctttgccagcccggcaagggaactcatctaccgtttaccatcgagtggcgcctcttcgaatcaccccctaggacaccaggcagggtggggggtacgcttctacaactaccccgaacttgtgctctgaccctatgcctgttgcacctaggccccctcggtaagaagcactccttgggcacgctcgggggttatacctattactttgtctcaaggccacgtcagggcagaatagcgcattcggggaactgggacccccggtcgataggggaaccacaagcggcgttccccttcttcctacaatccacctgtgttgcctcgactagctgggaatgcggattggtcgtggagcctcccctacttctggaaagccacaatgcctcgtgacgcaatcttcccacgccatcaacagggcagacgcttgccccttgtacccactgtgaagtgtggtccccggtgcacgaaccccgctctgcgaatcccccgttgcgccgcggattaacagcccttagctgggtgacaggctcgccccgtacctctcggaggcctaatccgctatccccaaaggaatgtcccgcgtgccctccccgatttcgtcaattcgacaccgcggaggaagtgtggccaatcagacccgggggcacagaacacgtgggttggccaactgcccccaacgcgccccctccaccgggggcgccccacaatcggttggcgtacaaagactccaccctccggccgtatctccttcggtatcggcacctcgccgacgccaatacgaggtagcccatcacctcaaccgttatgtgtctgagcgtgtgctgcacatgcaggccttggtagggttcgcgcatgtgcccctctagtttacgcctctttgcgtcctagcgcgactgcgtgtcctggtgtatcccatcactccgcttgctctggcggctgcagacgcactcgttactcgcggtcgatcgcggggggttctctcccgcggtggtcgtgagtggtcctcctgatgttctgccgccgtgcgcagcatgagtaccgcacacgcatcatcttcactacacttgatcgtgcgcgcgatctgcgatctggtctccacactcctggg

SEQ ID NO: 653256 - DNA, 477 bp, Homo sapiens
gctgaggcaggagaactgcttgaacccgggaggcggaggttgcagcgagccgagattgcgcccttacactccagcctgggcaagaagggcaaaactccgtctcgaaaaaaaaaaaaggaaaaaagaaaccaaattgtcctatttattacattgtatttctgttagatttccatgaaacatggggaattttaaatggcagttttaattttttttttcattaaacaaccccaaaccaatttctactgtgatttgtacaatgttatccatttgaagaactattgacttcagatactttctacagcagacttttcatttctcaacacaaatgagaaaaaggactactttctccagggccaaacaggaggtgagaaaggtaatgttgtaccgtaaattagggttaaattcagtatttggacctgacatttcaggttatatctccaaactgaggttaattcttacaatcagttttcaaacaat

SEQ ID NO: 653257 - DNA, 143 bp, Homo sapiens
tctagaggatccctgactgctgcatatttgttgcactgtgggtatcagtcatggggttagtgggttatcttctaagccttctcctatgtatgggggttacgtacttgacttgtacgcggtgtggtcgggtgtgttattactac

SEQ ID NO: 653258 - DNA, 906 bp, Homo sapiens
agcggagcgctgctgtgggctagcgcctgggctgcgacactgcagttgtctacgcggccggggccgggacgaggaggcgttggacggggtcgcatacgttcgtcccctcgcattgcggcccctgacaagctgcgccaggatccccgagtgcggctggcagcaggaggcgtgaacgctcttggggcatcagaccaggcctgagcgggcccgaggccggaggaacccaggacatcccggcgtaacgggacaatgacaacaagggcgcatatcttcaaagcacctagtacctcctaccattagtacaactgattccatcgctgaaagtcctggtaaaatctctaacttactagagtacttaatgaaataaacccacgattgtactatccaaaaaccaatcttacaccatgaaacgctaaaaacaattacccaaatacaagccccataatttacgtattgtaatattcatatgactcaacaatatttatcctaccagttattccacctttacagataacctagcttcttaaaagcactacacatttcgcgggtcacacaactagattattacattcccgaaggttccaacgaacgctgctcgccaccaaacactccatatgacccgcaaattataaaagggccaacacggccccttggttaagacacgtttcgacaaaaaaaccccttgggaagttgtcgtttggccaagttagcagaggaaactacattgcgttataaagtatcaggttatagcgagaatgcggtcgaacgcggaccttaccaggatacctctagaataacccccattgcgacatggtagacatagaccataccgaacgacagtacaaccggcgataatctagccattaactgcccaacgcaaagaacccagaatctacacacaagccc

SEQ ID NO: 653259 - DNA, 991 bp, Homo sapiens
gcggacaactccagggggacggtagcgcgatgagcgcggtgcccgggcctggcgcggacgcctgagacccagtcggacggagaggcggccccgccggagtgcttcgggcccaggaacccagaaccctgacaggcaatggccggcacgagacatgataccgggccgatgaatcctggataccgggtgcataggtatgacagtcaaaaagtgtgatggtcgaccagtcgacgaaggtccaggagatgaggaagaatctgactgggtgcactgtgggcagacaagcttaccgttcgtatcttcaaggtgtgtgtgccatgtggcatggattgcccccaagtgagggacaggaatgcagacacgggcgagcgacaacgactgcctcggagagggcatggactgaggagtctcgccgctgaggcggagagaaacactgttggcgagggcccaggggagtcaaccctagattttctcacctaacaggcgggaggatgggagccctactcgaattgccatgacttaggaagttctttaaggatggcgtaaaggacaacaaggtcaacaaccacaggacgctctacgccaccttgacgggaaaacggtttttacaccttgcaaacaacgggggccaacaggacaggcgccatgagtcccattgggtgcggacaacagacaccacaaaagagatcaatttagtgtcccacttgatgatacaacccatgggtccggggaaagcgcctcaggaacggggggattacatgaatcggaacgtcttcaggtccccacccaaacgggacatggcgggcaccgtccactgatgtacgattacacagtgggcggcacttaacgtttggcattggggcaaagcagcccgatccaaagagcaccgtcatttgcctagaacccacaaggtatggagcccctttgtttaccaagaacactctggctgtgaacgcttgcgagggccgccccggaaaggtattacacactagct

SEQ ID NO: 653260 - DNA, 99 bp, Homo sapiens
atcactgcttccctgagattttatggagcctcaatgttgacctgacagagttccagtccaaccctggtgcccctaccgctgcaatgcacgttccctctg

SEQ ID NO: 653261 - DNA, 155 bp, Homo sapiens
  misc_feature (107)..(107): n is a, c, g, or t
actccagttccaagaccaggccgttccactcatacacgccactacatgtgacgtcagccctgaaaaggtaacaggaaattcagaacattaacaatagaaaaaggcangtggtaaactaataagaagtgtgtttttatatgtgaggttattggcat

SEQ ID NO: 653262 - DNA, 568 bp, Homo sapiens
  misc_feature (32)..(32): n is a, c, g, or t
  misc_feature (550)..(550): n is a, c, g, or t
gacccgcctgctctgcccttttgattgttccnaagatctattatccatgtctataatcgtcttttgttgtttttttcttttcttgctctgttacagaagcgagtttttgttactgataggcataagatagcattcttttttttcgtttggtttgttcttacaagtcttctgcagtttactcgtacggcgtatataaagaattcctgtaataagagctatattgcatttttatatcctctcgtcttgatctagtctagcaatatagatgcataattgtattgattctcctttgatagatgtatccaggttgagagcacgcgtgatcgccccagtaacagtcaatttcccatcagcgactagcccggctgacagtaaaggggcatgaagcatctggagccagcagtgtcacggaggaccggaagccaaaaattggaatgcaatcagacaattcactggacctgggtagaagaaggactcttggattcaatgttgatctatttcatattattactcaacaccagtctgggatccctgaattcgcgagaagatnttcgaaaaggtcacgcgc

SEQ ID NO: 653263 - DNA, 292 bp, Homo sapiens
ctactacgcactactgcgctggcgctagtaacgcactgcgccaaaaggtcccccagcggctgccacatagtctctgcccatcctgagtgacgctgcacacttggctccacaggccctgctcgctccaccgcagcgggcacccagggggcatcgcagggcacctggctagaactaccaacaaatcactattatgacaggactagaatcccacaaacacacatcagcaggagacaatataaacgagggagcagtcggactataaaggtcacaatgtcatcccaccaaacatgcc

SEQ ID NO: 653264 - DNA, 781 bp, Homo sapiens
tacactagctacggcgaccatttgtccaaagcgccgaagaagcagaccatgtgggactcacaggccaggcccgatcggcccccaccagtgcctttaccacccgctcctagacccgtcttcagctgctgagatcatcgactgagggggcctgaatgccccctgttgattctgctgcccctgcacagcaagctgctagtgcctgggtggatgggccaccgcctttgcccagcctggatgccatccaagtcagatattcttgtttaatctcgcgactgaatggacttgagcacacttttggcccagggtggccacacctctatcccggcttttggtacaggggtacacaagaggaggatgatttgcgtgaatacccctagactcccatgaggagatgccatgagccgcccaaggccttccctggcactggcaaacagggcctcctgcggagcacactggctcatcccagtcctgcccgccaccgttatcggtgtcattcacctattcgtgttttttataatttatcctctgttgattttttcttttgctttatgggtctggcttgtttttcttgcatggtgttggacgctggatcgcttctcccccaccccctagtgtagccagcaggcagagcattgccctctgtctcaggctggtgtccactgggaggggcccaagaactctgctcagagaagtgcagggagagccttccaagctcactgtccctgagactggcatgacaggggctatggttgctatggtgtagttttaagaaaagtaataa

SEQ ID NO: 653265 - DNA, 252 bp, Homo sapiens
cgtcacatttggtaccccggaggagttattcgtaggcctgctgctggtgtggtgcctggcttcttttgccaagtttgcgtgctagcactggggccactgcgcaagaccggtacgaccggaggctgcgccccggcgtaaaggagcaactcgttctagctggaagagctggtctcagctggaaagcctaccctacgtgcctacgaataactcctcgggatccgtgcacgttaacgattactaggactatgcaga

SEQ ID NO: 653266 - DNA, 246 bp, Homo sapiens
ataaaagcctgtgtcggcttgctaaacctgctcctccaaagccagagcccaagcctaaaaaggcccctgccaaagacagggagagaagtgtacccaaaggtgaaaaagggaaaatgctgatgctgtgcaaggatggggaataacccgtgcagaaaattggagatgccaaagacatgaccagtgcactagaaatgctgaatgtgtgcttgtgagatgccacagtgcaagtgttgtgcagttttttga

SEQ ID NO: 653267 - DNA, 1881 bp, Homo sapiens
gagaacgcgtttgtctgtgcgaactgctgacgtcctctcggtgccagggcattgcggactcggctcgcttggcatgcgccctgcggagccgcgtgtgcggcaagcagacttgaatgccgccgagctgggcgactgtcggcatggacgcaggagccgcgctcgcatcacttgcgcaaccgagctccctgcgctgtgtgagagtcctctatcgcgcaacccatcgcgtgcatgtgatagcactcgagctgccgcgatgggccgacgcgtaccactctcactgcagtccgcgcgcacacccccgcatatgtgctcccaggctcccaggcccccatacgcgtcttcacagacgcgcgctcatcgagtgactgcctgggccctcagccgtgcgcgcgcgcacctagcgacccctcgctctgtcgaccgcgggcgctctcgctctccattggccgtctgcgcgcctgccttgctgcttccgcgagagcgcacgattgctgccacgcgccaagtccccatatgactcccgtgagcgcttaggcaacacggcagcctacgtggccacgaccgctactcgctggcccgcgccgcggggcccggcgcatgcggcgacaacgtaggccgacgcgcttgccccccagttcctaccgcagcctcgtcttgcgcctgcatgctgcctggcccccgccgtccgtgcacccgcttcccgtccctggcgcatcgtctcgccattgcgagttcgcccgttctgcctcgcccagagtccgtcgctcgcttgcctctcccgggaatactacccccacgggattacctcgaccccccacctaggctcggccccacgcgaacccttcttcctccccccagtcccggacacccacctcgttgaacagccctgtgcttcccccccccggccctgaggtccgccctgtggactgcccggaccctccccttcccacccatccatccccctcgtcggcttggcagcgcgaacctcgccaatccccttgcgcgtctcgcgcctggcgtgctccgtgcctacggccggcctatcccccccatagaccgcatagccggcgacagaacgcatcgcaccccaaggcaacaccccccacaactgcgacccccaaagcgcgatcacacacatcgagacccaacgacagccgagcacacaactacccacacaatacaacgcacaagcaactatcccccaacgtagaccccaacaggcgacctgcaacaccgaagacaaaccagggagcacctacgccagaaaagcgacagccaaaacatgcacaaacactccacccctcaaccagacggggctccttcacgcaccactgcacaagcgcagccagaacgccccccccttgacagcaccctgagcaccaaaggccaaaaaccgagcacaccccgctacgcgcaacgtacgcgcaacccgcacgccaaccccccactgcgcacccagcccagacgacaactgcacacccgagaaggacaccacccaccaacacccgcccactccaccgacgatcccaacacgccccgaccacacaaacaacacaagcaaccccacgacagcagacacacggcgcatcacacctccagcaacacacacaccaacacacataccaccgcacacgcggcaccaccaccaccggcacccacccgcccaaccacacgcggaccacaaccacgaccacgcgcggcgacccagcttaactctacccgccacgcacaccacaccaccgcccccaaacacccacgacaaccgccccaccccccacaccccacaagccacacaaacaacacaaccaaccaacccacaacaagccacccacaccaccacacgacaacagcacaccagacacaacactacacaacccacac

SEQ ID NO: 653268 - DNA, 576 bp, Homo sapiens
gggacggcaaagtagagttaggaagatattgagaagaaagagaaactaaatgccaatggaatctgcaatataaaaaatgtaaaaaatctgaaatataaaaaatgtaaggtttggtgggggtcatttaggattaatcaaacatcaattccaaagaaatttttttcttacagtaaaatatttaaatatatttgtgtactccaaaaattattcacatttgcatgcaacttcccaaatgccaatttcaagagtcataacattgtaattgaaattacatgctggaagatgtcataaatgtgctatgcaatggtgggcttcacaagattaagcaaaaatttaggatttatagcgcagattagtcttaatacatttctgtttatctttccaactagaataaaagggaatatcttgccaagtaatatgctacttgatttaacaaaaaaggtaatggcagttaagttaaggaaaggaagatttcacatagttttgttaattaccatgtaaatgttacctatgatatgacatttaaatctacaaatgattaacaaagattcttaaagcatattgctctaagcaaag

SEQ ID NO: 653269 - DNA, 753 bp, Homo sapiens
cctcgtggagagatatcacaattggacccacccatagggcgttatatacccttccctttatattattccaccacgggagcaaagttcaaacgccagttggcgacgcacgtagaatccatcgctgcgccctcaagccggtttcggtacacatatgtgtgccgacgcaacggttggcccccccccttgttttggacgccgcatgtgtacatctgccgcccgccactgcgtggagataggggcgacacaaacaacataatcatggcagaggggaatttttctataaataaatacagggggcacagaactcccatgataccctccaagggaatccatatataacatatcttgtacaaacctcctttgtcggacataagacaccctcttggaggagattcctagaacaatatcgcaccccaagttctccccttctacatacggccgaaacttttctccccctgatagaatgcacgctccacaactcctcctcctccggtattatagaatcgggtacgctgtataaggtccccgcatgagatactgaccatggtctgaacacaccaggatgtctccccgcaaaacctatgaccctcgtacagttcaatagacctctctagtcatttcgcccacctccctagtgcggatacccattattaaactctgccaataagtcggtttctcttgaggaaaatacaatgtttcagttcaacacaaaaacggtctcatacagataccaccaatagatcgcagaaatct

SEQ ID NO: 653270 - DNA, 160 bp, Homo sapiens
acctctttaggttgttcctatacataagccgtcatttaacccccaggtcgctcaccccaagcttgtgagctagcgtggagtccatactacaagctagtattatctaaataaacagaacttggccaggctcagtggctcatgcctgtaagtaatcccaaca

SEQ ID NO: 653271 - DNA, 151 bp, Homo sapiens
  misc_feature (144)..(144): n is a, c, g, or t
agaggatcctcccgccgtacagtggcggaaataaaaactctcctgggtcaatcacatatttttcttaatatggctacaaaagttattaccaaaaggtgttttttggtttaatatcatattataatcgtgtcgcaactgggtagncggcggg

SEQ ID NO: 653272 - DNA, 219 bp, Homo sapiens
tgtttcataagtaattctccccacttgatttttcttcctatccaatcccatagatcacagttgacgctatagccatttaatatatgttcacattgtaaagaatatgtataaatgttttcctcgtatgttagagcatgtataagccagcatataaataaattgtttaataagacggtacagtaaattctcaaagcattttttcaaatccaaaaaaaaaaa

SEQ ID NO: 653273 - DNA, 564 bp, Homo sapiens
gtaagataactgcgccatccggactagctgtttggttacgcaccaaagcgaagggcccggggtatcaaagtaccgcttttgtgcaagttcgcccgctccgatgttccaccaggtctcgcgcgccccccccggtggcgtgaaaacgagtggacccttcttggtcagaggcgcaccgtgtagtatttgcccttaagcggacttttggaggaacaggggacatgcctccaagagtatgttttttaactcttctaagaacccacccaatcgataatcttcaacttttaccaagtatttaagaagtgttggttaactcccagctttgacaagacaaagtcccacaatcactcacacttgttgatagcacctctatggttatttgcaacaacttccactttgttactggcacttcacgaaagccccctggcactggccgccgtctgtgagtggcacttttagaccctgttaaacacttgaggccccacctcgcttttaccccaaccgagtgaccacccccccttatattttcaaaaaaatcccctttaattcttaattgccaaaaaaaaa

SEQ ID NO: 653274 - DNA, 303 bp, Homo sapiens
tgttacccggtggttacggcatcaccgtcaccaaaccaacccatgaataagaccagtcgccaggctctccctgaattacctgttgctgggcacggatgtcgtcatcgccatcttcatcatcgtggccatatccttcgtgccgggccagctatcgttgtctatcctcgtaggccaagaagtccagcaaggacaagcacctagcagtttagtacaggggctgcaatcccatcatctactggctggcgaactacgtttgggacatgctcaaatagctggtccccgctacctggtgtgtcatcatcc

SEQ ID NO: 653275 - DNA, 326 bp, Homo sapiens
tagtgtcttactagttggtcagtacaggtatgacttatgttgaattttgcctagttacgaagatatgaatcttaataataggatctcttagtattagcactcattggattttctaagtggaaatgtaatgggcagtgcaatgatttaacattgtttactacagacgtttcttgaagacttctgagttatcgtaagcatgtacaaaaggttatttcttaagcttgcatttaaaatgcgtttacttcgtatgatcctcagcaagactatgagtggaatattacatgctcacacaagcatacgtgcatatggtttaattaaaaaaaaaa

SEQ ID NO: 653276 - DNA, 438 bp, Homo sapiens
gttggccagcgtcgaacggggggctactcaaggcccagtaagcccggccaggtataagcgcttagaacaccagtggcgtggcacaggcacagagtaccgagtggcctagaggtgaaccaagagcttagggtcctgcgctgtcacatacgagcatactaccacgacatacgggccgagccaccagctagctagagttacagccacagtgaagcggttcatatcggcgcaacttcttctaggccagctagggggcttcaggctacttttcctagctcgtcatcactgctagtcatcgtcactgtcctagtgctcctcttcaaatcccttcttctagggggctgcagagttctccagttggtcaagtttctctggctctttctctttctccttcttcacatcatcagtgagcttacaagcctcacagatcctcttaacgaa

SEQ ID NO: 653277 - DNA, 202 bp, Homo sapiens
  misc_feature (9)..(9): n is a, c, g, or t
  misc_feature (17)..(17): n is a, c, g, or t
  misc_feature (75)..(76): n is a, c, g, or t
  misc_feature (122)..(122): n is a, c, g, or t
  misc_feature (178)..(178): n is a, c, g, or t
aaaaagggnaggaagcngggaaaaaagaagggggaagcgggttatttggggaatattgtttgggggcgccacggnngcccccccccccccaaaaaaaaggtttttttttcaaggcctagggngggtatgaagtgtggggcgggggtcaaaacattcctgagaatctgggaaaggggcncaaagatggactgagaggaggggt

SEQ ID NO: 653278 - DNA, 923 bp, Homo sapiens
  misc_feature (627)..(627): n is a, c, g, or t
ggccctcttcctcctggccagcctcctgggcagcggctctagtctggccctggtccttggactgaaagaatgcaccagggctcggcagtgtggggccccgaatgtgcccacggcgtccgactgcggggcagtgaagcgatgctgccagaactgtttggacacaatgccaggcagtgaaatcccttacccgtgcgagtatatgcagatgactgttgtcagcggacaggtggtgatatagcttgaagggacaattgcgcatttggaggaggagactccttgtgaagattggagaagagctgtgattggccttcctgaggaagcgaaaccactgtctgaattcatgcaccggagatatgctggaactccttatcctttccctgtacactcctaggacagtcatttaacacggactgacactgacgccggtcctggagggacgcgtgtcggctcctgcttctccccttcgtcatgacttacgttctcgtcccaagcagggtgctcgcctaggcacgacagcttgaactcacccaggagaacgtcaacgccgtggcggctcgcaagtttcacgaactcaccaagtactctggtgagcagtggatctagatgagttgtgtgaggactcccctnttcactgagccagaagcgactacgcctccttcgttcgtctctaacccttccgagcggacatctggcccgccccgggcaatgaacaactggcaccaccgacatccgaaacagcgcatttcaactggggggggacgttttattgtgccatgatgaactggccctttccacgcatgggctggacttggacacaatccccaggaacgtggctcggtacgtggcacccacagtacccactcctatggatccccgcgcccgttgtggattggaaacgattttcaacggaagagcgtttctga

SEQ ID NO: 653279 - DNA, 740 bp, Homo sapiens
  misc_feature (27)..(27): n is a, c, g, or t
  misc_feature (150)..(150): n is a, c, g, or t
  misc_feature (159)..(159): n is a, c, g, or t
  misc_feature (170)..(170): n is a, c, g, or t
  misc_feature (223)..(223): n is a, c, g, or t
  misc_feature (227)..(227): n is a, c, g, or t
  misc_feature (396)..(396): n is a, c, g, or t
  misc_feature (398)..(398): n is a, c, g, or t
  misc_feature (462)..(462): n is a, c, g, or t
  misc_feature (473)..(473): n is a, c, g, or t
  misc_feature (494)..(494): n is a, c, g, or t
  misc_feature (498)..(498): n is a, c, g, or t
  misc_feature (526)..(526): n is a, c, g, or t
  misc_feature (528)..(528): n is a, c, g, or t
  misc_feature (530)..(530): n is a, c, g, or t
  misc_feature (557)..(557): n is a, c, g, or t
  misc_feature (581)..(581): n is a, c, g, or t
  misc_feature (588)..(588): n is a, c, g, or t
  misc_feature (595)..(595): n is a, c, g, or t
  misc_feature (606)..(606): n is a, c, g, or t
  misc_feature (636)..(636): n is a, c, g, or t
  misc_feature (646)..(646): n is a, c, g, or t
  misc_feature (657)..(657): n is a, c, g, or t
  misc_feature (666)..(666): n is a, c, g, or t
  misc_feature (734)..(734): n is a, c, g, or t
tcggtttctggttaggtggctggagangtcctgttgccagcttcttgtgggctttctcttgttcaggatgttaggtaacagttccccaattccgccggggggagctagatccccaaggctggggggccaggggctgcagggaacacagcnaaggctttnggagccaagtnagatcagttcaggccccttaggcccaggaacccgacaccaccgcgtacctgtnagcncacactcacggccaccccagttacaagtgcagccacaaacacccacactcactcacacccacacccacacgcacacccactacacacacacacacacacacacacacacacacacacacacacacggctgtaacaacacaggacccacaccctggacccctggtatgtntntggaccagaaccgaacagctggatccacagtgcgcggggctgctcagggggcgggttctctgtntcgctacttantggccgcctcgcaggcgtttnttcnatcactgtacacatccacgggttctganananacgttatgggcgtgtggtatccctctnggcacacggtacaagatatgactncggtgtngcgggcncggtccatttncacatcacaggatttctcgtggtttcaganggggcaggtnaactgggtttngagggtgcntgttatcttcttcttgggagggggcttttgttttgactttttgcgccccatgtttgcgggtggatganccttct

SEQ ID NO: 653280 - DNA, 190 bp, Homo sapiens
tggggcagtaacatatcacaatggtgcaatgtcatcagttaaggctattttcacttctgtggatcttcagtaacttcaggccatctggatgtatatgtgcaggtcactgggatatgatggcttagcttgagctcagaggacggacagagaccagcctagccaacagtgcaaaacgccctctctactaaaa

SEQ ID NO: 653281 - DNA, 759 bp, Homo sapiens
  misc_feature (260)..(260): n is a, c, g, or t
  misc_feature (327)..(327): n is a, c, g, or t
  misc_feature (384)..(384): n is a, c, g, or t
  misc_feature (404)..(404): n is a, c, g, or t
tagttttattggtttttatttccataacacaaaagaggaagcgaagggccagggcccgaggcatccccttggcacggttcgaaggctttcaaccgtcccgggttggtttggaaggcaatttgggggccgcgcccaaggaaacccgtgcaggcttgtcagttcccagcattgaacagcttaaaataaaaatcgtcccgtcgggttgctgctcggagaggctccaagaaatgcaaaacaaacccgcctggaaaatgctgccntgagaaccagagcgagggcttgaaagatgccttcaacacagactcttctaggaatccagccagcttngggacggccgtttcacaaaaccaaaaaacaccaagtaacatttctaaccggagaatngccggttttagcaagaaaanggggcttcacctaaaggggggggtcacaaaacacgaggggggtccccccgggcgcctgcctcttcctttctgagcagatccgtccgagactggtgtgagcggattcgccaccctgtgctggagggggccgcagcagccggtctggggtgggcgctcactgttggccccgcctgtttgccaggttcttctctggtggctctgcctgtgccgggatcccacctcggctcggccaccaaacttcggcaggcgccatggcggcttttgtgttgtgtgaggctccgggcgggcttgcacacttcttgctgtcaatcgggatccgtctaggggggttgactggccgaatgcgcgagaatcg

SEQ ID NO: 653282 - DNA, 667 bp, Homo sapiens
  misc_feature (260)..(260): n is a, c, g, or t
  misc_feature (327)..(327): n is a, c, g, or t
  misc_feature (384)..(384): n is a, c, g, or t
  misc_feature (404)..(404): n is a, c, g, or t
tagttttattggtttttatttccataacacaaaagaggaagcgaagggccagggcccgaggcatccccttggcacggttcgaaggctttcaaccgtcccgggttggtttggaaggcaatttgggggccgcgcccaaggaaacccgtgcaggcttgtcagttcccagcattgaacagcttaaaataaaaatcgtcccgtcgggttgctgctcggagaggctccaagaaatgcaaaacaaacccgcctggaaaatgctgccntgagaaccagagcgagggcttgaaagatgccttcaacacagactcttctaggaatccagccagcttngggacggccgtttcacaaaaccaaaaaacaccaagtaacatttctaaccggagaatngccggttttagcaagaaaanggggcttcacctaacatgagtggtcctacacacaaaggtggttccccttggcgcccacctcatcctctttaagaaaaacggtctcagtctcatgagtggtgtccacaccctcacagaaggccatgcagtcatctagttgatattgtgtctgtgatgggtcagcatccgtcagggcatttaagcgatggtcataggcaagtgttggcaatctcgcctcagccaaagaagtcagaaccccctagacgagggcagcctaccagagc

SEQ ID NO: 653283 - DNA, 830 bp, Homo sapiens
  misc_feature (150)..(150): n is a, c, g, or t
  misc_feature (156)..(156): n is a, c, g, or t
ctccccggggagcgtgttttgccagtatggggaagtagggcggaggcataggaatgaccgcgagagtggctgctttcatagctccgcttgcgaaactcctgcccggctttgacaccgccacggctttcagtgatctggaaaatccctagnttccanaaatagtcttagggcgaggacttgacagaggtaatttgattatgcctgggagtctctattcatacatggttacctaccgcgggtagggtgaggtcaacctcgtgttttatgttttttttcctgtgatattagctagcaatttccagcgtttcctgaaccttgaagtaaaaacaatgatactgatctaaactactagaatctaggttggaaggaaaggaatgcatcacgttttactcttgacgctcagaaagcgataccccaaagacagaggctttagaagctgcctcataatgcaggtcccccaaccttgacttgttgctcccacttttcccaagtgcagggaggtactctctgaaatttcctttcctgactagagaagcctctttgtagaagaatcaatcgcattcctcccctcgctgaaatctcgtatcctatttcaaaaagactcagaaatgcagccattcctggagggactttttcacaagattactcaaaagaaaattatttactaatttctgtccattcattgttcctaataatcatttgctgctcctcaaaataaatgtctacatttctcatctaccctttcccctatgaaaaaaagatataaaatcttctgtactccattaagctactgggtaatcatcctcctgcttttaccccggtgttatgta

SEQ ID NO: 653284 - DNA, 776 bp, Homo sapiens
  misc_feature (150)..(150): n is a, c, g, or t
  misc_feature (156)..(156): n is a, c, g, or t
ctccccggggagcgtgttttgccagtatggggaagtagggcggaggcataggaatgaccgcgagagtggctgctttcatagctccgcttgcgaaactcctgcccggctttgacaccgccacggctttcagtgatctggaaaatccctagnttccanaaatagtcttagggcgaggacttgacagaggtaatttgattatgcctgggagtctctattcatacatggttacctaccgcgggtagggtgaggtcaacctcgtgttttatgttttttttcctgtgatattagctagcaatttccagcgtttcctgaaccttgaagtacatcacgttttactcttgacgctcagaaagcgataccccaaagacagaggctttagaagctgcctcataatgcaggtcccccaaccttgacttgttgctcccacttttcccaagtgcagggaggtactctctgaaatttcctttcctgactagagaagcctctttgtagaagaatcaatcgcattcctcccctcgctgaaatctcgtatcctatttcaaaaagactcagaaatgcagccattcctggagggactttttcacaagattactcaaaagaaaattatttactaatttctgtccattcattgttcctaataatcatttgctgctcctcaaaataaatgtctacatttctcatctaccctttcccctatgaaaaaaagatataaaatcttctgtactccattaagctactgggtaatcatcctcctgcttttaccccggtgttatgta

SEQ ID NO: 653285 - DNA, 607 bp, Homo sapiens
aacaatgtaccagaagtactatagccaagacagcattatgacttgatgtaagtcatgccacatccccattattggccacctcacgatgaagagacagataactccctaaatgttaagctggctctactcccctcaactacttaaactagtaaaaaccacatgggaaatatagaaattcaaatagaagtaacataaacctgtcataaatcgtaaacagaaaaactatttgtgggacagcatggatgacaaagtggtctactgtgtaaattctagaatgaggcagacaaaagttggaaggccggttaattttcccctccttctcctgctccagcttcgtctccttgggtatccgatgtccacaagggtcaagttgtctctcagtaattgcattattagcgtgctgtctttgtatgactcttcacttaatgtatcaagttcagcaatggcttcatcaaaagctgtctttgcaagagagcaggctttctctggggagttcagaatctcataatagaacacagagaagttaagggccagacccagtctgataggatgtgtaggttgcatttcctttttgctgatttcaaaagcttcttggtatgcttgttgt

SEQ ID NO: 653286 - DNA, 229 bp, Homo sapiens
agacagtcagcatcagtcctgttatgggcccatgacaagaggtggagaaggcgcggacggaggcggtcactgaggcggtcgcggaaatagtggaccgtacagaggcgactatagcggtgccgggaactatcaaggcagatccttctaaaggaaatagtgcaagtcctaaggcccacacccttacacacaccgaattccctgttttgcttgagggagcccttctgctggt

SEQ ID NO: 653287 - DNA, 350 bp, Homo sapiens
  misc_feature (47)..(47): n is a, c, g, or t
  misc_feature (146)..(146): n is a, c, g, or t
  misc_feature (186)..(186): n is a, c, g, or t
  misc_feature (190)..(190): n is a, c, g, or t
  misc_feature (192)..(192): n is a, c, g, or t
  misc_feature (241)..(241): n is a, c, g, or t
  misc_feature (253)..(253): n is a, c, g, or t
  misc_feature (268)..(268): n is a, c, g, or t
  misc_feature (312)..(312): n is a, c, g, or t
  misc_feature (317)..(317): n is a, c, g, or t
cgtcccctttgcacatgttccctgggcacctctgtcctccgcgattncctgcctgcccagagagctccctgctctggttaggcttgtgaggtccccgtagctgtggctgctgcagaggcctcagcctggccggaaagcctgttcanctgctggcactcagagcctcgcagtggtccttcccttttntgcntncggaatcttagggagaccctgatgaacactttgagttgtctccccaggnacacacagctcnctcctcattgaacanttagcacacaattctggccattccaaagacttcagatgaagaantcctngtagacagtttatgaactgggattatgcaggac

SEQ ID NO: 653288 - DNA, 270 bp, Homo sapiens
  misc_feature (107)..(107): n is a, c, g, or t
  misc_feature (124)..(124): n is a, c, g, or t
  misc_feature (141)..(141): n is a, c, g, or t
  misc_feature (146)..(146): n is a, c, g, or t
  misc_feature (159)..(159): n is a, c, g, or t
  misc_feature (184)..(184): n is a, c, g, or t
  misc_feature (243)..(243): n is a, c, g, or t
cgagggaaggctggctgccagaagatagcgagtttacttcagacattgccaaaggtgctgataacacagctgctatcagagctttcagaacacataccaactgcaangaaagtacagtagccgngctgagtgtccaatagngtcanggttcattctccnccgatgactagacacaaaagaattncctccggtgtagttctaataaaaagaagctcaagctccaagtgaagggaggagagtggnctgtagcagaggttggcttcaggcttg

SEQ ID NO: 653289 - DNA, 173 bp, Homo sapiens
  misc_feature (2)..(2): n is a, c, g, or t
  misc_feature (39)..(39): n is a, c, g, or t
  misc_feature (102)..(102): n is a, c, g, or t
tntgcaagggacagggctccccatggcctcctggttgcntccctcagggctgatagcagcactccctggccacacgccatggcgctccctcaggcgagactnagaggccagtgaggcctgcacggtggcctcagcttctggggtgcccttgctgggcggtcccctcaggcccc

SEQ ID NO: 653290 - DNA, 705 bp, Homo sapiens
gactagttctagatcgcgagcggccgcccttttttttttgtttcttaaagaattttcaaaatcaaattccagaatggatttaacgggagatatcccaggaaaatgaaggcttctcttaaacactaaaaaggcatgtaatggctggtaagcaaaagggatatgacacatctctgatactgttttgcattatgggtggggctgagcagtcagaagaccgggtcgtcgtctggacttgggcaaatgagccggagcccctggggcaggtcacacaaccggtcccagcgagggacacggaggggcccttcaggtacatcgcagggggtgcgggttaaaaggtaattaatctggtaaatatactcctagtaatttaagattgggtgttaaaaggggaattaacagatggtatagggcagtgtctttaaacaaaacaaaaaaccaacaaaaacacacacacaaaacacagggggggggagcgcacggaataacacacaagccaggaccaccctgggacgcaaaaacaccgcgggacacacacacggaccgggacaacaaccacgcgacgcgttagaggggagcagagacaatagggtccaaacgaggcggtgtcagccacaaagagcgacgaaacggggcgcacgagcaagatgaagagaaaaaccgaacgccgaacaaaccaaacgcgcgccagccgacgcagcgcgcagc

SEQ ID NO: 653291 - DNA, 369 bp, Homo sapiens
ataggatccccccgtggatgcgatgaatgttcaagtgctttgctacagggacagctgctctgaactctgagggaggtcgctaattggaaaacccttggggaattattatgcccatttcggtctctgagctgcacacaggcttccagagagtggtgatagggcacatttgttataagtgacctaagtgacaaatgtaactctagctgtcctaagcaaaaggaaattcatagacttaggtcgtaagttcagcatgtaacctccggggacatctatgtctggatgctccaaaatgatcttgagaaattgagtctgtttctcctttctgcttcccacttcgactccctctttctgcttcattcttggcaggct

SEQ ID NO: 653292 - DNA, 417 bp, Homo sapiens
  misc_feature (25)..(25): n is a, c, g, or t
  misc_feature (90)..(90): n is a, c, g, or t
ccctggaaatacctatgccagcccntaaaaaaatgagttccatgtcctttgccgggacatggatgaagcctggaaacccatcattcctcngcaaactaacacagaagcagaaaacccaaacacccacatgttcctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatcta

SEQ ID NO: 653293 - DNA, 244 bp, Homo sapiens
  misc_feature (153)..(153): n is a, c, g, or t
gtgctgactttcgtctcatcacattctgccggtataataaggacactttccttgtcaccgatccgtcgatgcagatgtcatacgtatgtcaggaactgcaagttcacctcgcctggtggcctccccttcatcagtttcatgcaatgaacctanatggacctgctggccctcaagtcggttagtgtcctaccagcacgccttcctctacatccgccagtctcgccatacacctgcgcaacgccat

SEQ ID NO: 653294 - DNA, 655 bp, Homo sapiens
tggaaacagagtctcactctgtcgcccaggctggagtgcagtggcgcaatctcggctcactgcaaactccacctcccaggttcatgccattctcctgcctcatgccattctcctgcctcagcctcccaagtagctgggactacaggcacccgccaccacacctggctaattttttggtatttttcgtagagacggggtttcaccgtgttagccaggatggtctccatctcctgacctcatcatccgcccgccttggcctcccaaagtgctgggattacaggcgtgagccaccgtgcccagcccccatggctggctaattttttggtattttttagtagagaagaggtttcaccatattgggccaggctggtctcaaactcctgaccttgtgatccacccacctcgacctcccaaagtgctgggattacaagcgtgagccaccgtgcccggccccctttatgtttttgagacagggtctcacttcactctgtcccccaggctggattgcagtggtgcaatcacagctcactgcagccctgatttcccgagctcaagggatcttccagcctcagtctcccaagcagctaggactataggttgtgcaccaccacacccagctaatttcggtctgggtacgagatggggttccctatat

SEQ ID NO: 653295 - DNA, 145 bp, Homo sapiens
gctcgaccttaagatcctcacagtcacagaagcataatgctttgctgggtgtgatggttcatgcctataatcccaacactttgggaggcgaggcaagaggatggcttgagcacaggtccagtatagtgagaccccatctctacaa

SEQ ID NO: 653296 - DNA, 148 bp, Homo sapiens
cacgtatgtcgatggttgcggggttaaattaaaaagaaataccacacatagcaaaaaagaatgtaaggtatggttagtggttgctgccgattaagaacaaaaaactgtaaatcatcttaccacccaagagtgattttatcacttatgg

SEQ ID NO: 653297 - DNA, 1315 bp, Homo sapiens
gcggatggttgctgccgaacatgggcaagttcatgaaacctggcgaagtgtggtgcttgtcctgtgcttggacgctactccggactcaaagctgtcatctggtgaagaacattcgatgcatggcacctctaagatcgcccgctacagaccatgctctaggtggctggacatttgaccgctaccccacgtcaaagtgacgagctgccatgggcaagaagaagatcgccaagagatcaagacgataaaatctttgtgtgatagtgtataactacaatcacctaatgcccacaaggtactctgtggatatccccttggacaatactgtctgtcatataacggatgtcgttcatgagatcctgctcttaaagcgcaatggctccgatcgggaggccaaggtcaagtttgaaggagagattcacaagacaggcaatgaacgaagtaggttcttccaggaatactggcggtcttatagattgcttaggttgtctgatcgattcaagacaattcataccactgacacacataaagagatccttagaaacaacaaaactcggggggactcgttgttgggcgtcgagtgtcgcataacacatttgcgtgttaacttaaaatgtgctcagcttggggttcggacccttcgggtagaatcgcacggagatccccaatggttcatcctctggttaccgccaggcgcaaggtagagaacttctgcagggcaggtggatccccctcttataaggggaaaagctgaaattacacatgttcgcgaatgagcgcgggggatgccttaaccccttgggagggacttaaagagaacgcggggaggcacaaaaactgtggaaacggctgtcccaccacggggaaattccttgtgacgagcctctgcggccatgacggcccactggcaatctgtaacgtgcggaggcaaacggcatgagcacaagcggacagcactacagggagcgctaccccgcgaattaaatccgccaacagggtggtccacaaaagggacggccctcgagagaggcgcggttaaaacgctcggcccccccacatacacccgtgtaatcaaacgatacagagaagctttgtccggcgcaaacccctacacctgggacacagctgtgtatcacatcgcgtaggctcaaacacccaaggggcgctccacacaaggagcaccaccacttcaccaatgggcgattcaacatggagcaccacccacatggtaagcacacatacaggcggcgttgcgtctcacaagccgcgacacctccgagacacgcagtaaacacacactagtgcgacggccacctct

SEQ ID NO: 653298 - DNA, 582 bp, Homo sapiens
  misc_feature (98)..(98): n is a, c, g, or t
  misc_feature (115)..(115): n is a, c, g, or t
  misc_feature (131)..(131): n is a, c, g, or t
  misc_feature (139)..(139): n is a, c, g, or t
  misc_feature (143)..(144): n is a, c, g, or t
  misc_feature (149)..(149): n is a, c, g, or t
  misc_feature (154)..(154): n is a, c, g, or t
  misc_feature (164)..(164): n is a, c, g, or t
  misc_feature (166)..(166): n is a, c, g, or t
  misc_feature (187)..(187): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (208)..(208): n is a, c, g, or t
  misc_feature (218)..(218): n is a, c, g, or t
  misc_feature (224)..(224): n is a, c, g, or t
  misc_feature (244)..(244): n is a, c, g, or t
  misc_feature (249)..(249): n is a, c, g, or t
  misc_feature (257)..(257): n is a, c, g, or t
  misc_feature (260)..(260): n is a, c, g, or t
  misc_feature (276)..(276): n is a, c, g, or t
  misc_feature (287)..(287): n is a, c, g, or t
  misc_feature (297)..(297): n is a, c, g, or t
  misc_feature (316)..(316): n is a, c, g, or t
  misc_feature (324)..(324): n is a, c, g, or t
  misc_feature (340)..(340): n is a, c, g, or t
  misc_feature (347)..(347): n is a, c, g, or t
  misc_feature (367)..(367): n is a, c, g, or t
  misc_feature (374)..(374): n is a, c, g, or t
  misc_feature (382)..(382): n is a, c, g, or t
  misc_feature (423)..(423): n is a, c, g, or t
  misc_feature (479)..(479): n is a, c, g, or t
  misc_feature (500)..(500): n is a, c, g, or t
  misc_feature (574)..(574): n is a, c, g, or t
ggccagtgattccgagtgtgtgaggagcggcagtggcggcggaggagggggcggcgtgggtgggggcgggggcgggatgcgctccccggcccctctanccccgtggtggtacaangcgaaggtgtgggaangccgcganaaannggaantgcancccgccggananctccggcttcacttccgtaananganangagtgtacggcaangggcgggaantggaanttggcccgcctcgttgtganctganctcagcgncangcttttgtggcgtcantgcactgttancccgccctangtgtctctgacgctgacancttctcantgtgaaaagtcgcganctgtgangtctggggggcgcctcaaancttccantccaacancggatcccggaaaggcaacgtcggagactggacccaaaaancttcctgttctgcctgcagagttgagccccgtccgggtcctggacccgcgtagtantgaccctggatccctgttcantgcgttctcgctccccgcgctccctgctggaccccgggatgccgggcatctccgcccgaggcctctctcatgangggaggaa

SEQ ID NO: 653299 - DNA, 403 bp, Homo sapiens
gtacacacctgggacgacggtgacgtgctgctaggtcaggggagtccgctcggccaatccacatgacctagctatgagccactagggggccactgagactgcagcgtgtgcaactgagagaggctgcgtcctgcatgacataaggagccgcatctggatcgcgagcccgtgctgcatgcagaaagtgaggcacagacagcagactgtagatctagccagctaatgcgaacggatctggaccgtcattggaagtaatgcctcctgagctccagatgtgcacagactgttgcatgagcgtgagcgacaactggctgtagactgcggctgcaaacagaatgcatgatgaagtttaaggactgctgctgccgtcattgctgctctatactcgagaggtagcagagct

SEQ ID NO: 653300 - DNA, 268 bp, Homo sapiens
  misc_feature (8)..(8): n is a, c, g, or t
  misc_feature (14)..(14): n is a, c, g, or t
  misc_feature (50)..(50): n is a, c, g, or t
  misc_feature (173)..(173): n is a, c, g, or t
accaaaanccgganaaaaggtgcattttaaccttgacccaaggacaaatncggttgcagagaagaattaagggccccaagtcctgtctcctctgagggcatcaaggacttcttcagcatgaagccggagtgggagaacttgaaccagtccaacgtgcggcgcatgcacactgncgtgcggctgaacgaggtcatcgtgaagaaatcccgggacgccaagcttgttttgctcaacatgcctgggcctccccgcaaccgcaatggtgatg

SEQ ID NO: 653301 - DNA, 377 bp, Homo sapiens
tgtatggttcggacccaccgtacttttgctgagtccccaaggggctgtcgggtacagattccaggagagcggctgctggtcaggcagcagtgatctctaaagccacgcaggtaattttatcagatgctggcagagaaggggttctcatgtggtgggtacctggcaggcggactcggggctcattcctttcttcttggtccttggaggggcagggcagtgagagacacagctctacccccactacccagcagctgttgtctctcccacttccaattcctgggtgtgaggcccacctgatccggggaggtcgaggctgcagaggtgggaggatcacatgagcctgggaggtcgaggctgcagaggtggcaggatcacat

SEQ ID NO: 653302 - DNA, 156 bp, Homo sapiens
actaaagtaccctgtactgcctcctcccacccttgattgcttacttgtcaattaaattaaaatatgaggtacaattgtattggattgcaccatgagccagactattgcttccaggtactttctgggttgaacaatcattcaatatctaaccttgta

SEQ ID NO: 653303 - DNA, 151 bp, Homo sapiens
cgctttatatctctcaacgctttatacttccctctacgctttatacttcctatacttcctcaacgctttatacttcctctacgctttatacttcctatacttcctcaacgcttctcatttcatttcccggtatgaagtataaagcgttgag

SEQ ID NO: 653304 - DNA, 236 bp, Homo sapiens
  misc_feature (19)..(19): n is a, c, g, or t
caatgcatattccagtggnttacactattgaccctatagagagagagagtgaagcaaaaaatgaaatcttactagtgcatactagttggtaacctagcatttttcacctaaaaaataatccgcaataaacataatatgtgtcaaaacttttgtagcccagcctttaataaatttccgtatataaatttactaagcctaggaacttgactgactattaacgcataatacacgattat

SEQ ID NO: 653305 - DNA, 266 bp, Homo sapiens
agaaagagagagacagatgtagtactatcttaaatgtcttagaaaatataatagtgaatacgatcgacagaggaatcacggaaattgctccaaagtggagattctaaacaaggctatgggagaaagcaaaaaactcttccattgcaacatttgatggtcatttgtactttcaggcatgtactaacataacatcataacagcctctttaatggaatggagggaattctctaacgggagacctagagtaagtcagtccttcattctat

SEQ ID NO: 653306 - DNA, 494 bp, Homo sapiens
  misc_feature (8)..(8): n is a, c, g, or t
  misc_feature (76)..(76): n is a, c, g, or t
ccggatgntgattttagataaatctttgccgaactttcaggtgttttactcaaaagtctcccagcttttgaaaaanggagaatgtctagagcagtgaaattagttttttttactgcaatcaaggtttcaaaacaatgttagtgcgcccgacaaactgggactatcttgtttcctttttacacccttcctctctgagtagtggggaagggtgtaaacctccctaggagcaggtaaggtagactatgattgctcacaattggtaaccatacttgcagtgatctttgtgatttattgaatcacatctaggatgtacatattaatccatatttgtgctgagcatattcatttatcaactaagagactacagaaaaaagccattgttgtggtgatgaaaatgtcaacactttatcaggttctgaacccaaagagacttttgcttattatgtaagaagcacacctgtggctctaggcctttggaagaaaataaaagagaa

SEQ ID NO: 653307 - DNA, 89 bp, Homo sapiens
aggggaagcagatctgaggacatctctgtgccaggccagaaaccgcccacctgcagttccttctccgggatggacgtggggcccagctc

SEQ ID NO: 653308 - DNA, 440 bp, Homo sapiens
  misc_feature (241)..(241): n is a, c, g, or t
  misc_feature (250)..(250): n is a, c, g, or t
  misc_feature (255)..(255): n is a, c, g, or t
  misc_feature (364)..(365): n is a, c, g, or t
  misc_feature (398)..(398): n is a, c, g, or t
  misc_feature (438)..(438): n is a, c, g, or t
ttgttgtgggtaggggaagagctgaggattctggagtgcctgaggacagaggaggtcagcaaggtctgaatagatttctctggaaataagaatcttagatgctaaaatttccttctgttcctcctggtctggaacctcccagggactgtccttatttctctctcctggtgtgggtaaagggacagttacaaaccaggtcaccatcctcagaggctgatgcctgtacccaccccagcacagncacctccgncagancccgtggctctgggagagccagctttgctattcccattgtgacagcgatggcaggcctgacccacggggcagttagagcagcctcgtggagctcgcccctcccctcagnnctgccacctctccctgcatcctgaggccagtgngccccgggcctgcacagatacctcatcatctaaccacaanca

SEQ ID NO: 653309 - DNA, 370 bp, Homo sapiens
cacacacatcgagcagacacacacacacacacacacggagaattatgcctggggacttgggcccactatacacaccgagcgaatacagatatctgtgggtgagacagacggcgggactcagctttcatgtgtcgccttccctgtggagcagggcgatcacaactatcgtagctctctgtgcccaggactcttgtgaaagcatagagagctacgagtatgttgtgatcgcctcacccagtcctggacgcagccagctcctctttcaacagcctgcagcgtgttccctcctatgacagacttcgactcagaggatctctccgggtgccctgcccaaccacaagcccggggcgcaccttcaaggatctatgtg

SEQ ID NO: 653310 - DNA, 320 bp, Homo sapiens
tgatctacggatcttaggactggcgtgcttatggcctcgtaacataccaaggccagcacagacaatatgtagacaaatgagcttggtgagtatcccacaaaacatgatttctaaaaacaagtagctagctctgctctggatgataacagggatcttttttttttttttttttggattttgggcctttttccttttgaaagggccgtccctgtggcatagggaggtcccagggctagggctcatactagagcgtgatagccaccagccatacgcaaaagccacagcaagggtgggtctccagtctaccaggtgtgcaacca

SEQ ID NO: 653311 - DNA, 237 bp, Homo sapiens
  misc_feature (62)..(62): n is a, c, g, or t
  misc_feature (102)..(102): n is a, c, g, or t
cactcaccttactccagacaaccttagccaaaccatttaccaaataagtataggcgataganattgatacctggcgcaatagaatatagtaccccaaggganagatgaaaaattataaccaagcataatatagctagggactaacccctataccttctgcataatgaattaactagagaataactctgcaaggagagccacagctaagacccccgcagacagacgagctacctcaga

SEQ ID NO: 653312 - DNA, 187 bp, Homo sapiens
gggggctgctgggaagatggcggactcggtggctagccgatgaggaggccgcggggggaacccggcccctcgggcccctgaggaccgatctgtagggatgcgatcctgcgcaagggccccggggaagtcatggtctccatcatccaattccatgcttcgagtcctgctctctgctcagagctcccct

SEQ ID NO: 653313 - DNA, 199 bp, Homo sapiens
ggttctgtcctcattccccctcctgaaatggaaggagcaaattttcaaggagcagttaatgtaagtaagctagacggctagacggctcttcagcgctgtctgaatcaagtacttagtagttttatgttgttcaaaatacattttaagtgaagttagttattttgggacttcctttactatattgcctaaactacatcaa

SEQ ID NO: 653314 - DNA, 750 bp, Homo sapiens
  misc_feature (617)..(617): n is a, c, g, or t
acgcctgatgacgcgcgggccgtacaccttccgcggttattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccttacaggcttacgcacttgccgagtctcacgatattccgcagaataaagttgactgggcctttgaaccgcaacgtgccgcgttgttaatccatgatatgcaggactattttgtcagcttctggngcgagaactgcccgatgatggacaggtgatcgcgaatattgctgcgctgcgcgaatacttgaaacaagacaatatcccggttattacacccgccaactcgaagaacagaacgatgtcggccgctgtgtgtttt

SEQ ID NO: 653315 - DNA, 588 bp, Homo sapiens
ggctgcagtggggcctctgcctcccaggcttaagcaatccgtcccacctcagcctttcaagtagctgagaccacaggcgtgtaccacccacccatggctaattttttattttttattttttattgtttgtttgtttgttttgagacagaatctcactctgtcacccaggctggagtgcagtggcatgatcttggcgcactgcaacctctgcctcccgggttcaagtgattctcctgcctcagcctcccgagtagctgggattacaggtgcctgccaccacgtctggctaattttggtatttttagtagagacgaggtttcaccatgttggccaggctggtctcgagctcctagcctcaggtgatccacctgcctcagcctcccaaagtgctgggattacaggcctgagccactgcgcccagccagcctggtagtccggttcccgtttcgagacaagagtctcactctatcgctcaggctggagtgcagtggcatgatcttggctcactgtagcctccaccttccagattcaagcaattctcctgcctcagctcccgagtagctgggattacagactgtacaccacaag

SEQ ID NO: 653316 - DNA, 591 bp, Homo sapiens
atggctgtggtacgggcgtgggacgcgacgtgaaggcccgtgatcaggcaccaactcctacgaatgtgcctgacgcagttgagaatgcgcagctacatcagtactaccagatgtatgcgtcgacaaatccgagtggatcttcaaccgtcgacggggagacactcttcaaaaacggggagctgaagtcgctcgaggagatcatggctgatgccgggtcaaatcgagaagatcaagttgtcggagtgcttcgccccctcgtagaggccgcgggcgtcgatatccacgcgtaccaggaccagtacaacgagtcgaagggtgactccaccgaagcgatgtcgtacgacgagtacaagaatcggctcctacatgaagactagttatcacgcatttccacttctggcgaccgcgactctgatcgcggcttgttcgacagtgcagttggacggcgtcgagtccgtgcctgtcagcaccccggcgtcgaccagcccaaccaactacgtacttctggccggttggatcattcaccaatgtgtggtccgcggaccctggggtcgacttgttcgctgaaccagtggcggtcgtccgcgcggc

SEQ ID NO: 653317 - DNA, 576 bp, Homo sapiens
aaggaccccctggcatactgagctactgggggccataggctgcagtgtaggatggggaatgatctgccctgtttgccaggtccacccctccacctgagcccgagagacctttcttcagtttcccaagcctaacctgtctcttgtgaagcctctgctcttccctggttctatgctgatcatagaggacgagtaagggtttaagcctgtgagtgaccatagaggacttttatggggtaagagggaaggtccattggctgtgagaaaaggccagaagctatttctattaaggaacaagcacaagggctagagaagttaataaatatctgacagatacatctgacatatagtatgcttcatactgggctaggcactttacattaactcatataattctttttttaagtttttttaaaattttttattttattattttagagacagagtcttgctccattcaccaggctggtctcaaactcctggcctcaaccaatcctcctggccttggcctcccaaagtgctgttattacaggcgtgagctaccatgcccagccccgtataattctttttaaaaaaaaa

SEQ ID NO: 653318 - DNA, 554 bp, Homo sapiens
gggtacggccggaatgttaggatgtcaccacagtaggtcctcggctcagtcggcccagcccctcgtcaggtcctccccaaccgccacaagcgccgcggctctgagacgcggccccggcggcggcggcagcagctgcagcatcatctccaccctccagcgcatggaagacctggaggagctggaggtgctggatgaggaagcccgctcgcgcgggctgtccgcggtcccagtgtcccaccgggccctgctggcgggcgcgctcctgatggacttcggaaatgagcttcgtgccgtcggtgccccggggacccctggccggttcgtccccccgtggccccggaggcggcaggcgttcttgggatctcgagcccgggtgtcggtcgatcgtgtcccgcgccatctcccgtcttgtctgtctgtgcgtcagttctcggcgtctcgcaagtctctctggagggagcgattgaggctctcctggtccgtgtctgtgggggtgtggctgtgtttggggggcgtatgttttggggtgtgatggttttgtagtgggggggggg

SEQ ID NO: 653319 - DNA, 278 bp, Homo sapiens
cggttctccgggttgccggtgcgctcctacgtcgcctcctgaacatgaccgcacctaggtctgacttcatcgtccgaggatgtcgaacggcagcttcgtgccaggaggtgcgtgcaaacgccagctggtagccgtggccaggcagctgcgaggacgttccggtccaagcggctcatgggcatgacgccctgggagcaggacgctggcccatgctggaggctttgcggttcgacgggaccgagccaggcaccgaggcccgggagcggcatcgtgccgga

SEQ ID NO: 653320 - DNA, 338 bp, Homo sapiens
  misc_feature (33)..(33): n is a, c, g, or t
actaaatggctgtatgtgtgatatggactgtgncaccataaatgttaggccctaactcttgaagggagtgcctgtgaagctgcaagacaggcacaggggtctagtcccttaggcaaccagacatgaaaacatattcatggcaaggggtgaaataagtgtgttagtatagaagtgagaaaagaacctgcattttgagggaactcaagcttttcacattgctacagcatagggcatgattgtaggatgagaaaaggaaaggcttgccttgagcagctggactttatacttgttgggctgaaggagcaaatggaaaattgtgaaagggaaaagggtaccga

SEQ ID NO: 653321 - DNA, 105 bp, Homo sapiens
taattcgtgtcacgtagtgtagtctctttcttttgtttcccaggtgttgggtgggtacttattttaacaaaaacttgtaacaattgtgtccaaaaaaaacaattt

SEQ ID NO: 653322 - DNA, 318 bp, Homo sapiens
ggtcgactgcaatggaatggaatggaatgcaatggaatggagtggaatggaataaacaccagtggaatggaatggaatggaatggaatggaatggaatggaatggaatggaatggaatggaaaggacaggaatggaatggaaaggaatggaatggaatggaatggaatggaatttaatggaatggaatggaatggaatcaacgcgagtggagtcgaatggaattgaaagaaaattaatagaatggaatggaatggaatgcaatggaatgcaatggaatggaatacaatgaacccgagtggaatggaatggaagggaaa

SEQ ID NO: 653323 - DNA, 141 bp, Homo sapiens
tacccggccatctctagtcagcagtatcatccatggatctgtaattcttaagtaaaaggaatgaaatggtttgtcagatcttgactttgaagtcagaccattccacaggctcagatgcccctcttgctctgtcgtccagat

SEQ ID NO: 653324 - DNA, 1088 bp, Homo sapiens
  misc_feature (397)..(397): n is a, c, g, or t
  misc_feature (650)..(650): n is a, c, g, or t
aaaagtttactcccacatggattctcacaagacatattacaaatgacagcgctgaaaataggtagtcttggagcgatatgtcaaagtttcggctctacacttgtacccgttatatctggcagtgaggattatttgaaaatcacagaattatgcaccataatagaagtgtcacagaatcaggccactgtacttccatactactggacaatacaatataacggacactgtcatgcaccttcaaggcggtgcgtgtacaacttatctttgacaacattcacatatcatatactcagactagtgcaacacatctgacccagagactgagcatgttcggatttctatcaccaaagccgtctatatattacatatgtagcacgcatcttacgtattatcccantgcatgtgaccatgttgatattccaccatgcagatatattacaggagcacatgcatatagttctaacgtcataagcgtgctaggccgtcatagtccccagggtcattggtaacaataagaaaggtaacatcctatcagtatccacatactttgtgcgccagatatgatcttcgttgtaatattgacacatcttagaaaacgcacacatactacacctatacctgtttgagcgacacggatatctaggaggtgntcttagtaaaatacaagcgtcatagatgacacataaacgtcaagacacgatatccaagatggcacaaggttacaaacttatatgcaattagaaggcgaaaccattagataagaggctagaccacgtactttgggtacattagcagtgtcctcgatatgtatcccttaacaagacccatacgagcaattacacctttcgtagaaccacggatgcatagagacaagccgatttcacaaaggtaaaaccacctaaaaaaagaaccaagcgtaaaaggcccacacacaaactaggacaatctgacgacaccccggcccatagagacgaccgtgaccccgctcactaggcacagctcaaacccgacaatacccaaaagcaacccccacacacgcgagcacgcgcaaaatacaacgaaagccaacgcgccccagcagcgggcgc

SEQ ID NO: 653325 - DNA, 278 bp, Homo sapiens
acgcgcacgcgcgttcaaagttaagaacgggaagaatgggtggcacggtggctcctggaagagctcacccagcacagtctgccctgagctcggagccttggtttctagtccctggggcagatttatatttaactaaatttttactataaatacacagacgaaatagaacaatataaaatcgtgaggggttgggagaagaaactgtgaggaactcagcatggaagccagagcttggagaggtccattcacggccaacttgaccttcctccttgaccccc

SEQ ID NO: 653326 - DNA, 602 bp, Homo sapiens
tgcgtgagtgagaactgaaataaccattcactatttaagtggacatattcatgaatagaggatacatgtatccatggacaaaactgggttcagaagcagtggtaattaccatcaatactatgggatgccttttggaacttaaggatgggatacaggatgaccatgaaagctgtggttctaattctaacaaccgtagtactgctgagagcccaaatcatcaatcaaaacgcggaggaaatagcagcagggtggtcctacagattctgacttaacacccaggttatgtgccgagtctgattagacgagttgtaaataatgtgtaaccttgtgataaataatctcatactaaaatatgttgaagatgatatacgtcctttccgtcaatatacacttctgcagaatgttatacagtaggtgaataatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaac

SEQ ID NO: 653327 - DNA, 1388 bp, Homo sapiens
ggacgcgctgggtcgacccacgcgtcacgggacgcgtgggtttcctaacactcacaacaaaactaactaatactaacatctcagacgctcaggaccatcgaacccgtctgaccatatccgtgcccgacaatcatcctagtcctcatcgcccatcccatccctacgcatcgctttacataacagacgaggtcaacgatccctcccgttaccagtcaaatcacatgggccaccacatggtactgacacatacgagtacaccgagatacggcggaccataaatcttacaactccatacatacttgccgaccataataccgtagaaccaggcgaactgagacatcatagaacggtatgaacaatacgagatagatactacacgaatgagaagcgacaacgtacgataataataatgaacagtcaacgaagcaagatcttgacaactcaatgacgctggacacacaccaacatacaagacgcatataacaacaccaggagttgcaaagtataccaccgcggaacccacatcaacaccccacaacacacaccattatcagaccagagtaacacacgcagccgacacgagatactacgacaagcgggacccaaacagccaccagcaacatgtccatagtggggacaacgacacagacagcaacacaaagcgatatagcaattggcccccaaggtacggatcccagtaaggacaccgtcttcaaagtaaccacccactttaaacaaagttgcatttgcgaaaaacatataagagcgagcacaccggagaatagaaacacaccgtccgtacgccaaccccacgaccatccgaaagacacacgcgtacataaacaagaccacaacagcagatcaccgaccggacgcaaaaagacaaaaaaaaacaagagaaaataaaaagaaagaaataccacaaaacaaacaacggagacgacagaagccgacactcgcaagacacaaaaccacaccgcagtcaaggggaggacacaaacacagaacagcaggcagactacaacagacagagagaaatgtgaaagcacaccagaacgtcctccccaacaaaaacgaggagaacggagcacacgcaaacaccgacaccagacacgacggacacccagcccgatagtaaaagaactacggtccgaggacgtgagggcaaaccagacgaaatacagacgtggcccataaatgtcgacacgacgaactaattcttacattgaggaagtgacaaaaagttagtgaaaacatgtcattaagcagctactaagagcccaccgcaacagataaaacacagtagggatatagggtgaagaagaaaggaagagagaaggcacacaaaagcacagaacgaaaagcagaacttagcgagaaagcaatgg

SEQ ID NO: 653328 - DNA, 264 bp, Homo sapiens
gtcgactgttaatgttcagtgtcacagaaaacataaccaaacaactcccttcatacactgctggtaaatacacaagttagcatcatctttacggacagaaaaatgcatacacaaaatctaaaaataattgttttttactccttctcctagcaattgtactcaaataattatgaggatttttcagccggcattttttaatgatagtggataattgaaaaacatctcaaaatccaaaatatatggattaaataaagtgcgtcgacg

SEQ ID NO: 653329 - DNA, 232 bp, Homo sapiens
ctgaggatccctctcataccgatcaggtaagtgtggtggggtgagactcacggatttcagataaggccgctacggcattagccaccaccatgggattggaatctgctatgagatcccgtagagaatccagaaatcccggatcttccaccattggggcatggatatcatggagtttggccacgcagacggcggcggttttccgaacatagggatcctcatcggggtaccgagc

SEQ ID NO: 653330 - DNA, 217 bp, Homo sapiens
ctacgagcgcattatgctgtgtagttaacacttctgtagcaaagatggtggtagatatcttttagttactagaagttgcccttcaccatggctatttgaaaaggagatgtacttggacgtatcagtaaatcttgagataaactgtttggagatttaacctcctctctgatgggggaccaactctatggagattgtaaatacgttttatttataaacc

SEQ ID NO: 653331 - DNA, 108 bp, Homo sapiens
ctacactgaaagaacttagtgacttctaattctattcttatacaaatgttacataaatgtagtaagtttatagcacaatatcacatctgcaacaataacaaattgaac

SEQ ID NO: 653332 - DNA, 768 bp, Homo sapiens
  misc_feature (469)..(469): n is a, c, g, or t
acccgagaccccgttgagcaccagccctagtcccccgcgcggcccttattcgctccgacaagatgaaagaaacaatcatgaaccaggaaaaagtcgccaatactgcaggcacaagtgcgcattggtgtggaaaggaactgctcgccagaaagaagaaggtggttctatagaagctagccacgagcgaggatgacaacataataacttcagattctccttaaagaagttaggggtaacacaatcatctctggtcatcgaaagaggtgaatatgtttgacaaagccaaggcaacgagtgatccactttaactaaccctctaagttcaggcatctctggcagcgaacactttcaccattgacaggccatgctgagacaacagcaggctgacagaaatgctacccagcatcttaaaccagcttggtgcggatagtctgactagtttaaggagactggccgagctctttgccanacatctgtggattggaagagccccactggctactggacaggatgatgatatgaagttcccagatcttgtggcgcattttgatgaggccttcccagaatgaggcgcactgggattgagtccacttctggagattaacctggagaagttctgggagctgctattttatattatggctgccttttcacaacctttcgttctggtctcgctcctctgatttctatatttttagcccagcctgtgcctgggtctctcagtttgcttcccctcttcttgcggattcccgaaccggtccgttgccc

SEQ ID NO: 653333 - DNA, 865 bp, Homo sapiens
ggctatcccagtggattcaagcaagatgccaggaacactggcatagttttctattctccccatatccccactaacacacccgggaaacacacaacacacacacacacacacacacacacacacagttaatatagaaaaacacagtaaatatccaaaataaaactaaattcacaagttctcccacaaaatctcaaatatatccagcgtgtgtggggggaagtgcccaccatcaccaaccaagaccaatgtgaaatccaccaatcgtgtacaagagaagtaaaacggaagcaacagagctgtgtgatggccccatgacctcgcaaaatcaccaggaacgctcagtggcaccagcaggacagcagcagctgggctgtggcacagagttttcatcttctccatagtgggcaagtgtgtgaagtccatgcatgaaggaggacagggctgatgcgggctatgaactctcaaaaccccatgctagggagaacctatgggaaatagaatccaaagtgagcaggacaacgagcagggactacacactataagattcacgttaagcagtatctgacggggcacgcagatacaggtcttaccactccacaaacacagaacgagggagaggctaacagtcacgctactccaactcacgtctttctcttctaacaagccccgcgacaggcactctcatgtaaccacggagtcacacgccagataatctcggggtagtatcccataaaagagtagttattaacacacacagaggctgagtgccacggctcacaccgtgtaatcccacgcattgtgcgaggctggctgcaatgtgcacttgcttgaagttcagggcgttcaagactcgctgggtcaccag

SEQ ID NO: 653334 - DNA, 377 bp, Homo sapiens
  misc_feature (16)..(16): n is a, c, g, or t
  misc_feature (21)..(21): n is a, c, g, or t
  misc_feature (29)..(29): n is a, c, g, or t
  misc_feature (32)..(34): n is a, c, g, or t
  misc_feature (36)..(36): n is a, c, g, or t
  misc_feature (41)..(41): n is a, c, g, or t
  misc_feature (56)..(58): n is a, c, g, or t
  misc_feature (60)..(61): n is a, c, g, or t
  misc_feature (63)..(64): n is a, c, g, or t
  misc_feature (73)..(73): n is a, c, g, or t
  misc_feature (75)..(76): n is a, c, g, or t
  misc_feature (81)..(82): n is a, c, g, or t
  misc_feature (95)..(95): n is a, c, g, or t
  misc_feature (102)..(103): n is a, c, g, or t
  misc_feature (105)..(106): n is a, c, g, or t
  misc_feature (108)..(108): n is a, c, g, or t
  misc_feature (110)..(110): n is a, c, g, or t
  misc_feature (112)..(114): n is a, c, g, or t
  misc_feature (117)..(118): n is a, c, g, or t
tctgtatttgaccttntaatngcatgggnagnnntnaatanatggagaaagcaccnnncnnannctacactancnngaaannattccatcaagcntttacanngnnantntnnntanntacacaaagattcttgatcttacttgaagtatacatgagggaaagagccccctcagcaggtgttcccgttgcttacagaagcaaactaaaggacctaaaactggaggcaagccaggatgccaaaaagggggaagagaaatgataaagaaccattcataaattccatgtctacttcaagacatttgtctaatgacccttacataataagtattttagggaaaactaccacccttttaagataaaagcacaatcttaaaag

SEQ ID NO: 653335 - DNA, 509 bp, Homo sapiens
gcccgtcaggagaattctgaaaggctcaatatacaggaattcagagtaaaagcctcttatgtcttatttcgggaacaatggtgtattgtaacctagctttttcacatttttatttttagagatggagtttcactcgatcaccctaggctggagtgcaatggcgcagatagtcggctcactgacaacctcgagccacctggagtttaagatgattctcctcgcttcagcgttcccaacgtagctgggtattacagtgcacccaccacctatgcccagaccaattttttatgtatttttacgtagagacggggtttcaccatgttggccaggctggtcttgaactcttgacctcaagtgattcccccatcttggcctccccgagtgctgggattacaagtcatgagccactgcgcccggccacaaccaattttttctttgtttttctccactcccactgtttcacttgactagccttaaaaataacaatcaaaaacaaataatcttttaag

SEQ ID NO: 653336 - DNA, 164 bp, Homo sapiens
  misc_feature (74)..(74): n is a, c, g, or t
ttctgcggtcgacctctgacggactcccccgatgcgcctacgacgccttccgtaacgagcgcctccgtaacgangccgcctccgtaacgagcgctccagtctggtgcagacagggcgtgttaggagggtgttacggaggcgtcgttactgaggcgctcgttacg

SEQ ID NO: 653337 - DNA, 221 bp, Homo sapiens
ccacttcagagtagctggaggctgtgtcgttccttttcaaaattcttttttctctcaatctgtcttctcactttatttcattaagttgatcttcaatctctgatatcctttcttccgcttgatcagttcagctgttaatacttgtgtatgcttcatgaagttctcataccgtgtttttcagctccatcaggtcatttatattcttctctaaactggttatt

SEQ ID NO: 653338 - DNA, 282 bp, Homo sapiens
tttgtggcacgctgctccatctgcagtggagctgggccagcttgctcctccacgctgccaatcatctccttggatctagggcctgttgcattgcagtagcgagctttggcctcctccaggctgttctccatggcatgctttcatgctgatgctggtgactgcagctcaatctccaggtgctgcatgcagaaccgacctttggtctcctccaggctgtactccagtgatgctttcatgctgagcgtgggactgcagctcaatctccaggtgtaccgagctcga

SEQ ID NO: 653339 - DNA, 755 bp, Homo sapiens
tcctactcctcattggtagccatctctagtcggaatggcgtgcctagtgcttagcgaacgaggaacttctaggctatatacgactacgtcaaaggtcccaatggtagtaggtgcctacggggtactagaacccttcgctgacgccatgaaactcttcaccaaagagcccctaggacccgacgacatctagcgatcacccgtcctgacgatcacacgccccgaccctgttagggtctcaccgagtcgctgcgttctacctagtgaacccagccgtgggcccatactggcgaaatccctgggggtaagacttctctaatcgtgaggcgcctactaatactagttgtagtgcccacgtgaagaactagagcggttgtgagtctatcgtccgtcgtggattgcagggctgactagttaccacattcggacaagtacgcgccgtgcaatcgagccagcaaaatggacgaaggcagatgatccccaggaggcaaggcatggcgatctgtgggtcacgccggagcccattcattcatactatcaaaatattcgtaactgaagctggtgtcccttgtgagacgcttctttgcagacgctctgagtcgagcaccaaagaagcagacatttgtcctgtatttagctccctggtgcgattcatgcacgctcttgctggcgattacaatatgatggtagtcttcgccactgtttatgagtactacccaaccgatagccgctgcgtacaggtggaaacggaacccgaa

SEQ ID NO: 653340 - DNA, 462 bp, Homo sapiens
tgtgctcaggtctggatcagtggcctgatatattctacagaactctccacctgaaaacaagagaatgtacattcttctcagcgccacatggcacttactctaaaattgatcacataattgaaagtaaaacactcctcagcaaatgcaaaagagctgaattcataacagtctctcagaccacagcacaaatcatattagaactcaagattaagaaactcactcaaaaccacacaactacatggaaattgaacaacctgctcctgaatgactcctgggtaaataatgaaattaaggcagaaatcaagaagttctttgaaaccaatgagaacaaagagacaatgtaccagaatctctgggacatggctaaagcagtgttaagagggaaatttatagcactaaatgcctacatcaaaaagctagaaagatctcaaattgataccctaacatcatgactaaaagacc

SEQ ID NO: 653341 - DNA, 612 bp, Homo sapiens
ggagacctcatccacctggccagctcagacgtgcgggcaccacagcgctcagagctgggagccgagtcaccatcgcggatggtggcgtcccagtgcctacaacctgacctctgccctcactgcccatccatcactgctgctccctgcgtgctcaactgacgtgagcccctgaactgctggctgtggtgagtgagatctgttggcccatgtggcaatgctgctctgtgacccgctggagccgtgcatggtagcatatagtgcatgtgacgcccgcatgtggaccttgtgctagccacattctccgatccccttagggctttcatgcagtggcccctggccaaaccgtcagttgatgttggttgcatgcgtcatcgttatactgggatggacctcacaaatcccatttcgccttatgcggctagtatcacggcgaacgtacaacgcggttcatcacaacccaagggttgtgccctccggatagggcgggttcacatggaacacgagggccggggcaggcccaaagaagtaccccaatacgaagcggggactgggccttcaagaagctggcgcctccaaccggtgaaagggatgccccaaacaacttccgggaag

SEQ ID NO: 653342 - DNA, 372 bp, Homo sapiens
aacttgatgcctccccccgaccctagaggaaccccgccgcttatcgaagccattgttctgctcttcagcctgggcaccaaagaaagactctacctataaaaaaaaaaaaaagcctcccgcgcttttctgaaaaagagccccctcaggggcaattaccaatttacccgcctggaattaggaacccttaaagaaccactagaattgcctacccatggccagggctccctatatatggcacaaattcatacactcaaaacaggttacttcatactctggtcctttaaaaaaaaaagggagagatttggaagattgttttattttgggaactccactgtttgctttttcctaaagcttcacaaagcatatacttag

SEQ ID NO: 653343 - DNA, 145 bp, Homo sapiens
cgggctggggaagagggggcttacaaaggggctacactgaatattacgatgcagaaaaggcgaattgatacgaagcctgtccatcagcctgtctttccctcttccccagccagccctcttccccacgcccagggtacccgagctc

SEQ ID NO: 653344 - DNA, 188 bp, Homo sapiens
taggacagactgttgcagcggctgtgtagcacgacgtctgttgctcctcagggccactagccaggctagccgatttctgggactgttgtcgctccggctgccactcttccgggctctgctagctccctgcgaagcaggatggccgcgaccgcgcgcaccgcgtgcttggagctggcgatgctgctcag

SEQ ID NO: 653345 - DNA, 331 bp, Homo sapiens
agtttttttttcctttttaatttcattattttggggttttggtttttgcagtcccatttatttgcagtggtattaagtcctattgctagaataggtttctccaaaaaaggttatattttgaaagaaaaataactgcccttaaataaaacccctttatttaaaggtttgcccctttaaattcccccctgagggcatgtcctatgcagccatagatttttttgttcatttattttttttccttccagggggttgatttgataaaaaaatgggttgaattaccccctttgctggccatattatttaataaactttattcaaaattggggggcca

SEQ ID NO: 653346 - DNA, 610 bp, Homo sapiens
gagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttcttttttttttttattttgggggtgtgagatttatacatttataggcgcgcccatcggtctctcaaggcgttctctgaacagcctttaggaacgagtgcgagagaaagagagagagcgcgcgccagggagaggagaacaagaagatgaggattatttccagacagatggtctggtaattttcgggatttgggggactcgccaggggagcctttccgagcagcgtgcaaatagggggtctcttcatccgaaacacagatcgggaatacacgggtttccgattagacaatttttcttcataacaccagccccaaggggtcggaagctcctttaaattggggtacctctggtgggaccactttgagacagccaacaagtttggcggtaacaaacgccttcggtcccagtattctagaggagtatag

SEQ ID NO: 653347 - DNA, 1055 bp, Homo sapiens
ggtatcccctttatgtcctttctctatgggtcctttctgttctcctcctctgctttgcctgctcggggccagcgcctgcttttgtgcagcttccatttgttgggttgtcatctgttacgctacttggggcgcgggacgctcttggctcttgttcccccccggggcttctgttgcttgcgaatattttacgctgtggtgcttttcgagccattccttttctccccagaggggggctattcctcccggtgttttttccaagagttcattatttgtttcatgttgtcttctccattgttgcgttatttactcctaattcgttccagaggttccctttcggtaggctaatatgttggtttcaaattgttgccctcatgtgctcaagtgatcccttcactttgaacgcaagggtctctgcaatgcccttctgggtttggcatttggaaatggcttccatctgcaattacgcagcgaaggtcttggcctgttggtcgggccaccttgctactagctagtgtacaaggctgttcagtgtatgcacggctgcctttggtcgattccggtcatcgctgatgggaggaatccgaaatgtgggtcatattgcgaaagccttggcccttggggcactccacagtcatgatgggctcgtctaccgtggcatgccaccactgtaggcccctggtgcaatacgttcttttcacgatgggatctcggctagaagagaatatcgcggtatgggttctctctgatgccatggacaatgcacctcagcagccaggacagatatttcaagtgaagctgacaaaatcaaagtggcccagggagtgtctggtgctgtgcaggacaaagggtcaatccacaaatttgtcccattacctgattgctggcatccaacactcatgccaggaacaattgggtagcaccaagaggcttgacccaagtccgagccatgatgtactctggggagctttagtttgagaaggagaacgtcctcagcccaggtggaaggtggcgtccatagcctccattcgtatacgacgcgggtttctgtaaaaagg

SEQ ID NO: 653348 - DNA, 276 bp, Homo sapiens
  misc_feature (3)..(3): n is a, c, g, or t
acnctcaagtatcgcccacctcagcttcccaaagtgctgggattacatgcgtgaaccaccatgccctgccagcaggtagcttcttgatggccagggtggtgtcttcacctggaatgggctggaaccttggtggcatgatcatctgaagcttgatggtttctaggcgagagggcaatgcaattgggttcaaacagcatttcaatgggcaacttcagaggtggatcactcatgctgtcaggaagcagacccgcatgcgggtctcttcctggggtaccg

SEQ ID NO: 653349 - DNA, 347 bp, Homo sapiens
gctgttccccgtcgtggtgtggcgaatcgtgtagtgcacagcacctcgtggaaggccaatactactgctaccactgttttctcgacttccacttcctccactacttccactgtgattggctgtctccatagttttgatgttaccagaatggcattattgcatgtagccttttcagattgacttttttttcacttagtaaagtgcatttaggtttcctccaagttttttcatggtttgatagctcattgtttttagcactaatattccattgtctggatttccactgtttatttacccattcacctattaaggaacttgttggttgctttcaacttctttcaactata

SEQ ID NO: 653350 - DNA, 929 bp, Homo sapiens
tttatggtgggcgcgtcggaggccccactccagatttcaggacaactctagcttacttcctacctcattcccggcttccctcctccttccctgcagcctggttaattggatacctgcctcgtgtagcatgtgagcgtcaagctaaggcctggcagggtctgagtgggataccgatggtccccacggcgcaccaagattcgtcagcacgaagcagccaaacagcccctagggccttcgccccggtgttagaacagtagttgtatctcggatgacgcttctcgtctggcgcccacatgcccttctcgagccctgagtacttggattgcgcggcaatcgttatcgctagtccccttcttgcggtttcctgggcagccccgatgtatcctctctcacaccggattccccaaagtattgcttcggcgagcgtgctcgaatcgtggacgcgcgcgattgcaaagcgagacctcatgtctcagatatacccaagaacatagctttcccaagctgtccccaatcctagagatcgcattcctcactcaattgctgggcctagccaaagaaatgggaaaaggggcgtccacatacgggcgcaaccgcaagtcttcttaggccttggaagcgtgcgcgaagggcacccaacgtgtgttgggaagcgggtagggggcttaggcccatgggagttttccttactcctcgtttgcaagactaacaaatgaactaagttcactgatgaaagacctgaaacttctagacctacaaagggagagcaaagggaccccctggaatgtaaatgacttgtgtcctaacccttgaaatgagccgtaaagagccccatggacatacaggtggaataaccggttaaattgcccaaaagacttatggtagccaaggcccaaatgaaaggatagtataacaacacttggctgcaa

SEQ ID NO: 653351 - DNA, 408 bp, Homo sapiens
gtacgactatatatgatcctcggctgactacggcggaagggtgggagggggacaaggataaaaagctacaaatagggtgcagtgcgtactgctcgggtgatgggagcaccaaaatctcacaaatcaccactaaagagcttacccatgtaaccaagtaaccaaacaccacctgtaccccagtaacttacggaaaaataaaagaggaagacgcagctctgccttctctgcacaccctggtaatactaagaaaaatgaaaaccaaaaaaaaggaggccaagtttgacatcctgaaatttaacaggacgaggcggctaagaattcagccacaaaatagttcccggtgaagaagccgcgtttgctttgaaacgcggtaagaaatgcccccgaacacctgggcttaaattacac

SEQ ID NO: 653352 - DNA, 87 bp, Homo sapiens
cggcacgaggctagaaatcgctgtcgccttaatccaagcctacgttttcacacttttagtaagcctctacctgcacgactacactta

SEQ ID NO: 653353 - DNA, 200 bp, Homo sapiens
ataggatccccgtactgttaagtcagagagagaccacctagtgctcagtgtagcccagtgatgccctatgagggggccctctgacgccgtgctatcaccaccttacttgatagtcatcatatattggcaggtaatttctatgacggcaggtcaggtccaccactgacacgtatggcatgtggggacacggaaggccatgc

SEQ ID NO: 653354 - DNA, 326 bp, Homo sapiens
  misc_feature (241)..(241): n is a, c, g, or t
  misc_feature (302)..(302): n is a, c, g, or t
  misc_feature (315)..(315): n is a, c, g, or t
ctatcattgcctttcttcacagaactagaaaaatctactttacattttatatggaacgaaagaagagcccacatagccaagaaaatctaagcaaaaagaacaaaaagttcataatcactgggacattggagaaatgcaaatcaaagtcccaatgaggtaccatctcatgccagttaggaatgggtgatcatttaaaaagtcagggaaacaacagatgctgggaggaagatgtgggaggaantagggattgctttttacactgttagtggggagtgttaaatttgttccaaccattttggggnggcatgttgctgnttcctccaggg

SEQ ID NO: 653355 - DNA, 380 bp, Homo sapiens
aagcgcatgtgacagcaatgaggcagaaacttgtgagggtgcatagagactaggagaggccttacctgagtaagagatacagaagcggaaggagaggatctcacgcacagtaggctatgtacactcaacccatgctgcaaaaaccactctagactcttggaactcctgggacttgtacatacacagctcactcagacggctaaggaaagacagactcccaaaagatcaaactagctaaaagaagcccctctgccatcaccaggaagaatggacccgtgttggtggaatctggaggtatatatactgcagccctgtgccttgggcatcacctggagatgctgtgtagtgctgtcgtgggcgtctaaatttcttgaggccac

SEQ ID NO: 653356 - DNA, 124 bp, Homo sapiens
tgccaggttctctacctacctccatccattcactcctcctccaggaagtcttcccgggaaacaccagggacacaggctaccctaagttagacggccgcagccatcattggtgcttctggctctg

SEQ ID NO: 653357 - DNA, 758 bp, Homo sapiens
gcccaggtggagtgcagtgagccgagatcgcaccattgcactccagtctgggcaacagagtgagattccgtctcacaaaaaaaaaaggaaaagggaaaagaaaaataggcattaattaccttctttccttggttcttcaaccggccattgaaactttctgaacacttccaaattctcaggtggaattaattccaaacacaaaactttataaggtattacaaataatttttactccctttattagtaattaggtattacttttaacaaccgcctcagggggtatattaatcgtctcttaaacagcttacacatttcagggtgcagcttacattttaacccacacttaatgctccctctagttggagaaacaacttaggccatatttctcactgtgctgtgttgttagccctcaaggggccttaacaatgtggggtgccgaaataaccttattccggtagacatttacaccgtgaatttggtccaaacccaatacgttcttggatctctaccaattgggccaaaaatttcttcaccagggcctcgtgttactcccactgtaacctccctctgggacatctctgctccactttcattcttggaactctcctcacgctatatgcgaccgggctgggctgttgacctccagttacctgtagggctccctcagcctattttatacaacacgcctcacaacttttggcactcgatttcccgcaactttccttccccttttctccacgctactttttttccccttc

SEQ ID NO: 653358 - DNA, 452 bp, Homo sapiens
  misc_feature (29)..(29): n is a, c, g, or t
  misc_feature (69)..(69): n is a, c, g, or t
  misc_feature (95)..(95): n is a, c, g, or t
  misc_feature (416)..(416): n is a, c, g, or t
  misc_feature (418)..(419): n is a, c, g, or t
  misc_feature (421)..(421): n is a, c, g, or t
  misc_feature (423)..(423): n is a, c, g, or t
  misc_feature (425)..(425): n is a, c, g, or t
ctccttttggtgctaagctggctagtttntgggccgctgggtccagctccaagcgggcgggctcttgtnttctggtccccaggttggctggtctntgggttcctttttccgggctcttggtggggtggactttggtcctgggctccaggctaggccaggggccttcagggctgcagcgggtggctgccttcttggctgggcttctggggtggtggggccttctcagggcaggggccagggctggggttgggactggttttagagagagagttaacgtcggcagagcgggattggcaggcccagcagaggataacccagagcagcagcagcaagaagcccacgagaccgttgcagacgatggcgatgagggccccctgggagatggctgcccccatgacaggcagcaccctcaaaanannanananagtggagctgcctcaatggtgaggccc

SEQ ID NO: 653359 - DNA, 1027 bp, Homo sapiens
ggtgatgaggcagacccagcagattggaccatgattccttctgtgtcctttttacgccttcttggcatggtacgaataagtggttcaaaacctggcatgttctctggatttcgccaatgatccccttgtaacgatctgcgtgcctttatgtcctgccttggtggtggaatgcaagttttcgatgcctttctatgtctggctagtcttgttcgtcacgcatgtcctttgctctgtactacctggagagagttcctgtgcttactcgtttggaccatcgtcaaattgtagaacgcgtaaatctagtgtgccatgacagaaagcatgtcctggcttaggcgttccagcataggcaatagcctctccgtgtccacagctagggagccaacgaggagcacatgccgtccatggtgatgtgaccatcgcagtctacagttgccacgctcaccgtctgccccttgatgagtctgtggagacctggctctcagcaacggggcctatccttgagcctactggcgtccatgatgaatgctgaatgggccatcacttatgctgggtacacacttctctttacgagtctatctgctaacggcaatccttgggcacagcgtcggaggtctttacccagtggccccaggctaactctgtctcttgtttccactggagctattcggactactcttacacaagggagtatgatcttatttgaatcttctgcacagccgcgtagatacaagtcccatgtttgagtaaaacgggtttatatgcgttcctgaattacaaggagctcctcgtggaacgctcgtgtaaatatgtgtattattaattccactgtataagttgagatgtacacgtcattacctgtccccggcagcctgtgctctcgtgtatagggccataatgggattctgaagaaatctcgggagagggaaggggagttggaacaaaggtctgttacctggaggccagtccagtgctcagacctttagactcattgtaagttgccacataaccacagggaccaaagtgt

SEQ ID NO: 653360 - DNA, 291 bp, Homo sapiens
tccccttccaaattccggctgcccttcacagtcagtcatgtgatcatgtactcttgagcactgtttggcaggcctgagggtcgtacccttatcttccactgcctgtgtcagtgccgagcactttctagcaggagcttaatcagtgtttgttgaactctagatctgtggtcacgaacaagtcatggacgctgcaaaggctcctgccctttcaagagcagctgagatgaggccagccaagccctgggtggagggggccaagaccagcccagggcagcacaaaggggttgggtt

SEQ ID NO: 653361 - DNA, 465 bp, Homo sapiens
  misc_feature (12)..(12): n is a, c, g, or t
cagccccttacnaaaggtcagctagccccttgaggacatcagctttggcctcagggtcctaatggccagcagaacccactgacagagcttagaggagtcccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttgaaacacaaatgttttc

SEQ ID NO: 653362 - DNA, 459 bp, Homo sapiens
caggcagagcagcccagttagccagcaacggatcaggccgaggcaaatggagcaaccgcggggaaaaattccagacccgaccggcaaaccgagaggaacacgggccccatgcaagcaaaaccagcagcagggcaggctgaagcaggacaaaggcccgaaccatcgaggcggagaaggcagcgagcagaggacgcaccacggggccgaagccggagcgagacgagagaaccccactgaccgcgaagcaagggacaccgcgagagcggcacagactgaagagaaaaacccaaccgcccaattcagacgagcaggcggtaaccaacatggggcaacgccgagaaagcccccagaagaacgatgagaaacgcgctctaggaccccggaacgataaccgggcgaatcagaccgcccagaacccgactagaccccaaggggacgacagcgccccctccggggccc

SEQ ID NO: 653363 - DNA, 140 bp, Homo sapiens
aggatcctctgaggtggagtaattaggcgtagtagaagtagaggttacggagggtgatggtggctatgatggtgggtgttctgtcagcgttaggaaaaaatgacagtttaggtgtaaggaagatctcataatgagttttt

SEQ ID NO: 653364 - DNA, 216 bp, Homo sapiens
  misc_feature (137)..(137): n is a, c, g, or t
  misc_feature (151)..(151): n is a, c, g, or t
  misc_feature (180)..(180): n is a, c, g, or t
cggccgagctcgaattcgccgagatgtggtgctgagccgggtgccggagcaggaggaggaccggacagtgagcttgcagaatgccgcagccatctatgacctcctgagcatcacgttgggcagaagttctcgtccgncgtgctctcggagngcctggagcgagccatgatttttgttttnggagaatttcacctttggtaccaggtggccctctcc

SEQ ID NO: 653365 - DNA, 336 bp, Homo sapiens
tcgacggtaccaacatggtgaaaccccatctctactagaaatacaaaaaattagctgggcgtggtagtgcgcgcctgtaattccagctactggggaggctgaggtaggagaatcgcttgaatccaggaggcggaggttgccgtggagccgagatcacgccattgcactccagcccgggagattaagcaagagtctgtgttaaaaaacaaacaaacaagcaaaatacaaaatgtactgtatattggttaaagatatacgtaataaaggccgggcgcggcggctcacgccctgtaatccccagcaccgttgggggaaggccgaaggcgaggtggatca

SEQ ID NO: 653366 - DNA, 263 bp, Homo sapiens
cgactctgaggatcccgacaggctgcttcagcgcagccacagtaaaaccaatgacatcacgaactcacagctagcagttttgggtgggaacatataagctatttgtaaaacacaacattttcatcccacccttaacctgactcctttttttttttggagacagattctccttctggcccaggttgaactgcaggggcgtaatctcggctaattgaaagctccgcctcctgggtacacgcaattctcctgcctcagcctcccga

SEQ ID NO: 653367 - DNA, 617 bp, Homo sapiens
  misc_feature (21)..(21): n is a, c, g, or t
  misc_feature (102)..(102): n is a, c, g, or t
  misc_feature (115)..(115): n is a, c, g, or t
  misc_feature (122)..(122): n is a, c, g, or t
  misc_feature (135)..(135): n is a, c, g, or t
  misc_feature (138)..(138): n is a, c, g, or t
  misc_feature (144)..(145): n is a, c, g, or t
  misc_feature (179)..(179): n is a, c, g, or t
  misc_feature (230)..(230): n is a, c, g, or t
  misc_feature (250)..(250): n is a, c, g, or t
  misc_feature (254)..(254): n is a, c, g, or t
  misc_feature (275)..(275): n is a, c, g, or t
  misc_feature (284)..(284): n is a, c, g, or t
  misc_feature (286)..(286): n is a, c, g, or t
  misc_feature (325)..(325): n is a, c, g, or t
  misc_feature (328)..(328): n is a, c, g, or t
  misc_feature (444)..(444): n is a, c, g, or t
  misc_feature (556)..(556): n is a, c, g, or t
  misc_feature (607)..(607): n is a, c, g, or t
ttgttgccacttctccatggntcctgttttggggggctccaaacaagtgcagagaagctgccttttttttcccttccttttcagtttttgttgctgcctttnaaaatcaacttcntgaagtnacagtttttttancantttttnnttttttttccaggtgatttacctatttgctttcnaagaattgctcttccctaggctgcttttggtgttttgttcagttggttaanagataaaagctttcagttcntttnatttggtaacaggttcttttnttctttttntnttgctcaaaaaaaaaaagttattatcctaactcacaatntcnttactgagcaggaacctcctgtgacaggtgactaaagagaggcaagaaaagcaaattcagaattgtagagcagctcctaagagctgaaatttggtaacagagggaaaatgaaaggnggtaagatttccattagcaaatgattaaatcttaattaaatgagtattggaaagctcctagactgcataagctattgggagacacttaaaacattcatatacactggggaancattcactatgatatgtaacgttaagaaaaaaatttttttttttccatggnaaatggggtt

SEQ ID NO: 653368 - DNA, 972 bp, Homo sapiens
accacacggaatgttttttttgttggaggaagagggaggaggggcttataccagacgctcataagcaattttgagtgagtgaagagccatgcccagcaacagaggggagcctgcccacttggagcaaaaggagccggacaccagattcacccacggcgcgatcccggtgacggaggcagtgtgagcaggcaggcgggtggcactctggggaagggagaaggattgaaggtgaaaggggcacaaatggcctccagggtaacagtcctattagtgcctctttttctggggggggggaacttcttatcaaatctttcttgcattcccgtgataaaatgttttttaacgtgagctaccataaaaaaagcgagtaagaactaaaggaaataatatttcccccggctggtgtgtcctatacgtgtacggcctctcattagacgtcatacttgatcatcggggtttgtaccgaccgctctgttctacttctttattctggcatgcagagattggcacaccagttttactatatcacccgcgtcccccaactatatgtgagtctgcacgactttaatataggtcaatattaccgtacataatactcgatacctacattatacgatatatgtcacttcccgccccgacgccgcccttgatattcatctatgactattgttgcagtcttacatttataacaatccaccagatacagcttgctacacggcagtacatgttataacgttgttacgtagtatattgatccgagataggatattccaacgataatttgtggggcgcgcgagactgtgtttataccccgcgagtttagatatgagggttgtgtcgctaacacgagtcaacacaaggagttagatgcgtagattgtgtctgctattttatgatgtcagtactgcggtatcggaatcggtgtgcattattagtaagagatcaggacgctagcatggacgacgttacgag

SEQ ID NO: 653369 - DNA, 285 bp, Homo sapiens
  misc_feature (113)..(113): n is a, c, g, or t
  misc_feature (169)..(169): n is a, c, g, or t
  misc_feature (192)..(192): n is a, c, g, or t
  misc_feature (249)..(249): n is a, c, g, or t
  misc_feature (275)..(275): n is a, c, g, or t
gaaattaagactaaatgtcagaatatttacagtagacagaaaaaggcattaacacttgaaacattacagtatatcagagtgtaaagtataaaaaaattccaaagctgaaactnttagataatttctttctatataagttgaaaaggagtagctttttgaaattattccnttgaaattatactttttttaccngaaaaaattatagattttttgaaaagcaaattcaactctaaaattacttcatactgnttcaacttgttggttatatgaaagcntgtgatgaat

SEQ ID NO: 653370 - DNA, 882 bp, Homo sapiens
  misc_feature (857)..(857): n is a, c, g, or t
acagatgtgtataggattgttagggtatatttgttgatcattactttaatcgtaaatcgatgggaatatttgtgcaatatggattggagttctttaatttaaaatactggataccttgagattacatttccattgtcacagtgtgttaatctcatagtgggctgatgcagtttgttagattcaatttgggttgggacgtagggatgagctattgcgccaggtggatagacccagctgatggggtctcctaaggctgtatggctgttcctgtcagtcgactctcttggacatgagccgtacagtatcagcttccaacgagagcttaggcaataagtctagattcgcactgtaaggactcttatctgttgaataccttacaaacgtcttgttacgtgaactggagatgctcggcaataggttcctgttaatgaaacgtgctcttagctaggttggtatacgtcatcgttgtgcaagagccttcaacattactctctaacttgctttccaaattctgctgcaacggaagaaggccagtgtctacattgctgaagaagtgttaattgaaaccatagtattagtagaaactgatgttcacgaagtctttgggttcaagtgctggagacaagagtgaaaaactattccactttctaatgatacaattcaacacaggatatgatgaactatcctgcagacatgtgaagaccagctgattcaaaaggtcagagagtcaaagtggtgttgcccattcagatagatgagtcatcagaaattctgcagaatattcacaccttgttttgtgctatattcgtttcattgattatgatggtcgtgatgctaaaagaagaacgtactaatantaagcactgggatgcacatctcaaa

SEQ ID NO: 653371 - DNA, 183 bp, Homo sapiens
agacaccacggcagagcactttgtttgttagcatcttcataggctgacttggtaaacttagatagattttatagcgggtgcatacattaacttattacctcattttgttatttttcgaaacaaagccctgtggaagaaaatggaaaacttgaagaagcattaaagtcattctgttaagctgca

SEQ ID NO: 653372 - DNA, 1046 bp, Homo sapiens
ggtctgggtactggctgcagcatcatgaagctgcctgagaagagtttctgtatgtgcaatagatgaggataaagaatctgtggtatgattgatcttacacttcgtcagtaatgctggtagtcgtaggagcgatgagataaatgaataacaggcggtgagaaacgtgctatagtacgcagtaccgtcgaggtgtcagatccttgtagaggaatgcagtgtgataagtatatagaatagaatggcattggtcacctcaggtggacacgttaggtgcggctagtgatcttgtgcaactgcttgtacgttctagagaggacttggttatgcgaaagagataagaaaacacaacatagacataacaaacacacacaactctgcagggcgctccttcctgctgggcgcccgggcgaaagaaagagtgggcacgcgagtacccgcgggtacacgcgtgcccccatatagcgcgagccattgctcgcacgcgtacgacacactaagcgttttctctccagtcgcgcaacgacaacgtgcgtgggtgcaacgaactatctaatggcgggcgaagttcgtttgcaccccaaatatccttaaaggggctcggatttcgcctattgtgtctttctgtacggcacctaatagcagcaatcgcgtgtgtatgaacacccacggcgcgcgtatgcttccgagactacttacggcaacgaaacggccgtggcctggggcgacacatcccacgccgagtctgacccgggccaggggccacctacttcagccccccacggggaaacgaaaaccccaacgctcggcgacctgacggaccgcgcagaacatttgaacggacctcaggggcttagcgacccaccgccccaaacgaccaaggaaccaggggcccatctaaaccaacgcacagcccgacactgtaggcaccataccaacgagaccttacgctgggaccataccaagcgcccttcggccgaacagggcaactgcggcacaactcatcgccacaacgcccacacccttcgggacaagatcataccccatag

SEQ ID NO: 653373 - DNA, 969 bp, Homo sapiens
gcgtagcctggagggttggcagtgagactgactgcgtcggggtggagactgggtgagatggaggctcaaccccggacggtaagaatgggacgagagagtgggcgtgacagcgcgaaggtccgggagtgtccgccatatagtcgttcgaggtgaccgtcgcgtagttgtgagtctgtgagagaagatgtgtaagtatggcctcgtcccggtacatctggtgcgctgcgggtcccggagctgtagatctgctgcgttggtgctagattgttagacttgctagctcatggacgaatgatcgcaggagagctactgactgcgaccctgcatacgatcctcatcttgagtagatggactcagaacgtgatgtgatcacgcatacaacgcaacatcagtgcccggcagtaaggaagcaagagagtgtcagcgctacttcaggtgtaggaatacaacctcatacgatctgcattcttaacagcacgagatgatactaggctttgcagcgagctcagcttgcccccgtgatgccattgtaaggtacgcacgcacaatgcattggttataacgagtttcgcgtcagtcctcgaatccgtatttatctctaagtcaggcgaattcaaggtgaattcgcctctccataatccgtaacgcaaacatcgaccgtcgctcgctaagtcctctgtaggccttgtaacacaattggtacggaaggccacgtgtgcatctagcgctgtatgtcatattctaggtctcccgttggttgcaatgttaaatcgaacgtgtacacgacagaaacaacccatacacaggacccatgtgataaaggatcccccaattgaggtaaatgaccttttaattggaagaccaccgtgtccttggggttcaattgagcatacccacccatgcgtgtgagacaaatatcgggtcgtaagttcttataaaacgccattggcttcggaaacatcttggtgg

SEQ ID NO: 653374 - DNA, 252 bp, Homo sapiens
ctgaggcgctcgtgggtggacgggtccacgtagctgcgcacctctgttgggtctgacaggtggtcgtgcgtgtccttgttgaggtcgccacgctggtaagctacctccaggggaaggtggaagctcaggcgggggtccatgatgccgccggtggccagctgggcatccagcagccgtagggcctcctcagtagggatcagctccttcttcatggcctggaagagcgagatggtctgggagtcgcccttgcgt

SEQ ID NO: 653375 - DNA, 565 bp, Homo sapiens
atgtagatgtaataagaagagtcatggtcatatgtccgattgttcctctattagtacgggtgataagtttcagagtacgatagaccagagatcccaggaaaggttctagtgaccctagttacccatgaagccagtctttccttagactctgagctcctcaggctagcgctggtcccagtctgcacatctcagaccataccctcttcctatacaggaggtggggcaggctttcagccctcaggtccagtgtggggagcggcaggagcaggagggctgggatcctccagctgcacatcatgcaggtgcactgtgggggtggtggggtctttgcccacaccctggtttgggtcggcttggtcagggtggtgcctgcgtacgtgcttgaccacctggaactttggcttggccttgtagttgcagaggcggcaaaagaaggggtggcggtcggtgtgggtgagggcatgatggcgcaggccagcagcccagcggaaagcacggtggcacacattgcacacatagggtttggcctcactgtgcttgcgaaggtgggtgcgcagcaggaagc

SEQ ID NO: 653376 - DNA, 779 bp, Homo sapiens
  misc_feature (779)..(779): n is a, c, g, or t
aagcgccagctttccatttggggcatcttcctcctcggcactttctgtgcccatgtggcttagccaggtgcttacagtaatcactttctaaatggcttccatcttttgccatgcagtaaacatttcgttgtttatgccctcgaccacaagagacagaacactgcaatataaagcaatggcaaggttgttgttgttttttaatcacacggagtttgagaaaaaacctgcgtcttgagatgttaagacaatgcctaacaagagttaccattcccctcttttacagcgccagtttggataatatctcaaggcttaatagggaaggaaggtggcattgaaaaaaacaacatgtccacagcattacagcagcaatcctgtgtggcattttgggctcactcaagagtgtgggtaaatcctgagaatgggagccaaaaataaagctcatgaacctgaaattaccatgaaattctgatttaagaagtcctactatgaaatagtgatatatttcttcaacaaaatgcctgtgattcactgactgggataaacggtgcatttccaaaatacaactatgttcaatttcttaatttacctgatttccgaataaaaatcttcaaccattttccagaggataagctctcgttatcccagtccactgggaacaggtgaacacacggcacgtcagcaaactgaagggtaagctagccaggtaagtctgtgccaatttgcgaggacggcttacctttcaatttgatcgcagattccctggactgtttcaatgtgan

SEQ ID NO: 653377 - DNA, 245 bp, Homo sapiens
gatctatggcctctaagcactgctttaaatcatcacacaagtttgacatgctgtattttcatttttgtttggtttaaaatattttctaatttcccttgatgcatgggtttatttagaagggtgttttaatttcctattatctttctctaattatttctgttttgattctgttatagtcagagagcatattttgtttgatctgagttctgttaaatgtgtctctgtttgcttcataaccaggaata

SEQ ID NO: 653378 - DNA, 235 bp, Homo sapiens
gctttttaaaaaaacctttttttggctaaggccggggggcggtccctttggggcatttccgcccgggatggggggttaggtaaaggctggtccggggcggggccctttctttaatttggtttttttttttgtctgggggaaaacaccggggggctcctaaagggatttttttttgggcccctttttttttttttttcttttgaggtttttaattaaaaggtttattcccccttga

SEQ ID NO: 653379 - DNA, 1272 bp, Homo sapiens
gggcccgccgagtctgtggggggtgtgcctcgtgttgtggggcgcagttggcgccggtctccgttggttacggcgtgtgctttgtctgcgggtcttctctttttttcctgctgagttgtggtttgatcttgtcggtaggttggccctgtctgttgtgtgtcgagcggcgggggcccggttagtagatgtgccgggttgcactttttttatcgtgtctttgttgtgtgctccccggtcctttgtgtttctgccgcgagctggtgctgccggggattcaagtggttcgtgttgggggtgttgttgggctcttggtccccgtgatcgcggtgtcgtgacgtctggtggtctcctgggcgtttttggtgctttgtattgccgttcgttgtggcttttgggtttcggtctgcggggcttcggtcagtcttcgcgtgtgtctgtctcggctgtggcctggtcgtttgttgtggttgccgtggtgctgggtgtggttggttgtgtttgtgttcgttggttattggtgcgttcgggggtgtttttgcggttggggcttctgggtccagtagtttcgtatgttggcgagtgttgggggtgtcggggtgtcggtgcgcgacgggtagttggcgctgtagttacgtgtggcaggttggcgggcctgtgctgttctccgcttcctgtttagtgtgggtgccgcgtgattacaggtgcagtttgttgtggcttagtgttgtgtggaccttgttatctcccttggggggagcaggcgcttgttttttgttgtgtgttcggtatgtgccgttgcagtgcctgtcatggtatgttgtgcctagacccgtagatttgtgaagggactcctcttgttcttctgttgtacgtatgctccctgaaccagttgttcagaggaccgatgtcacatcgcgttcatgggcatggtcccatggagcatctgggtgatatctgtctacagtgttggctcttctgcgaggctgatacacaaggcctctcttccacatgatcatgtgtgcttacctcccccagcccctaccatccaatgtggataggatattacaagtaactgccgtgaagtagagtccatagtctacagagtacatcagcgtgtgcattgcggctgtcaccttcctcgctcccacttctgtatcctcagagatgctgcgtggatgtttccttaacctgcagcatgacttccctgtgaatgtctaatgctagttcaggtcctccaggcattgatttgtacagttaaactccgagtgagcc

SEQ ID NO: 653380 - DNA, 119 bp, Homo sapiens
cctagatttatctatgaatatcctcagactctggcgagacttttgaattcataaccaagccaacatctccagacatgtaaaaatagggaaaagtgattcaaattgaaaaagacagagaa

SEQ ID NO: 653381 - DNA, 193 bp, Homo sapiens
taaattcgcggccgcgtcgaccaggcttatgcggtggagaatgttttcatgttactcatactaacattagttcttctttagggtgatagattggtccaattgggtgtgaggagttcagttctatgtttgggattttttaggttgtgggtgtcgagcttgaacgcttccttaattggtggttgcttttaggcct

SEQ ID NO: 653382 - DNA, 284 bp, Homo sapiens
tgaagccaaaggactcgttgacgggcagataggccttaccacaaacatgggtggtgcggccacctgggactcctcgtaacactgtggccccgtcttccatgttcaaagaccccggtagcatgccaccagaccacctagctctaggacagctggcatctccatcaagtgtagcatgggctcacatggaggctgtggactgggtcggtctagcacactgcgcatagtaggcagcgcccgtgctgtgtgggatgatctcggccccgctctcgcggtgtgatacgcgt

SEQ ID NO: 653383 - DNA, 180 bp, Homo sapiens
gaggtgatctgaggatccccgggttctattaaaaatacaaaatagtcgggcatggtggtgcgtgccttgtaatcccagctactcaggaggctgaggcaggagaatcacttgaaccggggaggcggaggtggaagtgagccgagatcacgccatggccggacaggggggccgggccgcggg

SEQ ID NO: 653384 - DNA, 123 bp, Homo sapiens
aaggaatcgtgctggtgctaaagccagatgttcagtgtgatcttctgggcttagcttgctgagcttgtcatggggaggtgtgctctgctctcaacctctgcgtagtctctccagtaagcacct

SEQ ID NO: 653385 - DNA, 383 bp, Homo sapiens
gcgatatagagagagagagctatctcagaatctttgtttcatggaggaccacatgtgcgcctatactagctgcgccattacttgggacttaggattcgcgaccagtgagtggccctgatgccgcatcgctcctgctttacagcttggccgatggataactcgcccagatgaccatcgagcatctaggactggatctccgactagctgatggactggctggtgcagacgaccgccatgccgaccaccatctcacattgacagagcatgtgccagctgtgcgtgttcagcacttccggttttctcatgagagccgcactccgtattgaccttgcgctggcgcttcaggacagagtgctgctagagctgggcccggctatagcccc

SEQ ID NO: 653386 - DNA, 281 bp, Homo sapiens
  misc_feature (269)..(269): n is a, c, g, or t
gacacctgttcccgaagccctgtgagctgatggactacgtaacctctgggtcgcaatgctagaataaaatgcatggacacttgttccaaaacgatggagggacggtgtgggaaacagccccagccctgtcgactgagggtgaatgcacgagtgaaagtgacaatacatgggtaaactgaggcaggcgcatcagccgtagaggagagaggatgaggttccaacctggggtgtaagagaaacaagatgctacaggagcagaagggccatcngctgtgctaaga

SEQ ID NO: 653387 - DNA, 134 bp, Homo sapiens
  misc_feature (1)..(1): n is a, c, g, or t
ntctacggtttctcagaaataatcaatctttcctggtgtagtaatagaacactatgactttaaccttcatttataatcacttaataataaatagaacatcccaggaatagactcccaaatcttatcactttttc

SEQ ID NO: 653388 - DNA, 1668 bp, Homo sapiens
  misc_feature (1668)..(1668): n is a, c, g, or t
ttaccatcttcgcaggcacactcatcacagcgctaagctcgcactgattgttttacctgagctaggcctagaaagtaacacatggcgtacgcgtttccattgcccagattctgaaccgagacagaagataaagcccgtcgattgccacagcagagactgccatgcaacgctagttatccatcgacggcaagactagatgcgcatccatacagtccttctgaataggctatcctctgtcaaccagatatagctcttccgtgcacgaagtgacaccatgaagccgaataactagcgcaatgcagatactcattcattacataatcatgaagtggctatagccaatagactagctaggaatacgcccccatattcacttgctggagttcccaggaggtgtaccccaagcggcaccctcctctgacgatccggaccctgccttcatgtgcgtcacagtgatcaagaaagctaggacgcccaatcgtcaaatcgaatagtagcgcaagaagtcgtacttcggcgtacaccttacaagcgttgagagggcctgtgcctcaccttgcgaacgtctccttcaaaattcgtgtagtcccattccattacggcaaggtccaggtctggacgcggtgggacttgagagatccagagaccgccaggcttagcgtcggaaagatctttagccactaacttccgttccacatctgacctccaaccatttacgcagttgacctttacttacgccagactttctttaactcgggcaccatatctcccgttagacaccttcaaccagttttcttttaaacttctcaaccttccttcccataatattaatccacaacctctacaaacccggacattcccctcaaataaactccaactttaagaagattccccaattagccccacggaaggaccctattatataaataattatcggcgacccccttaacaacacagggctctacgccgtcttagcctaactaaaccccccttataagatgtcccatctgcaaccaccatccaatttcccccaacaagaggaagcagatcccctccccctcaatacagcgccttcttattctcccatatttaggcgcccgactataactaagaactaacagcatccaaccaaacaacaatcattctcaccatattacctccatcaaaatttgctacccacaacacaccctcctctctctgactaaatcatttagaacgacgcaacaataaactacatcacctaccaccaaacccccccccttcacaccacccaaccaacacacaccgccaccaccacaactactccaacacaatcatccaacacactcaccgcactcagctcccactacccactgacctcaccaatcatcaacacactcaagaaccacaccacaaccctacccagcacatccctccactcaaactacacccaccccacgcactacaccccccctctccaccactccacgccttcaatctctatgacctcgcaactaatatcacacatacaacatagactcacccaggcactcctcaccacacagacccctaccgacagcactagaccaacacaaccctatacagcctctgtcgctactatctctcatcctagcttcctgccctcttctcctcagccgtactctactcccgctatcgctctcatctcan

SEQ ID NO: 653389 - DNA, 118 bp, Homo sapiens
agcggggaacaatcactttagttcaggatggtcaagtgatggtcaagtgatggtcaagtgatggtcaagtgatggttcaagtgatggtcaagtgatggttcaagtgatggtccccgct

SEQ ID NO: 653390 - DNA, 359 bp, Homo sapiens
ttcacttcactatatttatttatatattaatggcgtctcgttctgtcgcacagtctgaagtgtaatggcatgatctcagctcggtacaacatctgcttcctgggtccaggcaattctcctgcctcggtattttatagtagagccggggtttcaccatgttggccagcctggtcttgaactcctgacctcaggtatccacctaccttggcctcccaaagtgctgggatcacaggcgtaagccaccacgcacactgtgattaagtttttaaatacaccctttcatatgtcagagacgaggtaaaaggagagtggtacgcgagaccccacctttaacagtatcctcgcgtgccgtattcgta

SEQ ID NO: 653391 - DNA, 208 bp, Homo sapiens
  misc_feature (47)..(47): n is a, c, g, or t
  misc_feature (57)..(57): n is a, c, g, or t
acactcaaactccgggccacaggaggaataggaccagcccctggacntgggccccantcgcccctcagagccgccgctcggatgaaaatcgggcggattgagggatgtcacccccatccctttgacagcactcgcaggaaggggggtcgccgtggtcgccgtctgtgaacaagattcctcaaatactgttaataattgcccttcatgt

SEQ ID NO: 653392 - DNA, 1137 bp, Homo sapiens
  misc_feature (357)..(357): n is a, c, g, or t
  misc_feature (430)..(430): n is a, c, g, or t
tgtggtttatttagttttaatttcataaatccataaaatcttaatctccggcaacccagtctaggcatgtgggaggagaacaaggaaaaacatgtggacacccaagaagggaacgtgcaggcgagaagcacaaagaattctaaggaatacgtgcgagccaaagtgggggtggacgggggtgcctcctccgtgagcctacagaaaggaaagtgactcgtgggtggttataaaatatataacacacaatgtctcaaacctttattctcgagtgtgtgctccaccagtctcagccaatgtgggtgactcttctctgtggcgcgtggactctgtgtggccattctccgtggacaccacaanagggcgcctccatgtgtgcctctccaaacatatatattctcattgtggccttctcttatctcactttgtgtgncacaaaaaacacccacacatgtgtctgtgtgcccatctcacaaaaccacctctcacgtctctgtgtgtgacacgtgtgcaccaatattaataaaacagtgtcgtgtgagaaacccccattgtgtcgtgtgtgtgtgtgggtctccacacgcacatatgtgtgcgcacatgtgtgacacaagatatgtgctccaaaggtatcccccgtatatgtgctcttttaggggaatgttagaaagttctctctacatatctgtctacacagattttttctcttcccccatatataatgtcggcacctgtgtggcgacaacccgagtgtggcccactatatatgttggggggtgtgtgtagaaaggtctctaccacaacgctgcgtgtgaacacacatttatagacgcgcgtgggggaatataaaatctctgtggtagaaaacgcgagggtaaacccctttttaattatacccaaaattcgctgttctctctcctccccgagggttcgctcaagaaaggcccgcggcacacaatattttccggtggcgggggggcctatgtgggggagaacccttgtgtgtctgttgtgaaaaaccgaggtgtctccaaagaggggagaaaccggcgggggccccccaagggggtggctctcgaccccggatcagcaaaccgggggcacaagtgtctcctgaaagaaaaccaccggggtgggcgg

SEQ ID NO: 653393 - DNA, 411 bp, Homo sapiens
ttccaggttaatgtgtccctgtatattacatcccctaccccgagcacacgactgcacattctactcacttgggtctcgtggcactgcaggaagccatccatgacctatggtgtaacctgtgcaccgtgtaaagtggggcgctcctgacactgcataagggaggggtgctgctcgaagccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggtcactaaggtgcctgctagccattgtataaaattaaaacatgaagaat

SEQ ID NO: 653394 - DNA, 313 bp, Homo sapiens
cccgggggggggggggggtttcccgcgccggcgccccccccccccggatttgcctttttttaaaaaaccccaaaggggggttaaggggggggcgcccccaaattaattaaccggaagggggggggggggcgccttttttgtttttgggggggggggggggggttttttttttttttaccctttttaaaaaattggggggtttttttttttttttggggggggggggccccccccccccctttccccctttccccaaataaccgggggggggccctttttttttgggtttttccctggtttttttcccccttta

SEQ ID NO: 653395 - DNA, 384 bp, Homo sapiens
  misc_feature (84)..(84): n is a, c, g, or t
  misc_feature (119)..(119): n is a, c, g, or t
  misc_feature (166)..(166): n is a, c, g, or t
tggaatctagcggatccccatgctcatccctccttaagaaatatgtagtcacctgaaccccaagtaaagaattaaagggctggncacatggactcgcacctgtaatcccagaactttgngaggccgaggccagaggatctcttgagcccaggagttcgagaccagnccgggtaacatagcgagagcttttctctacaaaaaaataaacaaaattaactgagtgtcgtggcacacacctgtagtcctagctacttggaaagctgaaatgggagaattgcttgaggtcgggaggtcaaggctgcagtgagctgagatcatgccacttcataccagcctgtgtgacagagcaagactgtgtctccaaaaaacaaaacgggtaccgag

SEQ ID NO: 653396 - DNA, 1186 bp, Homo sapiens
ttgagcctgagaagccgaggcgctgcgcgttctgcccgcgagctcacctcagagacagtcgcttccgcatccagtccgagggcgtgacacttgttacgcatgcaggcgtcgtcacccagtggaggcaagaacacgtagtcctcgctgcctagccagtcgagcccacgcggcggaacggtcaggaggtactgggccgcccacatgaggctgtcattgccactcggatctcgaagctgcgtttcaaggagaagcttggcgagggccagtttcggggaggtgcacctgatgtgaggtcgacagccctcaagatctggatcagtcttgaatattaccaccacttaatgtgcgtaacgggacaccctttgactggtagctgtcaagatcttacggacagatgccaccaagaatgccaggaatgatttcctgaaagaggtgaagatcatgtcgaggctcaaggaacccaaacatcatacggacatgctgggcgatgtgtgatgcaggacgaacaccactctgcatgattactgacatacatggagaacggcgacatcaaacagtacctcagatgcccaaccaagactggaaggacaaggacaagaccgaggagggcaccccaggggcacagcgagcaaggctgcagacacgagccccaaacatcagacataaccaattgctggatgcactgtggacaagacaccaaatcgccatcgagcatgcgcgaacaggacaccaacacacccaaagcaacatcgagagacacaggacaagcagggaaagtgcccacaaggggcaaaaaacgaacaaccaagaacgggaacacggacagacccacgaaaccaacaagcacggagagaagaaccagacacaagaacgggacaaggggcacgcccactcacgcggaaaggcgacaagcaaaagggatccaccaaacggcgaacacgacggcggccacagaccagaggcgacaaaaggaagaggaaacggggacgtacacggtatagagcgcaacgctatgtggaagaacgagaagaagatagaaaggagagaagaagaagaggacgaatgaggatagagcacagagtgcattactacagaaaagggaaggaagcaggagaacaaagacaaagcggagggaggcagagaggtcgagagaacaaaagagggagaccgggacgggacgacacag

SEQ ID NO: 653397 - DNA, 91 bp, Homo sapiens
catggatttgctggtgcagtacaactaggcttaatagggactcgaattcgagcctgaattcgagctcgaattcgagctttcaaaaaaaaaa

SEQ ID NO: 653398 - DNA, 198 bp, Homo sapiens
gatcaagtgcccacagtttgtttatcccttaccacaatccaatgaagtcagggattaccccagttctcagatgagaaaattgagtctcactcaacattggactatttgtaaccttcagactcgagaggaccagaggaatcttagaggagtagaggtcgcatgttcatcttcatctagaacttagatatcaagtctcta

SEQ ID NO: 653399 - DNA, 379 bp, Homo sapiens
acccccaaacaccggaatctcttgcccagcaaccttttgcgttgcatgtctatctatccagggtacggtgcccccacatgcaggctacccaactggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctggaaggcagtgatttagaccttttgagaataggacacttggcaggagggaaaaggaagaggacaaaggagggtggttggccaaagtggcacagctctgttgctgtttaac

SEQ ID NO: 653400 - DNA, 995 bp, Homo sapiens
  misc_feature (304)..(304): n is a, c, g, or t
  misc_feature (322)..(322): n is a, c, g, or t
  misc_feature (353)..(353): n is a, c, g, or t
  misc_feature (356)..(356): n is a, c, g, or t
  misc_feature (366)..(366): n is a, c, g, or t
  misc_feature (422)..(423): n is a, c, g, or t
  misc_feature (426)..(426): n is a, c, g, or t
  misc_feature (431)..(431): n is a, c, g, or t
  misc_feature (434)..(434): n is a, c, g, or t
  misc_feature (448)..(448): n is a, c, g, or t
  misc_feature (468)..(468): n is a, c, g, or t
  misc_feature (470)..(470): n is a, c, g, or t
  misc_feature (473)..(474): n is a, c, g, or t
  misc_feature (489)..(489): n is a, c, g, or t
ggaggcgcgggtggggaacatgtctgagtcggagctcggaaagaagtgggaccggtgctctggcggatgcggtcgctgaagcataggctactggcttttggcagttaggaattgattcttctcacttaccttctttaaagacgaagaatgtgcgccattagccgtttcggattctggcatgggattgaggagaatggcttattccaaactgtcagtatgatttccaggctccatatcttctacacggcaacacatatgtcaaagatgctaggaagcagtgactgtcacctgagaacatcccagngggaggacaagagaaatnatgtttattcctcaggaatactgaagtgccntgnagtaagctgncattcttctgtaacaatgttatcagtaatgctttaaactccagcacctggttatgnnttngaaancangtctgtttcttgtnttgtattttctctctggaantngtnnggaggtggtcttaantaaattaaacaagaaataggaaataattaaaaaaacagaaagaaagtaaaagctgcctgcattggcatttggagtgacttgaattaagtaaggggaagctgaggtaggccattcagtttctggctaacgggaggagggaaactagcgagtttagtgcaggtaaaaggggagtaaatatgggactctcacttttaaacttttacctagaaattatggatgaaaaaaagccaagctcggtaaaatactggaagagacttggttctggagccacttgtgaggaccgtgacccgtcacagtggcctcgggaggtcctattaacattatgcctaggggtggttgggttacagctttggtttgacatgtttaagggagacctaagacttcagttcaacatacgtagggtgatacagtgattgggtccagaagggtaggacaatttgaaggcaatgtggcgtgggtggggagtcataaattctcggatggacgatcagttaaaagtgatatta

SEQ ID NO: 653401 - DNA, 394 bp, Homo sapiens
  misc_feature (12)..(12): n is a, c, g, or t
aagccccggcgnccattggtccctacagtcaagctgtgcaagtggacaggaccatttacatttctggacaggtaggcctggatccttccagtggacagcttgtgccaggaggagtagtagaagaagctaaacaggctcttaaaaacttgggtgagattctgaaagctgcaggctgtgacttcaataatgtggtgaaaacaactgttttactggctgacatgaatgactttggcactgtcaatgagatctataaaacatatttccagggtagccttcctgccagggctgcttaccaagtcgctgctttacccagaggaagtcgagttgaaatcgaagcaatcgctgtccaggggcctttcatcaaggcatgactataagtagccatgctgatgtt

SEQ ID NO: 653402 - DNA, 106 bp, Homo sapiens
  misc_feature (4)..(4): n is a, c, g, or t
  misc_feature (11)..(11): n is a, c, g, or t
atgntacttanggagagaaggaagagaagtaccgagggcgtctttgatgtgtagtaaggctggagcgtaatggcgtgatctcagctcattgcaacacggtctctca

SEQ ID NO: 653403 - DNA, 306 bp, Homo sapiens
  misc_feature (34)..(34): n is a, c, g, or t
ttagaggatcccgggctcaggtgatcctcacagncactcagaggtcatttcatttatttatttatttattgtggagacagcattctcactctgtcacctaggctagagtgcagtggcactatcacagctcactaaagccttgacctcccaggctcaagcgattctcctgcctcagcctcccaaatatctgggactataggcaggtgccacaccataccaggctactttttaatttttttttagagatgaggtctcaatatgttgcccaggctggtcttgaactcctgggctcaagcaatcctccca

SEQ ID NO: 653404 - DNA, 335 bp, Homo sapiens
  misc_feature (248)..(248): n is a, c, g, or t
  misc_feature (256)..(256): n is a, c, g, or t
  misc_feature (317)..(317): n is a, c, g, or t
aggggacacctgtggagggcatttcccgtgggcccccgagacccgccaagagggaggaagcgctgctgggcgccctctaaccgcccacggggagctggggccatggaggggacaggagtctttgtccctgctcagcccggaggctgtgcacggccctcgtcacaaggagacccatgcagcacaggccgcgggggccccaggctcggctcaggtcttggaggccaagggcatggcttccggaagtgggnggggaggngaatgttaaaaaaagatccaaacggccccagcaaattcgggagattccacccctgagaaanacaatgtgagaaccgcca

SEQ ID NO: 653405 - DNA, 124 bp, Homo sapiens
  misc_feature (71)..(71): n is a, c, g, or t
  misc_feature (122)..(122): n is a, c, g, or t
atctagagatctcctgagaagagtgtgcaccaaccactattattctagatattacagcactcagaaagaancctataccattagcattcactttccattctcttcttcccctaggccttggnaa

SEQ ID NO: 653406 - DNA, 173 bp, Homo sapiens
tagtacggcactatgagaaatcttattaatgcttatttgccatcatgaaaccctagggtccttaagaattatgctaagtctacactgcctatgctctataaatggaacaacaaatcctggatgacagcacacctgtttactgactatcttaagcccactgttcagacttactg

SEQ ID NO: 653407 - DNA, 129 bp, Homo sapiens
gctacctcgctgggaccctggtcttgctggcccccgctggcctcctgcccaagcgactgcggccaggatggaccggaaggcgctcgcggccacgtgtgcactcaaccagggggccctggacttctttgt

SEQ ID NO: 653408 - DNA, 497 bp, Homo sapiens
gaagtaaccagagtgctatgtctgcatgctgttcagtctcctttgggaaggtgggacataaagtcattggtatgttatttctctcttgcacagcctaaaatgaccaatgtgtgatttacacggtggacactacacactggcgtccaaacgtcacacgactgctactacgtctggtactcaacaacgacacgacttggacgcactactgactcacaccaacactatctgggacacacacactcgtgttggacaccacgacgacgaaacactcacacggttatactctacacacccttgtggtgctacacgggacactacacaccgcacacacgacacacaccacgccaccacgtgtttgacacaccccacggaccccttcaactacgcactgattggacctctgtgttacacgacgggcggtcctggcaactattgccacaaaggggccaacaacgcccttgaacagcgtcccttgggggaccttttcctcctgaacc

SEQ ID NO: 653409 - DNA, 335 bp, Homo sapiens
  misc_feature (267)..(267): n is a, c, g, or t
ttttgtccaaataaatgggcaatttttccaatccttgaaaaaaaaaagatgcctaatgaatttccagttttggtgttggtcctaagtagcccaaatgtattttatttgacctatttggagcccagtactcataaactgtggcagacttagcatccaatcacaattcctgagttttaagtaattttataatacgggttgaaggacaaatattcaaaaatataaattgttccttcttttgttattgtttacaaagttattattccacanggtaaaggatgaagacttttagaatcatactcatggagaaacactttctaattaagaacatataattc

SEQ ID NO: 653410 - DNA, 2732 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacggcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 653411 - DNA, 218 bp, Homo sapiens
actttccactcggtgatatacattttcacttcatcagaagcacctatatctacagctcatttataattgatactgtgtcatgaaacccaaatgagcccgacaagttcctataaacaaagcttcccatgtactaggacagtcagtaatttatgcctcattcagaggattatggctgttccttaagaagtgcaagttcaaacctatcaaccagtgtatat

SEQ ID NO: 653412 - DNA, 517 bp, Homo sapiens
  misc_feature (76)..(76): n is a, c, g, or t
tcggctaacggtcgcctataaaaaactatcaaaaattccaatagacggccaggcacatatggctacacacctagtnatacccagcacttaagggaggctagaggccagcggatcactaggaggccaggggtaaagagaccagcctaagccaacataggtgaaatcccatactactaacttaaaaaatagaaaaataagctagggctagtaggcacacacctagcaatacccagccactccggaggctgaggcaggagaatagcctagaaccagagaggcggagataagcagtgagctagagaccataaccactagcactaccagcctagggtgacagagtgagactactgtttcaaaaaataaaaactaaactaaaaaatattcaaagagccagtagacctagccactcaggaagtaaatagaggcagaaggatacccataggcacaggagtacgagaccagactgggcaacataactgagaccctaactcaacaaagaaaaatatcaaagaggtag

SEQ ID NO: 653413 - DNA, 3682 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
  misc_feature (1866)..(1866): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaaggtgggcctgggcctgggtcagggtccatcaggaggagggtgctggcagggctggccttgccctgagctctgctccgccancagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 653414 - DNA, 240 bp, Homo sapiens
ctaatagtccttcagtgcataatgtctgtctacaacgtggacaccaggtaggctagtgtcaagccagagattcggggcagatagataaatgttcattttactgatgcactttagttttatgggtctgttacctggttttccaggaaagtttgtcgtgccttttaggacgggaggttaggctgaccaagaccagatgtagagccccaaatccctggcagatatgctggcttcaaggtgtgg

SEQ ID NO: 653415 - DNA, 2099 bp, Homo sapiens
  misc_feature (335)..(335): n is a, c, g, or t
  misc_feature (354)..(355): n is a, c, g, or t
  misc_feature (369)..(371): n is a, c, g, or t
  misc_feature (373)..(374): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (399)..(399): n is a, c, g, or t
  misc_feature (401)..(403): n is a, c, g, or t
  misc_feature (416)..(416): n is a, c, g, or t
  misc_feature (436)..(436): n is a, c, g, or t
  misc_feature (473)..(473): n is a, c, g, or t
  misc_feature (475)..(475): n is a, c, g, or t
  misc_feature (508)..(508): n is a, c, g, or t
  misc_feature (536)..(537): n is a, c, g, or t
  misc_feature (541)..(541): n is a, c, g, or t
  misc_feature (550)..(550): n is a, c, g, or t
  misc_feature (555)..(555): n is a, c, g, or t
  misc_feature (564)..(564): n is a, c, g, or t
  misc_feature (571)..(571): n is a, c, g, or t
  misc_feature (576)..(576): n is a, c, g, or t
  misc_feature (584)..(584): n is a, c, g, or t
  misc_feature (590)..(590): n is a, c, g, or t
  misc_feature (602)..(603): n is a, c, g, or t
  misc_feature (605)..(605): n is a, c, g, or t
  misc_feature (607)..(607): n is a, c, g, or t
  misc_feature (615)..(615): n is a, c, g, or t
  misc_feature (645)..(645): n is a, c, g, or t
  misc_feature (660)..(660): n is a, c, g, or t
  misc_feature (665)..(665): n is a, c, g, or t
  misc_feature (680)..(680): n is a, c, g, or t
cagagctctctctgctgggagtcagtcggtgctggggcgaggggaggcagagctcacagagcccctctacagctcaccctgcagctcggccctggccagtaaacccaccatccccctttctgccgcagaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagtgaggcccggcccgcngcccccagctcccgcggtnnccccgttcccgctnnncnncaancctaaanancccaactcccanannncccgcaccagcanccccccgccacacagcgcgncaggaaaccgcagccgcgccaggcccggcccaggcangnaaggggagggcggaggcaaacaccacacaccgnggccacagggggggagaggggggcaacnncacngagggccangggcngcgcagggnggcaccngcagnccggcaanggccangccagcagaacnngngngggcccangaagagccagacccaaaaaccccacggganccgaagcaccgtccnggtanagtgagaagactgcnggtgtccacaggctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 653416 - DNA, 160 bp, Homo sapiens
caggataccggggcgtatcacatcattccgtggtcttcgataaccacctttgctaactttgtccgcggcattggttcggtggtggcaaatatgatgttgatcgccatgaagatgctgataaagccaatcaggcactgaaagatgcggtagggaattaatg

SEQ ID NO: 653417 - DNA, 1163 bp, Homo sapiens
atgagcatggagtggggtgtggttagtagctgtgcaggaagcttggatgatcgggctcgctcataggcaggactgacatggatgatgcccacaagttcatggcttttggggggtctgaggtgtgcgggcgatgcctagttcactgacaatgggacgatgctacggatggaagaacgagagagagtgggcttaggagttgggactgtgtttgctgtgaagcagtcatgtggcagtctggtggcggatggtgaagccatctggtgtctggagatttgatcggcgtagtgagtgagctattaggagaagtgaggggacgatggacatgaaagggagatggcccagagtcgataggtgctgttcgcgttggtacactgtgaatgagatcgaggataggaattgggcgtgggattgagcgtcaatctagtttggtggtaagaggatgaggaaatatggtcaactgggaaaaaggggcatggagctaaactaggcctttctaggcgtgaaaggagcgtgtacccattcaggtgaggttttgtcccttattccagtagacgagagactggcgctcggtagcccaagacccagagctgggaagcacatggggtcccctgggaggaaaccagggctacatcctaggtctcacacaggagcggcccttgcctctcctcgatagggttgatggaaactactcaccttgggaagaacggtacatccttaaccttttacaacgtccgcaacttgttcaccccatggcttcctggaaggttcaagggtccctcaccacccatggggaaggaaagccgatggctcttggaatcgttcgctcttgagggcaagaaccggtgcgtaatcaacttgcggaacggccagggaggttcggatgaaaggaaaccacgggctttccaccgccgtaccggttactgggggacgggccaacctcagaacaggccaaggaagttcccacttcgcaaaccaagttcgaacccataggaaaaccacacaaaaggaaaaaggcctaaaggaaatctggtcgcggacaaacagaaagggccccaaagggaaaccaagagccgggccacagaaaacgctccaaattcccggtagcctgtaaccaaggccacgggccgggagacctgggactccccctggggctatacaacccg

SEQ ID NO: 653418 - DNA, 865 bp, Homo sapiens
  misc_feature (354)..(354): n is a, c, g, or t
  misc_feature (470)..(470): n is a, c, g, or t
atcaactgcgtggtaagacgacttgagcatcattcagtggaaacttgtggaacacgttatcttttgcctcagtaatgagactgtagcggatactactctaaccaaagcccccgctttcttccactgaaaagtgtcatccaatactaagtactcccacaccgcctccttctcacgcccttaaatgagacagctgtaagaggatagagtagaataagcagttctcccacacttctgtgagaacagtctggaatcaaacttgtggagccaagtgaataccatcagtcgaggaggagtagtgaagatcggcagctggatgagccttgcgttgagtcctctttatgtacatgcagccantgcaagcgagagtaagactagtgacgccaggccaaagccagcccttctggaggaccagcaagacccttcgccctcttcctaacaccctggcttcagtgcaactcttttccttcagnctgcatgtgagttccgtgataaatgttcaggtaacatggatgggcactgatggagaatcactgttgacttgagatcccggtttccatgtgatttgttttcttcaatagtcttattttcagtctctcaaatacagccaacttagagtttgagtttggtgtctattgaaccattaaccatgacttacatagctaggagaacgactgacatcagttaactgatgtctcacaagattactgtgtacctaagtggtcgtgatgttgaatactggtaaaccacaaacagtcagtttgccttgatttttgaaaaattaagaccccccgttgtcatcttgaagcctgttttctcttcaggaacaatcaagagggtattcacgaaactactggttaacgtcaac

SEQ ID NO: 653419 - DNA, 244 bp, Homo sapiens
acggactgacgatgtctgctatctcgggggcctggccctgacccagaagtgggcgggctcccactccatgaggtatttctacacctccgtgtcccggcccggccgcgtgggagcccctgcttcatcgcctgtgggctactgtggacgacactgcagttctgtgcggttcgacagctgacgccgctgagccagagtgatggagaccgcgtggcgcctgtgtgatatgcgcagtgagtgggcctgg

SEQ ID NO: 653420 - DNA, 2174 bp, Homo sapiens
  misc_feature (24)..(24): n is a, c, g, or t
  misc_feature (358)..(358): n is a, c, g, or t
cctcgcacttggttgcccgtgcanctgcaggctgagggcagggcctgggatctggggctgaagagaccctctgattccaggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaaggtgggcctgggcctgggtcagggtccatcaggaggagggtgctggcagggctggccttgccctgagctctgctccgccancagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaacacataagcaaacaaacaacatcatctcgcccaatacaaaacataaatccaacacggggggcgggccctcacaaaaaatatctcccggggggggcccccatttgcccgccacccactccatcttgtcaaagaggggccccctatggga

SEQ ID NO: 653421 - DNA, 858 bp, Homo sapiens
  misc_feature (23)..(24): n is a, c, g, or t
  misc_feature (51)..(51): n is a, c, g, or t
aagcaaaagaaaacgaaaaaggnnacggccacagacgccggaggaagaggntgtgaaaaaaagagcctgttcggcaacccccagagacccttcttcagtggcccgccgctggaagagtacaacgctgatcctcgtccacatttcacctgtggaagagcatgacggaaatagataaaggcactgtggaagaaactgcgaggagaagtttgcccccaagggtcctgaggaggatcataaggcctgagctcaggccttacctcgagcacatacctaggggaggagccttgaacattgacaccgacaataaaactgccccaggccccccttgaaaaaaaaccccccacacccacccgacataattttctcccccgcagaaacccccgctccaacccacataacccccccccccccccaactccgtccgacacctacaccacgaccccaaaaaaaacaaagaacccacccctctccctcctccactgccaatcctacattgtataccaacccaccccatcaagcacccagccacgatcccaaaatccactccccaccgggacgccccccgcacgccacgccccacactcaacaccctcctctcttattctacccaaaaaatagataacacaacgcagatgtctgaaacaacaaccccccaccccgccacccacacgtgcagacgtgttgatgcaaacaaaaagagatccccaccgaaaaacaaaaagacacacgccaccataaaacatcagtatgtgagcgaatttgacagccaccggcccgccccgccaccacgacaaaaatttttatgtgatcttttaaaaactaccaccgcccgacccccgcgcgcccgccccccacccg

SEQ ID NO: 653422 - DNA, 1005 bp, Homo sapiens
atccgccttcctgctcgcgagacgcctccgcgcgcgctcctccgccgccgggactccggcaggtttatcgccagagtccctgaactctcgcttgcttttgaatcccctgcatcggatcaccggcgtgccccaccatgtcagacgcagccgtagacaccagctccgcaaatcaccaccaagggactgtagaaggagaagaaggagagtggtgcgaagaggcagagaaaggggagagacgccccatgcggtaacggggaatgctaagtgaggaaagatggggagcaggaggctgacgaatgaggtagacgaagaagaggacggaaggtggggagggcagaggcaggcggaggcacaggtgacgggacggacgcggtgggactgagatgaggacacgcgtgaagtcaggcgtacgcgcacagcggcgcacaccctgcacacatgcgtgaaggatgacgcggtcgcatacacaccagaagcgacgaacgacccgacgaggacagactcgacagcagaacgaggcacacgcgcaactacaacaaacaacaggccgcgagaaataacaacagccaccgaactcacgcacaagaaccccaacagggccgacatccgacagtcccaaagcgcgccggcccaccgcggcccagagccacccgcaggatgacaccagcaccacacaccaccccacaaccacgacagcgactagcccacgtgggtgcacaaagaccaagaagtcacaaggcacgaataacaactcaaaagacgtagcaagcgaacagaggaaaccaaacacactacgtacagaccaatggacggcgcggcaagacagaaccgaacgtcacacgactggcaggcagcccaaacaaaccatggcgaaaccgcgtcaatcaaggagaccgcaacacagacaaagataggggcaacagaaacaagcaggcctacacacaaaggaacgacaaacaacaacagacaacagaacgcgtcggtgtctaagctctcttctccccc

SEQ ID NO: 653423 - DNA, 3287 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 653424 - DNA, 1161 bp, Homo sapiens
gccaagttaagaaagcgttcaaggctcgaacatgccagcgtaccgttaaccaaatcccatacatataactgaagctcctcatacccaagtatggatccaagtcttagtcgaccctagtaagagaggagatctaatagtttacgctatgaagtgacaccagtgagacagacaattctccctccgccagtcagccgttgctgttcagattgataagagcacatgatactgatcgcatttcacagtctccgacatatcatacgagatcagacgcgaacgaacggtcagttatgtaccgcgtcgatcgtggtctaatccacaaccatcaggagcaatgacttcaatatacgcgacacacggtttacgaaaaaacaagctaatttaggagaaagcatacggtcatagagtctgtaactcactcgacgctggtatatacccaaatagagcatacaaccgtgctaagacattcacacagttacattagaagagacagcacgcacattgtacccgagggtgaacgacagtggtgttaaaccgagccggcaggataacaccgtaagccgatgtcgcgaacgcgtagacaataaatacacattgatgtcccgttaagtatagcgggaccacttgttagtgacagtgggactaccaccgtaggcgtttcaggctggtcctcctataacgtgttttagaccgctaggttgacaacttttgaaccgtggtccccagttgcacaggacgcggctgggtacaataggagtcaccacgtgccacagcaccgcaagaccaggaacccccatacttgcgaagggcttttctaaaatatttactataaaagtggccgaaaagcaaggatacccctgaaatcaaaaatcacaaacagggggctcccccttagagagctttaacgcaagagaccccgttggccattttaaagagagaatttttcagaggctttggggggcccggaacccattccggggacggcacggaacacgcgcaaaagcctccccgaaaccaaggtaccaatgcgataacagaaccttttccaacccaaggttcaaaagtgcgaagactaaccgtaattacgtccacaagttggaatcgccaaattaacacttggaccaaaaaacgtggaacacaaggtttaccctcttagggggaatc

SEQ ID NO: 653425 - DNA, 227 bp, Homo sapiens
  misc_feature (145)..(145): n is a, c, g, or t
gtgcccacgtgagagttggtgagggcgatgcagcccagctgcagtgctaggtagatcaggtctaccagcttcagtgcctatccagcccctgttctggggcctgtgtgcttaccacccggttgggtattgtggcggcagggccagngccatgctgcataagatcgccagcagttgtcagcaccacagtcctcagtcctctgtccactggcgaagtgctggtgtgacaa

SEQ ID NO: 653426 - DNA, 134 bp, Homo sapiens
gtgttagaaatacaaggcagctccctgcatctattggctcccactgtactgacagccagatcgttcagaaagaggcagagcgggcgaacgtgccaaggagcgggagaagcggcgaaaggagcaagaagaagaag

SEQ ID NO: 653427 - DNA, 3244 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 653428 - DNA, 3203 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggttggctccgctcttggtggtggctgtgacctgggtccgggagggcgggcttgccgcagcctcggggtggccacgctgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacctcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcactatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctcta

SEQ ID NO: 653429 - DNA, 656 bp, Homo sapiens
  misc_feature (79)..(79): n is a, c, g, or t
  misc_feature (114)..(114): n is a, c, g, or t
  misc_feature (117)..(117): n is a, c, g, or t
  misc_feature (431)..(431): n is a, c, g, or t
  misc_feature (436)..(436): n is a, c, g, or t
  misc_feature (439)..(439): n is a, c, g, or t
  misc_feature (478)..(478): n is a, c, g, or t
  misc_feature (518)..(518): n is a, c, g, or t
  misc_feature (571)..(571): n is a, c, g, or t
  misc_feature (602)..(603): n is a, c, g, or t
aaaatatggtagaacagaagtgaagtctgccctatagtaggatggtgagataattaagtggaactaccagatccatgtngtgattctttccagtatcattcagcagcccttggncanttgcgaggcaagtcgtcaatggggtatggagattttccaggtgggtgtggttgaaggaagggaagaaagagtttaggagcacattacaagaagaaggtgactgtaaggtccaggctgagcaggaaggtaaagcaagaaggaaacatgaggttgtgaagagaagtttagagggatgaggaggcaggagaggtgaacagttgcaggatgtagctagagtggcgatgttagatcttggggccagagagctttacaatgattatgaagatcaaagggcattagaatcaagctataaagagccactgtttgatgttggnatgtnagnatgctgcaggtggatgtctgcacattgatggtgagaacntggtcaccctggccctgctgggtctttgctaaagagactntgctctgttcttggggccgtctttcatcacctgattagagcagtggtccccanatggtgttctttggaccatctgtataaaatnntcataggtcaaggataaaatggaaaaacagagaaaatgtcacagaaatgtgcc

SEQ ID NO: 653430 - DNA, 103 bp, Homo sapiens
ctctcatcacatggtattttatggacttttgaccctcctcttgctattcgctctcttagcgaatgtccacggacctggtctgaccgattagtctgcctgatta

SEQ ID NO: 653431 - DNA, 1345 bp, Homo sapiens
  misc_feature (253)..(253): n is a, c, g, or t
  misc_feature (257)..(258): n is a, c, g, or t
  misc_feature (260)..(261): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (298)..(298): n is a, c, g, or t
  misc_feature (453)..(453): n is a, c, g, or t
  misc_feature (1304)..(1304): n is a, c, g, or t
  misc_feature (1319)..(1319): n is a, c, g, or t
gctgcgatggctgccgtgcgaagggctggagaagcggagtgtctcggttcctctcaggtcctggacgttccttgacgccgccagtgggggggggccctgtggcggtcgccaccacgtgtagtcatgtacccgaccgcgccgcgccgcctcatcgggacttcatctcggtgactctgagcttggcgagagctagtgacaacagcaagagttggtgagggcgctcgctgctggcacggaacatggcacagcaacntgcnngnntngngatncgcggantatatctcttcctcctgccttnctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacancgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaaggggcaggctttctgctgatgcancccctggagctaccntgctcatcaccagatggccccaggta

SEQ ID NO: 653432 - DNA, 658 bp, Homo sapiens
tccttgcggtggcaggcaggatgttgtgaaatggtgcaggcaaaggccccagatctagcttggctggctcccgaacatgtccatatttgaagtgctgcctcaggcctggcacggcatgaagcagctgtggtccctggaggcaagaaggcagctcacggggccttccatttccagccaggcctcatctggtggatagtgtgcctagagtagcgaaagtactagagtgcccgtgcggcggagaagtcccaccaggatgccccccctcccctgataagcccgtcttctccctcgtggacaggagtcagccagtaggttgctgtggttacatgccggtgcctggaattcctccttagggtccctggggaagagctattgcttaacgcaggatgtgctagggtgtagggtctcgggcttatactttgatggctttggatgtcttacgttgtttcatggctgtcgttcttggctctttgtttctgtaggagcgcctcttccaagcagtggaggcctgagggcttgagggatggctggtgcgaccaaccagctattggagcacttgtgctcctggcacgagggagacgacaggatgtggagccttcccaggaggaactgggagaggtggcccgtgtcggccagtgcctatggctttctgttgacc

SEQ ID NO: 653433 - DNA, 117 bp, Homo sapiens
gggggtttttttttccaaagggaaaaaaaaaaacccttttttggttaaaaggcttcccctttttttaaataaaccctttttttgggaaaaaatgttaatttaaaagggcccccttta

SEQ ID NO: 653434 - DNA, 669 bp, Homo sapiens
tcttaacccgttcagtgctgccagtcaaccaagggtctgtgagtgtcagcgggggatcaggcagcaaagcctttttccccttgtgcctgtgatccttcgaaaggttgagccactgtgggctggtgggggaaggggtcaaggccatattcccaatacgtgtagggcgagggtccctgtgcgtggcacattcaggctgtgctgggaagaagagacctgggctgggaaggaaccgggtccccgagcggttcgtgctgcctcgcctcttccccctttggctcagctgagcagttgggtggtttctatgcccgcaagtttcaggaagttattcacaaaagaaaaatacatttttccccccgaggggttggggcaaggacaggggagagagtgctaggaaatgagtccccggggaaaggggcaccgggccgtgatgtaaatatctccggcctcccacgtgacgggattggcctaggaccttcgagaccaacagatttcagaaccctcagaactttgccccgggtgccttggtgggacaaagtgagggccgtacagggaagtgaaattctgagttgtgggggctaagccgtgacccccttctcaatgttccccgcccaacccattctgggcttcagaaattttttttcccagttgtggtttgtgcccaggcttggt

SEQ ID NO: 653435 - DNA, 7886 bp, Homo sapiens
  misc_feature (5008)..(5008): n is a, c, g, or t
  misc_feature (5011)..(5011): n is a, c, g, or t
  misc_feature (5043)..(5043): n is a, c, g, or t
  misc_feature (5054)..(5055): n is a, c, g, or t
  misc_feature (5061)..(5061): n is a, c, g, or t
  misc_feature (5071)..(5071): n is a, c, g, or t
  misc_feature (5077)..(5078): n is a, c, g, or t
  misc_feature (5081)..(5083): n is a, c, g, or t
  misc_feature (5098)..(5098): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggtgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653436 - DNA, 5764 bp, Homo sapiens
  misc_feature (2886)..(2886): n is a, c, g, or t
  misc_feature (2889)..(2889): n is a, c, g, or t
  misc_feature (2921)..(2921): n is a, c, g, or t
  misc_feature (2932)..(2933): n is a, c, g, or t
  misc_feature (2939)..(2939): n is a, c, g, or t
  misc_feature (2949)..(2949): n is a, c, g, or t
  misc_feature (2955)..(2956): n is a, c, g, or t
  misc_feature (2959)..(2961): n is a, c, g, or t
  misc_feature (2976)..(2976): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaattcacagggtacatgtgcaggtttgtcacctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653437 - DNA, 1112 bp, Homo sapiens
  misc_feature (218)..(218): n is a, c, g, or t
  misc_feature (220)..(220): n is a, c, g, or t
  misc_feature (222)..(222): n is a, c, g, or t
  misc_feature (317)..(317): n is a, c, g, or t
  misc_feature (358)..(358): n is a, c, g, or t
  misc_feature (360)..(360): n is a, c, g, or t
  misc_feature (393)..(393): n is a, c, g, or t
  misc_feature (408)..(408): n is a, c, g, or t
  misc_feature (419)..(420): n is a, c, g, or t
  misc_feature (427)..(427): n is a, c, g, or t
  misc_feature (430)..(430): n is a, c, g, or t
  misc_feature (435)..(435): n is a, c, g, or t
  misc_feature (442)..(442): n is a, c, g, or t
  misc_feature (457)..(457): n is a, c, g, or t
  misc_feature (474)..(474): n is a, c, g, or t
  misc_feature (477)..(478): n is a, c, g, or t
  misc_feature (489)..(489): n is a, c, g, or t
  misc_feature (522)..(522): n is a, c, g, or t
  misc_feature (528)..(528): n is a, c, g, or t
  misc_feature (530)..(530): n is a, c, g, or t
  misc_feature (540)..(540): n is a, c, g, or t
  misc_feature (546)..(546): n is a, c, g, or t
  misc_feature (549)..(549): n is a, c, g, or t
  misc_feature (553)..(553): n is a, c, g, or t
  misc_feature (575)..(575): n is a, c, g, or t
tcagtgatctctggagaaataggttctggcgacgctggagactcatccagcctgacgggcgaaagctcggcagatacatgaaatggccagaaatcaatacttctccgagctgctactggttgccaccttccctagccccaaaccgaagccatctgccaaattccagcctctttgagctggcccctccagatggagaggacatctcctgggctgggccngntnccccagcccacccctcatgacacagaatacttgagccactgatttttcatttctttttttttttttccttcggcccctcctcagccacctgattngctctatctgcaagcctgactctgccagcctcccctggtananaggaggtttacccattccctgcacgcctgtgcngtccctgtgccccgntggggcagccnnttcagtngtnggctnggctttnggggccagtgagttngcctctttccctcctgntcnnggccccagggntctggggagcccccaggcacacctaagcgtcgnggagcntngttctgccanagcccngcntacngaccccgggaggctgggcaggnggacagccccagccaccacctttcagccttagcctgtcccccaaggatggtgaagctcagcaggggctctgagggtacgccggccaaaagaggctggaacctcctgctcaagtctagacccctatcttctctgctgcccccaccctgccagagtctgatgtttccaataccaagattgtcttcacagggcacagcccctgcagagcatctgggtcattgcggaaagaggacccggtatcccctctgggccaaggtgtgtctacaaaagggacaaacagggcaaagggagggagagaaaaagggagctagagcgtgaaaggacgacgaaatagaagagcgaaatatctttgtgagaaaggagaatataatagcaagtataggaggcagaatcatatatagcgccacgcgaagagaagacaaaaaagtggggcggagcaaccaaaaaccagagcacgttggtagtgtagatcgtataataagtacatcaataaaacggcgtactggtacacgtacttatagttattgttttagttgggc

SEQ ID NO: 653438 - DNA, 318 bp, Homo sapiens
ctacccgcccacggagatttcctcaaaaaataaatataaaaggttggatgtaatttatctcccacttcctcccaatttactaccatccatggaaaaccgctgaggttttaatacatttgggtatatttgcttttagttcttttggttttggttttggtttggagacagagtcttactctctcacccagtctggagggcattggctcgatctgggtttactgcaacctccacctcccaggttcaagcagttctcctgcctcagcctccgggggggctggaattgcaggcgtgtcccaccactcccggttaatttttata

SEQ ID NO: 653439 - DNA, 9375 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaactgcctggtcctggtgtgtccttcctgcgcactcaactgttgtctggcatctgctcagtgtggggggatttgataacttgtctccaagatatcactgttttactgtgtatcct

SEQ ID NO: 653440 - DNA, 125 bp, Homo sapiens
aagattgccgttagctcataaaggtgatgggcacacagctgttcagagaatggaacacacatgcttttcatgcacctgactcctgcctattaactttccccaccttgaatgtcaatgcttgccct

SEQ ID NO: 653441 - DNA, 174 bp, Homo sapiens
atgaaactaataaaagaaaactttgggaaaacactccacaacactattcttggctaaaaatttcttgagtataccccacaacacaggcaaccagccaaaagtggcaatgggtcacatcatagttaaaaccttcttacaagtgaggatacactcatcaagtatgagcaacccaca

SEQ ID NO: 653442 - DNA, 4412 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagcaatggtggccaagggccccttcacccccccaagggggaaccccttaaggggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653443 - DNA, 6577 bp, Homo sapiens
  misc_feature (1689)..(1689): n is a, c, g, or t
  misc_feature (1694)..(1694): n is a, c, g, or t
  misc_feature (1769)..(1769): n is a, c, g, or t
  misc_feature (1773)..(1773): n is a, c, g, or t
  misc_feature (1813)..(1813): n is a, c, g, or t
  misc_feature (1821)..(1821): n is a, c, g, or t
  misc_feature (1829)..(1829): n is a, c, g, or t
  misc_feature (1831)..(1831): n is a, c, g, or t
  misc_feature (1857)..(1857): n is a, c, g, or t
  misc_feature (1867)..(1867): n is a, c, g, or t
  misc_feature (1919)..(1919): n is a, c, g, or t
  misc_feature (1926)..(1926): n is a, c, g, or t
  misc_feature (1938)..(1938): n is a, c, g, or t
  misc_feature (2001)..(2001): n is a, c, g, or t
  misc_feature (2110)..(2110): n is a, c, g, or t
  misc_feature (2153)..(2153): n is a, c, g, or t
  misc_feature (2203)..(2203): n is a, c, g, or t
  misc_feature (2208)..(2208): n is a, c, g, or t
  misc_feature (2215)..(2215): n is a, c, g, or t
  misc_feature (2268)..(2268): n is a, c, g, or t
  misc_feature (2350)..(2351): n is a, c, g, or t
  misc_feature (2376)..(2376): n is a, c, g, or t
  misc_feature (2457)..(2457): n is a, c, g, or t
  misc_feature (2467)..(2467): n is a, c, g, or t
  misc_feature (2492)..(2492): n is a, c, g, or t
  misc_feature (2506)..(2506): n is a, c, g, or t
  misc_feature (2515)..(2515): n is a, c, g, or t
  misc_feature (2522)..(2522): n is a, c, g, or t
  misc_feature (2536)..(2536): n is a, c, g, or t
  misc_feature (2553)..(2553): n is a, c, g, or t
  misc_feature (3699)..(3699): n is a, c, g, or t
  misc_feature (3702)..(3702): n is a, c, g, or t
  misc_feature (3734)..(3734): n is a, c, g, or t
  misc_feature (3745)..(3746): n is a, c, g, or t
  misc_feature (3752)..(3752): n is a, c, g, or t
  misc_feature (3762)..(3762): n is a, c, g, or t
  misc_feature (3768)..(3769): n is a, c, g, or t
  misc_feature (3772)..(3774): n is a, c, g, or t
  misc_feature (3789)..(3789): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataagtcttcttcagtgtttcattttggataatttcttttagtcttcacattcgttgatctggacttctacagtgtctcatctgcagttaatctcatccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653444 - DNA, 895 bp, Homo sapiens
  misc_feature (436)..(436): n is a, c, g, or t
cggcggcagcagaccccagagctcagaaggagtgagaaccctgaaccctaatcccactgaagtccagccaataagagcccagtcaccatggcggagctgcaggaggtgcagatcacaggaggtagaagccgacgtgttagccgagagacagacagcgctggaggcgcgcgatgacgtcacctcgtgatggcagagcatccatagcgagcctcgtggtccactttatcagctggtcttatgagtcgacctcaccagatatctcaaacgcccatgcgatctcttatccttaccacgaatgtgggactcaagctataatagtcttgcgttccagcacactgtttcggagtatcgaggacgatgcaaggacagatcattcgaggacacttatgatgctgggattcaactgttcggtatgcaccccgtgcgtcacatcggnacacggagcgcgagacctctcatgatgattccccatatggcgcggatcatcatacgtgacccaatcgtcgtggcaccgagacttgccaggactatggatcccttgtcgatcctgacgaggtactctaagagtatatctctatcaattaacttgagacgtcggtgttggacgctggtagcctacagtcctggacgagatatgctcttatgcacccggacactgtcgaaggtcttgtacctcattcgaaccattggagtcccgaagtgcctaaggggtctggatcgggcatcgggggctagagcaacataggctaaacaaggccctcatgcgtcttccattgccgggagatgatcctgtggacatttcttgtacagccaggaagagctctctggaaattctgaagttgatacaaaaagtacagaaaagtatcattaccaacattgcaccccacctgggatg

SEQ ID NO: 653445 - DNA, 710 bp, Homo sapiens
  misc_feature (171)..(171): n is a, c, g, or t
tcccaaaaagggattttttttttttccaagtaccggcaattggaaacccaaaaggggacccccgggttgggccaattctgggttcccccttccccaacaaaccggggggaggagggtgcgccccttaccaccctttttgtggtctcgatttcgggccccctttgctctcantctcgtgcgtgcagcatctccctataggggcagggccccacctttccctgtggaacgtgggtatatctcggctcacccaccctgtgcacatgtcgcccacacccccttcttctcccacacacaaagagaggtttctcttgtggggagaggggagatctcgtgggcacagagaaccaggagagggccaatgtgagcgagagtaacacacatttttgtgccccgcgtggattcgccagaccggacaatagataacagaagaaagtgcatcgaaaagacatgtggaacccctgtggaaccacaagacacaaacagaccaacaagtgtgtctccagagagggtctaacgctgtgtgcgtgaaaccacagggggggacacaaaagtggggaaacacaaaaaacacacctctggggggaggagcaacaggggccaaagggaccacccaggagagagggggccgggtgcgggagaacagccggcgcaacaaaggggatgatcaaagccccacctatgggcaaaaatagaggaaggagcaccccaca

SEQ ID NO: 653446 - DNA, 119 bp, Homo sapiens
aatggaggggagctaagagatagagagaaggggacagaggcaagaaaagatagtagatcacgaccgatagagaaccagggtagagggctagaaggagaatacgaagataaaataccagt

SEQ ID NO: 653447 - DNA, 9127 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggagcagctggttggagggagccagggccaggcccaccctcctctcgggaccaggagacttgcag

SEQ ID NO: 653448 - DNA, 8393 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653449 - DNA, 2244 bp, Homo sapiens
cggacgcgtgggtccggacgcgtgggctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 653450 - DNA, 154 bp, Homo sapiens
gaatcgagctcggacccgataggcagcacactccttactgatgaaacaaaactagaatctgctttatgaaaactgacttaattttgtatgtcagtttatctatttactaagcatttttgatggtactatggctaaggtcggagtgtctacaaca

SEQ ID NO: 653451 - DNA, 7869 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaaaaaaaaaaaaaaaaaaaaaaaaaaaaaaaaaaaaaaaaaaaaaaaatttttggggggctcgggcctcagaagaagacttttcaagaaccatcgcgttgggggcgcgcggcgggcccatgtggtgttagatggaaaccggtcgctcatagcgtgtccccagaaggaaactcgtgggtcctggaacaagtgtgtgggttttttctcacaattaaaaaacgcccggggtggaaccggaagtggtttcttggaccaaatcccagaggggagtccgggaggccacaggggattctatcaacaggagtcccagcgaactcgatataattagcgcgcgcgcggagg

SEQ ID NO: 653452 - DNA, 6699 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctcggcaacaacaaaaaaaaggagatgcaggaacagtcactatcattagtcatcagggaaatgcaaattaaaacatgagaagccgttacacattcatcagtgtggctcaaatgaaaaaaacgcgacaatgtcaagtgtgagtgaagatgtgaagcagctgggactctcgtaccttgcgagtgggaggcaaaaccgtgccaccctcgcgagaactgtgtctcagggtctcagaaagttcagcacacaattcacaggtgtgcatcactgggcttggatttgcattacattgaccccagccctgcagtggaacctaataaaagcgcctgaagcaa

SEQ ID NO: 653453 - DNA, 814 bp, Homo sapiens
cctgcggagtatactgctaagatgctgtccgtgcgcgtatgctgcgggcgtggtccgcgcccttcctcgtgtcgggccggactggtctccagaaatgctatgggttcatctttcattgctgcgaggaactgtccatgcctctaatccatctcatcttcagaagagctggcgactgctgatgatgtcctctattcttgagagagcgtattcttggagctgatacctctgtcgatcttgaagaaactgggcgtgtcttaagtattggtgatggtgattagcccgcgtacatgggctgaggaatgttcaacgcagcaagaaatggtagagtttcgcttcaggcttaaagggtatgtccttgaacttggaacctgacaatgtgtggtgttgtcgatgatattggaaatgataaactatagttagaggaacggagatataggtgaacgaggacaggagtccattgtggacgttccagttggtgaggagactgtcgggtcgtgtagttgactgcccttggtaagtgctacttgatggagagggtccaatgggtgccataggacgcgtaggcgagttggtctgaaatggccccggtatcattcctcgaatttcagtgctgggaagccaatgcatgactggcatttaaggctgtggatagactgtggtgccctttggtcgtggtcagcgtgaactgattattggtgaccgaacagactgggaaaacctccaattgctattgacacaatcattaacagaaaagttcaatgatgggtctgttaacaaaagagtggtcttgttttatgttggcttgtccacgggc

SEQ ID NO: 653454 - DNA, 194 bp, Homo sapiens
tacacgctgtggcaacatgaacggatagcttgccgagaagagcaatcccaagacacatagatttggtcttttcacatagtcccatatttctggaggcttgttcatttctttttactctttttttctctaaacttctcttctcgctttatttcattaaattgatcttcaatcactgataccttttcttctgcttg

SEQ ID NO: 653455 - DNA, 269 bp, Homo sapiens
gacggaaaggactcgaatggaaatcactggaatagaatgcaatttaataaaataggaacaaatgtaatggaatggaatggaaaggaatcgaaatgaaaggaatggagtggaatggaatggaatggaatcgtatggaatggaatggaatggtacggaatagaatggaatggaaggaattgtaatggaatggaattgaatggaatggaatggaatggaatggaatcaacgcgagtgcagggtaatgtaatggaaaggaatgcaatgtcgac

SEQ ID NO: 653456 - DNA, 283 bp, Homo sapiens
gatgtgggactgaaaaaggaacccaggacactaagcagtagaaagatctatatgcagggccggcgcggtggctcacgcctgtaatcccagcactttgggaggccaagataggcggatcacgaggtcaggagatcaagaccatcctggctagcacggtgaaaccccgtctctactaaaaaatacaaaaaaattagccgggcgtggtggcaggcgccggtagtctcagctactagggaggctgaggcaggagaatggcgtgaacctgggagatggaggttgcagc

SEQ ID NO: 653457 - DNA, 376 bp, Homo sapiens
  misc_feature (8)..(8): n is a, c, g, or t
  misc_feature (160)..(160): n is a, c, g, or t
  misc_feature (164)..(164): n is a, c, g, or t
  misc_feature (236)..(236): n is a, c, g, or t
tggggccntgtggttttttcttgttgttgcctttggccctgccgtgtctgtgcaagtcctcctgtccattgactggtggagaagtgatcccagattcctaacacaatacttacttaattccccagctatagcacccccttgcactttttggtttctcctncccncatagttcttctccatcatggcttcctcctcctcttcttctgttctttccctttcccctctcatcctcttcnacctctccacctacctccactctcaaaacttccatcccagctttcccctccactgccctatcacaggctctagctttcattgagcagttaaagtggggagatagttcccatgagatcacctgagtatgtgatgtcgacgc

SEQ ID NO: 653458 - DNA, 362 bp, Homo sapiens
  misc_feature (276)..(276): n is a, c, g, or t
  misc_feature (335)..(335): n is a, c, g, or t
ggcgggtctcttccggagtcgggctaggatatagcgggcagctccacgggaaagagtgtgttcatcggagaaggggtgagtgtgtggtgcctccagacttgatgcagttgtgtgtgcccagcatctccctgggcctctgctcatgtacagaattccagtgtgtgcaacaaagagtcagtgtgaggagtgaggagggatttggtagtgctgctgacgctgtggctggcgttgggtgaagcctgctggtggcatgtctgtagtccaacaggggttatntgagtggcatgtaggtgaacaagacagcacaaagtaccctttgtggaaactacagctgngtttccccagacttcatttgaccccat

SEQ ID NO: 653459 - DNA, 238 bp, Homo sapiens
accaaagtaacactggagaggtgttaggtcttctctctcccagtccataagagctgcatggctaaagagtatcaagttttaatgatgaggctggtgtcttccacctacttgtctcatatctgttgtcatgctggtaaggtacacaggagagttgtgtcagcagggatactgtaggcgtggaggtggcagctgcagctgggcctggattgtggcactaaccgtgggcatttcaggctga

SEQ ID NO: 653460 - DNA, 288 bp, Homo sapiens
ggcaccggctcggtcgcggtcacggacatgggcggcgcctttggcgcggacacgatcccacaagccgctgttgcgggcgaagtcatggttgccgggcagcagccaccaggtacaggcatagcgctgcatccgtgacaccgcctgcacgatcacgcggtcttccggtccctcagtatcgaacacatcgccagcgaccagcacatgcgcgacatcatgctccgcagctgctttgccgatcgcgtcaatcgcatcgaaccgcgcctcgctaagcgcagcgcgcacgtcgct

SEQ ID NO: 653461 - DNA, 821 bp, Homo sapiens
  misc_feature (6)..(7): n is a, c, g, or t
  misc_feature (9)..(9): n is a, c, g, or t
  misc_feature (34)..(34): n is a, c, g, or t
  misc_feature (63)..(63): n is a, c, g, or t
  misc_feature (75)..(75): n is a, c, g, or t
  misc_feature (86)..(86): n is a, c, g, or t
  misc_feature (91)..(91): n is a, c, g, or t
  misc_feature (119)..(119): n is a, c, g, or t
  misc_feature (123)..(123): n is a, c, g, or t
  misc_feature (131)..(131): n is a, c, g, or t
  misc_feature (138)..(138): n is a, c, g, or t
  misc_feature (151)..(151): n is a, c, g, or t
  misc_feature (154)..(154): n is a, c, g, or t
  misc_feature (161)..(161): n is a, c, g, or t
  misc_feature (234)..(234): n is a, c, g, or t
  misc_feature (254)..(254): n is a, c, g, or t
  misc_feature (272)..(272): n is a, c, g, or t
  misc_feature (277)..(278): n is a, c, g, or t
  misc_feature (284)..(284): n is a, c, g, or t
  misc_feature (312)..(312): n is a, c, g, or t
  misc_feature (335)..(335): n is a, c, g, or t
  misc_feature (348)..(348): n is a, c, g, or t
  misc_feature (364)..(364): n is a, c, g, or t
  misc_feature (373)..(373): n is a, c, g, or t
  misc_feature (418)..(418): n is a, c, g, or t
  misc_feature (466)..(466): n is a, c, g, or t
  misc_feature (495)..(495): n is a, c, g, or t
  misc_feature (500)..(500): n is a, c, g, or t
  misc_feature (503)..(504): n is a, c, g, or t
  misc_feature (517)..(517): n is a, c, g, or t
  misc_feature (531)..(531): n is a, c, g, or t
  misc_feature (559)..(559): n is a, c, g, or t
  misc_feature (779)..(779): n is a, c, g, or t
taaatnncnaaataggttttattttggccaccancatttaatgacattcaattaaggatttcntgaacaatttcnaccaaaaaaanaattnccccccccaaaacattgaaaaaattganaacngggtaccnaacagtngccaaacaagtcnacnccattcnttagtatgaaaagcaacaaaaaaaaatggagcctcaaaatattttatttcaaatttattttatgccagacccnagccgtaaccggaacccatncccagtctatgggtttcngaatnncatttncccatttattgtatttttatgagaaacntgttgtaatgagtctgtcccacnttatttgacattnaccaaagccgtataanagccatgcncagtttatttacagtattgtacattaaatgaaaatgtttgaagancacacaaagatttcacaaaaccataaccaatacagaaagatgtgtganacacattaggggccttcaaaattttaggnatggnatnntgccaagattatnttggcttataagtnttaggcaatcactaacctgaaataagtnacaaaaacatgcagatgattaccatttcaacaaatgaaaacctataaatgtctagctaaaagctaaaatattgtgtagctgaaatactaccatataacaatgggaatttataaaacaggaaaaaaggttactctttaaaagtcttccatgagttatagattttcagtaattttctataaaaacattcagaaattaagtttctcaaattatgtttatcacnaaattatgttttcagtagtgactggggccatgacttttaaat

SEQ ID NO: 653462 - DNA, 109 bp, Homo sapiens
  misc_feature (25)..(25): n is a, c, g, or t
  misc_feature (52)..(52): n is a, c, g, or t
  misc_feature (68)..(68): n is a, c, g, or t
tttacttttgaatgttacaaaaggnaataactttaaaactattctcaagagnaaatattcaaagcatnaaatatgttgctttttccagaatacaaacagtatactcatg

SEQ ID NO: 653463 - DNA, 902 bp, Homo sapiens
cattgtgtagggggctgtgtctgtattgaacaccaagagtcatacacatacccctatacaagtggttaatacacacattcgcgtacacagtgaaatcaaaatacacagcatcaacaccgtctctgcgacatgcaaagctcgtcatcctgagcttatgcattgatgccacccgtctctccgtgagcacacgtacaaggcatgagatcccgtggtccaggtcctgaacgcgccacgcacagacatctccattatactgtcctgtgccacctctgccctctctgatctttcccaaaggccagttcacaccatgagtcaccagcaataggatacacatgaaacacgcacacatggtgcacaggcaacattgacaacacttctgcaggtcactaacttcctcatgtgaaaccacggacaaattgcctcgcgctgaaccgccacatgcaccttgacaaatcccacccaagttaactgtggagaaacaatgtgatgctctgtgcgtgtctcattcttcaacttgtgaacccaatggccgagaacactagttgctccaatggcgaccattaaagcgttggatagcacccatagggccttcggttggcccatttgtgggtgttgcccaccacagcaggttgaaaggccgcccgacgttggaaagacacggccagccgttaacctggttcatggcgcagcagcactttagcaggtgtgcggaagagcaagagttcagtatgcacccggcgatcatgggtgtttcctaagacggaagcatttgaagagtcccatcaacttacctttttggaccagttagagcagttctgacacggacaggtggttagacaccacagcatgacacacagccgagctagcgacaacaacacaaaaccacagaaaggaacacacag

SEQ ID NO: 653464 - DNA, 336 bp, Homo sapiens
  misc_feature (38)..(39): n is a, c, g, or t
tattacaattttataaacatataataatttttaaatanntttttcaacacaaggtgctactgtcttcccgtcagtctgtgttaccccagaaccatctctgttctaagccaaggtgtggaagaagcccttcccataattctgctaagctttgtcatgcaatctcatggtatcttcatcagacatctgaattgagccttgaagtgtgagtaggagttcatcagggctgcatagtgttccatggatgcttagaccacaatttacttagccaacccctactgaggaacactgaagttgtttcctgtttttcaaaagtataaataaagtgtgagtacctgt

SEQ ID NO: 653465 - DNA, 489 bp, Homo sapiens
ctacatcacaactcacgcaccgcacacgatcacacacacagtgccaaactcctgacctgcacacacacaccatcatcacacatcccaattcacatctcatagcccaataatgtaagagtggaaacctagtcctgaatttcaaatgccaggagatcagtatggaaacagaatctgattttcttatttttatttgttttttttgagacagcatctcactctgttgcccaggctgcagtgcaatggcacagtcacagctcactgcagcctcgacctcccaggctcaagcagtcctcccacttcagcctcccaagtagctggactacaggcatgcaccaccacaccctactaatcttttttaaattttttttttggtagagatagggtgccactgtgttgctcaagttggtctcaaactcctgggctcaagcaatcttcctgcctcagcctctcaaagtgctgggattacaagagtgagccaccgcctgcagc

SEQ ID NO: 653466 - DNA, 625 bp, Homo sapiens
  misc_feature (244)..(244): n is a, c, g, or t
  misc_feature (573)..(573): n is a, c, g, or t
  misc_feature (588)..(588): n is a, c, g, or t
  misc_feature (602)..(602): n is a, c, g, or t
  misc_feature (607)..(607): n is a, c, g, or t
gttagatggagtctcgctctgacgcccaggctggaggcaatgggacgatctcagatcactgcaaactccccctcccgagttcaagcaattctctgtctcagcctcccaagtagctgggattacaggcgcccgccactacgcccggctaatttttttgtatttttagtagagacggggtttcaccatcttggccaggctggtcttaaactcatgatctcctgatccacctgccttggcctcccanagtgctgggattacaggcatgagccaccgcgccagccaactacttttgaagtcaggcttacgaagatataatttacattcattaaaactcatcctttttagtgtagacatctgtgagtttggacaaagtcatatcattgtgtaactatcacgacattaatgatataaaacaatttataaccaaaatttccctcattttctgttttagtcagcctcttccacactccctgccaatgacacttaacttattttctgtccctgtagttctgtcttttccagaatatcatatacataaaattatttgtcatttaaatgaattaaaagtatgtngccttttgattatgngttctacttactgnaatanatttgagattcatcaaaa

SEQ ID NO: 653467 - DNA, 1328 bp, Homo sapiens
cacccaagccacttgtcaacacatatgtgtaccatcccatgtgtgcagcaagcaacagcacacaataccatcatttatctttccagcatgcaacacagtatcacccattttacacatgcaaagcagttggcactccagcaatcaagttgtgtcaagcaagttcaacaatgcatcagcagcacatactcatacagatcttgatacattcacagacgactaaagtaaatcacatttcgacaggcacctttctgtagtgatacctattaatattaccggactcacaccttatgaacaactgatatacctctcacactgaatctgcactgcgacacgattccgttatgtaccacggcatggacacagcagaccagcttccacagaccaggtgtatgggacacagcgataataataccactatcaacacgacattcatccatactgctcacgacactacgcatacacctgaccacaatcctaaacgcagtaaccatattccacacacttcgcagtcactacaccagtcacacatacatgaccattaagaggacatgtcacctaccacacaggtgacacagactcgtcatgcaatggcccatcatatccccacaaaaggttgtacacagggctccacaatgggtcctcagcaacacgccatcagacacggacaccaggcggcacctccaacaactcacagacgagcacatacccaagcacaacgcataaataacactattgaaacaagccgaccacatggacacgcacatacagcaaacaaaacggaacgcagccaggacaaccaggaacgaggcacacgtacaacaccaatcacatgaacacatacaaaacatgataccaacaacagcccacgcaatatcccaagagtccacaaataacacaagacgcagggcgacaatgacaccaactacaccacgaagttatcccccaagcgataggagacatgaccaaacacaaacagtcaacagtgcacccccctgtagaataacagtagaaaggcgacgtcacgcaacagctaccgagcacgacacaagcactacaagaacgaaaacaaacaaccaccaagctacaaaacaaccacaaccacgcgaaacaagggaccaaaacacgaagaacacacaaacagaggacggaagcaaaacagacggaacacagagccacacaccgtgaccagaagaagacaaccaacaaaaaaagacgaggagcacccacgcaccagaagacacgccaccacaaacaccatcgaaccaagcccacacggcgcaaacaccaaaacacacaagaagacaaaacaacacaacacaagaagacac

SEQ ID NO: 653468 - DNA, 408 bp, Homo sapiens
  misc_feature (48)..(48): n is a, c, g, or t
  misc_feature (50)..(51): n is a, c, g, or t
  misc_feature (74)..(74): n is a, c, g, or t
  misc_feature (385)..(385): n is a, c, g, or t
  misc_feature (393)..(393): n is a, c, g, or t
aaaatttaaaaaaaaactaaaaaaagcataatcgcaaaaatgacaccntnngtcaaaaaaatgtagacataaangactggaaagataataacggccgagctgtcatagaaatcacagctaaaatgcgcaagttagcccatgttccagttcagacttgctccagataatccccggattccttgtttagaggatggttctcaacctttaaaagattcaaaaccctcattggtgggtttttgtttattcttggaatctgcctcatcctcccttgacttttacccctgtaagtaggagtatttgtcaactatagaggcagtggtaacccgacacactgccacgcagttgatggcattaaccaaatatcagccgctgccagtagaagaanagagctcngctctgtggaagagg

SEQ ID NO: 653469 - DNA, 257 bp, Homo sapiens
atcccatgcattagtgaggacagagggaaggagaggcggagcctcaggtatcgagtgatcttgtcgggaggattaacccctgtgtcccgagggtcctgagcgcaactcgggcgttgggtcggatcagcaggttggttatgctggcattattgagggagagccggagccagccttcaggaggaaactggaggtgctctggacaggatgtagcggattacgttggggtggcagattgagatctcgtaactgtcctcact

SEQ ID NO: 653470 - DNA, 424 bp, Homo sapiens
cagattagctttcattcgttgaataaactgcttaaatatctagagcagtgtactcctcacttgtaaagtcctcccatatgagatctatagagaaaccatgatgcggtggtggaaatgaatagcatcctcacttctttggagcgaatcactgagaacagtccttaaatggctaagccttcgtgtggcagttaagaattcaacttgccaagtctatcattgctgtgacatctgacatgcacgtatggggtgtgcctttggctaaatcatatatgttgacaaactcgaggggggacacggtacccacttcgccctataccgaaccgattgctgactggccgacgtgcaacaccgactggactgggacaggactgtggcctcgccactttatgcttgcagcacattcgactttatccccgtggtgtgg

SEQ ID NO: 653471 - DNA, 465 bp, Homo sapiens
  misc_feature (61)..(61): n is a, c, g, or t
  misc_feature (65)..(65): n is a, c, g, or t
  misc_feature (73)..(75): n is a, c, g, or t
  misc_feature (77)..(77): n is a, c, g, or t
  misc_feature (84)..(84): n is a, c, g, or t
  misc_feature (130)..(130): n is a, c, g, or t
cgtcatattatagaggtgcatgatttagaaggttatgaagccaaagttacagaccaggccnggcntggtggcnnncncctgtantcccagcactttgggaggctgagacgattgcttgagcccaggagtncaagaccagcctgggcaacatagtgagatgccccatctcttaaaaaaaaaaaaaatttataaacaaaaaagggacaattaggcaggcaagaattttgtcacttaaagtgaacaaaacaggtagtgtccggttagcagcagtagtgtaaaatgctttgtataagataaaccttaagaaaatttcttagtcctttgatactatataaacaatgatgtaattctgtcctgggaagaggctggcactgtgtgatgaccttactctgcaaactagattgaggtacttaatatgtaaaagtaaagtcttatattaaagcttgattaccatagctatccacc

SEQ ID NO: 653472 - DNA, 589 bp, Homo sapiens
  misc_feature (14)..(14): n is a, c, g, or t
  misc_feature (185)..(185): n is a, c, g, or t
  misc_feature (189)..(189): n is a, c, g, or t
  misc_feature (197)..(199): n is a, c, g, or t
  misc_feature (201)..(201): n is a, c, g, or t
  misc_feature (208)..(208): n is a, c, g, or t
  misc_feature (254)..(254): n is a, c, g, or t
agattttataacanaattaagatgttagtacaatatcgtgtttcgccgccgggcgcggtggctcacgcctgtaatcccagcactttgggaggccgaggcgggcagatcacaaggtcaggagatcgagaccatcctggctaacacggtgaaaccccgtctctactaaaaacacaaaaagttagccnggcntggtggcnnncncctgtantcccagcactttgggaggctgagacgattgcttgagcccaggagtncaagaccagcctgggcaacatagtgagatgccccatctcttaaaaaaaaaaaaaatttataaacaaaaaagggacaattaggcaggcaagaattttgtcacttaaagtgaacaaaacaggtagtgtccggttagcagcagtagtgtaaaatgctttgtataagataaaccttaagaaaatttcttagtcctttgatactatataaacaatgatgtaattctgtcctgggaagaggctggcactgtgtgatgaccttactctgcaaactagattgaggtacttaatatgtaaaagtaaagtcttatattaaagcttgattaccatagctatccacc

SEQ ID NO: 653473 - DNA, 1490 bp, Homo sapiens
  misc_feature (1472)..(1472): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataagaccngaacgcgctgatggtacc

SEQ ID NO: 653474 - DNA, 1486 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctaaacactgctttgaaaaccaaacaaactcctgctgcggactccggcatgtttgatggaggcctttcaaaagagtccacggcttaatggaggttgtttatgtggagacttcgatctgtacctgctgtcccctgtcactccctggaaacttggcggcagatgttgcagcgttaagttgtctctga

SEQ ID NO: 653475 - DNA, 132 bp, Homo sapiens
tgtggcctgcgtggtcgggcagggtcgatccagctccgtcccggcggccccgcggcagaccagatggtgggtgtggagaccaggctcctgaccccgccatgcatgcagcgccacatggaagccgtgcggccg

SEQ ID NO: 653476 - DNA, 1771 bp, Homo sapiens
  misc_feature (1746)..(1746): n is a, c, g, or t
  misc_feature (1761)..(1761): n is a, c, g, or t
  misc_feature (1767)..(1767): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggtactgaggcatccggcagccaagcagggggcgtggccaggctctgttgggcatccaggccagggggagttgggagagtggccgggctgtgtcgggtactggctctctccggctgcacaaggtcaggtgcaggcactatatgttttgaaacttcacatatgtttgttgggcaccaataacctttatgttcctctgacttaaactaaaatgagaacattttcttgagcataaaaaaaaaaatcccagtgcagatctggctgttatatttcagccttccagccacacttcatgaggactgcttcaagtgggaaacagaccccagccgcacccctgctggctcctctgtgcatgtgtgtcccttctgcctgagctctcccttcatgtagcttggaagccgaggacagtcaaggctgacattccattgacagtgttcatgttctgtgccatgcacttggagcttctgctgctccgtcatcaatcatcatttaatttcctgtttataatttagctctctgagcctacaattcttcctagtttcatggaacagttagaagatgagaaaaggatttccttttttattctattgatctggtttatctgacattgatacagttcccaggaacaattttaataaattnatgtagagccatgantttgancata

SEQ ID NO: 653477 - DNA, 179 bp, Homo sapiens
ttttttggttgtttgggcccccccccccccccccttttccccccgtggggttttttttttccccccccccttttttaaagcccgggcgggggggccttttttttttcccccccggggcctttgtttttttttggggggggcccccttttttttttccccccaaacccccccccccccga

SEQ ID NO: 653478 - DNA, 132 bp, Homo sapiens
gagcatgtatgaaagggaggcagacaggacctgagacttgtgccctagtcacatatctgtatgaagccaggagggtggaactatgatgacatctcctaacaatacccacatgcacatctctgtcatacagat

SEQ ID NO: 653479 - DNA, 858 bp, Homo sapiens
  misc_feature (845)..(845): n is a, c, g, or t
  misc_feature (847)..(847): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgcagactcgcctaatgngntcctctagatc

SEQ ID NO: 653480 - DNA, 725 bp, Homo sapiens
  misc_feature (2)..(2): n is a, c, g, or t
  misc_feature (212)..(212): n is a, c, g, or t
  misc_feature (225)..(225): n is a, c, g, or t
  misc_feature (227)..(227): n is a, c, g, or t
  misc_feature (235)..(235): n is a, c, g, or t
  misc_feature (242)..(242): n is a, c, g, or t
  misc_feature (247)..(247): n is a, c, g, or t
  misc_feature (266)..(266): n is a, c, g, or t
  misc_feature (271)..(271): n is a, c, g, or t
  misc_feature (274)..(274): n is a, c, g, or t
  misc_feature (319)..(319): n is a, c, g, or t
  misc_feature (322)..(322): n is a, c, g, or t
  misc_feature (343)..(344): n is a, c, g, or t
  misc_feature (384)..(385): n is a, c, g, or t
  misc_feature (389)..(389): n is a, c, g, or t
  misc_feature (403)..(403): n is a, c, g, or t
  misc_feature (406)..(406): n is a, c, g, or t
  misc_feature (412)..(412): n is a, c, g, or t
  misc_feature (415)..(415): n is a, c, g, or t
  misc_feature (436)..(436): n is a, c, g, or t
  misc_feature (447)..(447): n is a, c, g, or t
  misc_feature (449)..(449): n is a, c, g, or t
  misc_feature (553)..(553): n is a, c, g, or t
  misc_feature (575)..(575): n is a, c, g, or t
cnaaaatccatgagtaaactggattttatatttgaaatgattttacatatttgatctccagtgatttcccctccatcatgatctactccatcaatgactatagaaaaagttgttaccaacaatcatcataccggggaagtttttcaagatgctctttcaaacagaagcagtgcaaacaagttcagatggcaagggatacgataagacctggngcttatcttcggncncgtaaaanataaaantcccnaacatgtattccttaaganatganaangcagaacaacattttgatcagtgaaaaatattataaggctatatnacncattcttaccccgtgatcgcnntacttacatttctccctgttcattcaggtgctattgttcnntaancattcaaattctcnttnacagtnacnctagatgtggacgctcctggncggcgcttctntngatttagcaacaattgtgtcaacaggaggcaagtgacccttaaaatactgttgttggctctgttttattctgtttgtgaatgatttgttcacagtctgtatgtntttttctgcaaggaaacgaganatatctcacaacagctaattaagaaatcatttctataaaataactctcaatattacagaaacagatattctaaaacacaagtgtagctcaaaaaataattgggcagaatcaattttctttggcaagaaattgctaattcctcaccaaatg

SEQ ID NO: 653481 - DNA, 851 bp, Homo sapiens
cggacgcgtgggtccggacgcgtgggctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaaaaaaaaaaaaaaaaaaaaaaaaaaaaaaaaaaaaaaaaaaaaaaaatttttggggggctcgggcctcagaagaagacttttcaagaaccatcgcgttgggggcgcgcggcgggcccatgtggtgttagatggaaaccggtcgctcatagcgtgtccccagaaggaaactcgtgggtcctggaacaagtgtgtgggttttttctcacaattaaaaaacgcccggggtggaaccggaagtggtttcttggaccaaatcccagaggggagtccgggaggccacaggggattctatcaacaggagtcccagcgaactcgatataattagcgcgcgcgcggagg

SEQ ID NO: 653482 - DNA, 232 bp, Homo sapiens
cccccagaacgtggggcgaggctgaggcaggcagatcacaaggtcaggagttcgagaccagcgcgaccaatacagagaaaccccatctctactaaaaatacaaaaatcagccaggtgtggtggcacacgcccgatagtcccagactacctgggagggccgatggtgggacggagaggaactcctctcctcccacctcaagaagatgatgttctaactggcacgtggtgtcct

SEQ ID NO: 653483 - DNA, 142 bp, Homo sapiens
tctgccaaagcgtagtacccaaaaaaaaaaaaaaataaaccttttttccccaccaaacccacgccaatctctccatctcttcttactctcttatattccttttatatctccttctgtgttctctctgtgctttattcaccct

SEQ ID NO: 653484 - DNA, 235 bp, Homo sapiens
ccggcccgagttgagtcagacacacgatcatggctcactgtggccaaccccctggtacaagtgattcttcgcctcagccttccgactggctgggactacacacgtgcaccaccacattctagctaattttatttatattattatttgtagagatggagtcttgctatgttgcacaggcaggtctcaaactcctgggctcatgcgatattcctgccttgggcaacgggaaggaacg

SEQ ID NO: 653485 - DNA, 949 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagtaagtgtcctctgaggaggaagcagggaatggggggaaatgaggtccccatgatctgcccgaggttgccgagttttatcctctttcctcatcacaccactcattatggtcttatcaactgaccagaatacacatgaccgtgttgcttgccaggaattcagtaattatcctgaatctgcagttaccattgagcagatttgattgactttgcagaattctggaatttgtgtcactgaggagaaagttattgtctttgtccatgtacggcgtggagtgagctgcatactcagctgcttgtctggagtgaaagaccttgaacacagctgtgtgccgggaaatcatgttagccctgctggcttgggtaggagtgctgccactgcagtggcccatgccaccctgtagagttggtcattcaggaccttcaggactcagagacctcttgtcacagcctggctactgcctgtttttgtaaagtgttattggaacacagccaggtcgtgttgttggtgccagtttcatgttacaagggcagagtttagttgaggtaatccga

SEQ ID NO: 653486 - DNA, 649 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctgtaagtgatccatgagattccagggtcctacttgtggtgatcttaatgggtgaataaagggaaatatttataacaa

SEQ ID NO: 653487 - DNA, 109 bp, Homo sapiens
gagcctggtccctgtggtttggctggggatgctgaggagacagtgacggggtgctcggcccagagatcgaagtaccaataccatggcgaatagcctccagtgtcggcgc

SEQ ID NO: 653488 - DNA, 409 bp, Homo sapiens
ttataagctcactgaaatattattgctggaggggctcaggcaagctagatgtagtaacgagtgatctggagagatgcgtctcagcaccctccccaggagatgcatctcagtcccctctttccgtccttcccgttcagtcccagccctgggcctgggctgccgacacctggaccagagcccttgctgtgattggtgctccctgggcctcccgggtgtatgaagccaggcgtcggcccctccgggagccctgaggtgagccgccggggtccccctgctgccagacttcgcccgtacctaacatgcatctcactctgggtgtcttggactcttattccatgccaacgtgtcatttgtataactctaaacgcccatgatagtagcttccaactggaacatagcgaactaaaat

SEQ ID NO: 653489 - DNA, 474 bp, Homo sapiens
gaggagttttgcacgttgatcgcctgttcggtgtgggctgagcatggagacatgcctccacaagaccgggtcaatagatgtcccgtcgccaagaaagacaacacttcagaccaagacgaaatgaaacctgcggtgatacttggtgaggaagacgacctgttccgaccacagcctggagccttctctcattggcctcttcgttacaagaagaatcgaggagctccgtccatcagatgatccaaaataatgcttacatcttaaatgaagtctcggatctctaagaatgcctcaggtcccgaaggaaacgccctgagatatggaacgaacctctggagtcccagcgcggcgttgtcctggggcccagagattccattcgccatgtgcgccctgcccccgtccctgtggaagtggtccagaatgttcttgtcgcattgatcaaatccctgacaatgctaccacattctagagccaaaa

SEQ ID NO: 653490 - DNA, 1063 bp, Homo sapiens
tcagagtagacaacaatcagctgctcctgctcatgatccacgtgttcctgagaaaacgaagagcagctgttcaaaatgatcctggatgagcacctgtgtgcacatggatgggcaacctgcagctgctgtactgtgctgctcacagactgctatgtctacctgctccgtgaaatgggtgccacatgagaagccatacctggtggaagaggccgtattcttacaatgaacttgactatgtgtcggttggccttgaccagcagacggtgaagctggtgtgcaccaaccgcaggaagcagtttctgctggacactggctgatgtggcgctggcatgagttacattattttggcattctttgaagtcagacatgatcaaaggctgtcgagaagcctccctaccaccagacatcctgacggatgccaccatggagaagctggacactggcacaaatttagtggcccaagaatcgaagtgtgaggcatctgcttgtcaccgatgacgcttctacggaccttgtgcacttgggaggaccaccacagacgagatccctgggaccaacgccctgccactgctcaaccaccgagggcaccatacaaccaagagaaggcatgcagaactacaaggcggccagctcactaaactgtggcaaaggaaacaatggaacagaagttctaacgagtgatgcatcaaaaaaacagggataccatctaccagtaacccaggacacgaaccggaaaggtaataacatcatgaacaccaggatgaacactagaagatatatatacaacatacgtggacttgacgggaaacacagatatcacgggatttgatcacaatatcatacaagagataatcatcatcgcaactggacccttcctgaagagaataattataacgaaaaccgaggagcacaaatttacacgagtagagagacagtaattcctgtcacaggcagttgacacatggggatacatcacgagaggaagtagatcgcaatacagaatcaaaccagtatacagatatcaacaagtagaaagaataatatgaacacaccggtaataaaa

SEQ ID NO: 653491 - DNA, 99 bp, Homo sapiens
aggccccggcggctggggggccgcaaggacaaagaagacagcagtgatgagctcgaagaaggtcgaagaggcgtgagttagggagagcccgatcctgca

SEQ ID NO: 653492 - DNA, 162 bp, Homo sapiens
cacgaggcgagccggggctatttctggcgctggcgtggctccaagaagggcatcccatgcatcactcttccacctgctccttatagaagggaatatgagtgagtcgagggcgaagtccaaccagcccttggtctccaagcatgtaaaggacggcactgagaa

SEQ ID NO: 653493 - DNA, 527 bp, Homo sapiens
  misc_feature (12)..(12): n is a, c, g, or t
  misc_feature (39)..(39): n is a, c, g, or t
  misc_feature (55)..(55): n is a, c, g, or t
  misc_feature (94)..(94): n is a, c, g, or t
  misc_feature (107)..(107): n is a, c, g, or t
  misc_feature (130)..(130): n is a, c, g, or t
  misc_feature (134)..(134): n is a, c, g, or t
  misc_feature (160)..(171): n is a, c, g, or t
  misc_feature (174)..(176): n is a, c, g, or t
  misc_feature (178)..(180): n is a, c, g, or t
  misc_feature (186)..(186): n is a, c, g, or t
  misc_feature (188)..(189): n is a, c, g, or t
  misc_feature (193)..(193): n is a, c, g, or t
  misc_feature (198)..(199): n is a, c, g, or t
  misc_feature (232)..(232): n is a, c, g, or t
  misc_feature (331)..(331): n is a, c, g, or t
  misc_feature (335)..(335): n is a, c, g, or t
  misc_feature (338)..(338): n is a, c, g, or t
  misc_feature (340)..(346): n is a, c, g, or t
  misc_feature (350)..(350): n is a, c, g, or t
  misc_feature (354)..(357): n is a, c, g, or t
  misc_feature (360)..(363): n is a, c, g, or t
  misc_feature (365)..(365): n is a, c, g, or t
  misc_feature (421)..(421): n is a, c, g, or t
  misc_feature (437)..(437): n is a, c, g, or t
  misc_feature (451)..(451): n is a, c, g, or t
  misc_feature (483)..(483): n is a, c, g, or t
tcccattaaatnatggctgagggctatcccagaggcatnatgccccagcatttcngacctgcttcaagtacaagctgctgagctcctgcagctngagaatgccctcngaccaattatcaggtgctttcancaanaagtatttcacagagacagagacagnnnnnnnnnnnnagnnngnnngggggntnngggnggggnncccacagagcctgctgcatatgtacaagcctantctcgcaaacctctaatgcacacacccttaacttgcacatttcctgtacagatatgctcatcttcatactcaccctctgctccattctcttatctcagnatcntcncnnnnnnnaacnctgnnnnggnnnntncacaaaatggcataataaatagttacaggtaaataggtacaggttcagtaaataanacttgggtaatacttnataattactgaacnaagatcaaggacaaaattgttcaacttgatgnggaaatccacaattgagctgtataggaggaaaagaaccatcttc

SEQ ID NO: 653494 - DNA, 361 bp, Homo sapiens
aggtaccttcagcgtagagatggattttcactatgtagtgcgattctggtctagtaactccagacctcagggtatccacccatctagtgcctccctatatgtctagtgagtactcggtatgagccacaggtcctagaccagtttctgtattaaaatacatcttaggggactgaaaatcgattcctggactacggtttaattccccttattttttttagataaatctgctagtctgatacctattacatatccagagcctggtcataaatacgaatttctgaattttgtaatgcacaaattgctcttataagtaaacagtcagacaccccttctccacacgcataacgcgcctaatggcgtc

SEQ ID NO: 653495 - DNA, 921 bp, Homo sapiens
agagtcttttgggtggtgggcaacgccacactcgtttcgctcgggtcccctcgcgttgtctttgttatacctcatcggccgcggtgccgtcttcggcccgccctctctttggttgtggaggtccctgttgttatcgccgcccgccccctttggggggttctctctccgccgccgtctatggttgccgcctgtctcccacatatggggcaggcccccccccttgtgggtggttgtaaggagcccctccctcccggagtggcccctgccgctctccccccgccgttattctttcggcggggacattaatctcctcccccccttccccggcggagatgttttctttcggggctgttccttattacacgccacgcagcagcgcttctcactcttttttctccaccgcgccctcgcggtgtgagtattattgcggctctcgctgagtggtgttttcgctcacgcaccacacgcactaaaatcatccacctctgcgagtgacgtgtgtggtattcccccccgcccccctcgtctcccctcgcatagtggtgctgttcctctttatatgatgggtcaccactccctccctcaaggcctctcgatgcagggccttgtatgaaagagaacgacttctcaccccgcgtcggtcctctctatgatgaatcatttcgtatttattccgcctgctactcgtgcttgccccacctcgcccgccgtgtccttcagacaggggggcccaccctgctgatcaacaggagttttttcatctacaacaaaacaaaaataatattctcttttgctggtcgttctattccccctcccgttcttctattattttggggcgcccccccccctttcgccccccccacaaatttcgctttttttttttttttttttaaagggggggttttttttattttcccccca

SEQ ID NO: 653496 - DNA, 317 bp, Homo sapiens
ttttttttgtttttggtttttgggtgactgagtctggctctgtcttccaggctggagtgcagaggcatgatcttggctcaatgcaacctctgcctccccagcccaagccatcctcccacctccacctcccgagtagcaggggctacagactcgaccaccacgcccagttaatttttgtatttcttatagacaaggttttgccatggtgcccgggctggtctcgaactcctgagctcaagcaatccacctgcctcagcctcccaaagtagcgggattacaagcgtcagttactgcacctggcctctttctcgtcgacg

SEQ ID NO: 653497 - DNA, 1070 bp, Homo sapiens
  misc_feature (366)..(366): n is a, c, g, or t
  misc_feature (509)..(509): n is a, c, g, or t
  misc_feature (548)..(548): n is a, c, g, or t
  misc_feature (558)..(558): n is a, c, g, or t
aagaagaaacagcagaaagcagtctcaggttcaacttgccattcaggtgttacttgtggataagcacaaatatttcctgttggttaaactttaatcagttcttatctttcatctgtttcctaggtaaaccagcaaattggctcgataatatcgctggctaagcgtcaggcttgttttcatgctgtgccactccagagacttctgccacctggccgccacactgaaaactgtcctgctcagtgccaaggtgctactcttgcaagccacacttagagagagtggagatgtttatttctctgctcctttagaaaacgtggtgagtcctgagttccactgctgtgcttcagtcaactgaccaaacactgnttgaattataggaggagaacaataacctaccatccgcaagcatgctaattgatggaagttacagggtataccatccgcaagcatgctaatttgatggaagttacagggtagcatgattaaaactaccttgataattacagtcnaagatgtgtcacctcaaaggcttgaagaatatatttctnggtgaatttngtatgtctgtcatatgacacttgggttttttaattaattctattttatatatatatatatgtttcttttcctgtgaaaagctgtttttctcacatgtgaacagctggcacctcattttaccatgcgtgagggaatggcaaataagaatgtttgagcacacttgcccacaatgaatgtaactattttctaaacactttactagaagaacatttcagtataaaaaacctaatttatttttacagacaaaatatctgtccgttttataaaaagttatgcaaatgactttatttatttttatttcctgcataccattagaataattttatttcatttcttcaaattaccaagcactgtaatactataaattaagtaatactgtgtgattcagactataaaaaatcattcagaaaattataatcgtcatcgtcaacaagatttgatgtataagatgatatttccttacaatactgggaatccagtggcgagtgagacattatgtttatgaaatatta

SEQ ID NO: 653498 - DNA, 139 bp, Homo sapiens
ttctctgtgggggacgctctcagtggggtgaggtcgctcaggtgggaggcaggaggattgcttgaacctgggaggcggaggttgtagtgagctgagatcgcgccactgcactccagcctcggccccacagagagagcgt

SEQ ID NO: 653499 - DNA, 421 bp, Homo sapiens
  misc_feature (94)..(94): n is a, c, g, or t
gacacacgaatgataagaaagcaaacagccttaattgctgagatggagaaagttatagtagtctggatagatcaaacagcccacagcatgcccntaagccaaagcctaatccagagtgaggccctaactcgcctcatttctgtgaagacagagaggtgaggaagctgcggaagaaaagttggttcatgaggtttaaggaaataagctgtctctgtaacataaaagtgcaaagtgaagcagcaagtactagtggagaagctgcagcaagtcatccagaagatctagctaatgccaggcatggtggctcgtaattgatcatggtgtctataatcccaccactctgggaggccagggcaggaggattgcttgagcttaggagtttgataccagcctgggcaacatggtgaaaccccgtctttgc

SEQ ID NO: 653500 - DNA, 244 bp, Homo sapiens
ctttttttggggggggggggtggggggcccctttttttttttcctttaagttcccccccccccccccccctttccggggggccggggtttttttgggggggcccaaaaaaccccccccccttttttttttgggggggttttttttaaccggcccggggcccttgggttaaaagggcccccctttccctttttttttggggggaaaaatttttttttttaatggggggggggttttttttttgta

SEQ ID NO: 653501 - DNA, 1052 bp, Homo sapiens
cagtgagctatgattgtgccactgcacttcagtctgggtgcagagcaagaccttgtcttttttttttttaaatcatttttttaaaaagtaattttagtgttaagctccatggggctataggtcctttattattagtttttttttttgtaaaaagtgagaattgcgcccgggctcatcaccacgctcagggaagcggcgcagggcggggagactcagagcgttatcacaaggaaccctctccagccctccggggggtcaacagggagtcttcttgtggtgccctcagccccactgtaggcgggggcgacatacggggacacgcccaccacagccctgggtattgttttttcagaattttttagcacagaaattgggggttttccccccgatgtgtgtgggcccgggaccgagtgggccctgtagaaagaatccgcttgaaccctaaagagagtgaatcgctgggcgccgcggccctccgcaaagtggtggggttggggacctccgggcgtgggacgccaaatatagtgtcctgggtgccaggcgggatataagcttctaaaatatatattaaacactactctacgctacagaacgtgtttctaaccccacatttcggggcccaattaactggggctgtttcacacaacacgttttttaaaattatgtaccacaagggataaatcttcagcggacagggtgagttttcggggacacaccccgcgtgatatccaccccaatggttgttagtgggaacccccagcggtatacgcctctgcgataaggatatttcttccgaaattggtgtcattggccttgtgttaactcacttgtctgttctctccccctttacaaaaacccaagctggcgtatcttctcacatccttgggaggtggaccctcgcaatcgcgggccaacaaaatactcgatcagaagagaacccagggtggcaaatttgcggctatggcccacaatatactacggggttcgcgcagactcgtggtctacatatgcgacgaccattggtcgtgacatttatataaacacaaagcagg

SEQ ID NO: 653502 - DNA, 142 bp, Homo sapiens
caactgttctggaatgtcatgtgtatacagctcttcggattcctggctttcatgatattcatgtgctgagatggagagacgtagtaccctgatctaccagacacactgaacatccatgaacgccaggaaaccgagggagacc

SEQ ID NO: 653503 - DNA, 606 bp, Homo sapiens
taaaaggaaaacccggtaatgatgtcggggttgagggataggaggaaaaggggggataggtgtttgaacttgagggtgtttctcgtgtgaatgagggttaatgtggtaaaggtggtgggtgagtgagccccatggtgtggtggtaaatatgtagagggagtatagggcggtgactagtatgtggagtccggtaagtaggagagtgatattggatcaggagaacggtggttactagcacagagagttctcccagtaggtaataggggggggataagggaggtagagaggttgctaaaagtcatcaaaaagctatagggggagtacgaagtcgaacgccctctgcgacgaggatctatagatcgcacactggggcgagcgcgtcacgcaacatcatggaaggtccggctagcgccccaacccagtcaatagacgcgactgtcaacgcccggggtccccacccctgccacactgactcgcacgccggtgcaccgcccacagcggagcttccggcactcgccaccggggctcgtcaccaaacgaagcgggcacctccggccgccgatccgacacgagcattcaccaccggagcccaccaacagggccagc

SEQ ID NO: 653504 - DNA, 961 bp, Homo sapiens
  misc_feature (961)..(961): n is a, c, g, or t
tcagattggatttctggtgaaggcacagaatgcctgtatatgatgtaactgtgtcccccctcccgcccccaccaaaaaaaaaaaaggaaagaaaagttgtccatattgtgtaaattataccttgctaaagttaaaaaaaatagttttaaagggaaaagtcaattattgaataaacgggcttgaggctggtaggtctaaaggcccatagaacggttatagagatgtatatagaattatagttcttatttttttccttggtgtgaagccttttataacagattaacaatcaactgcataaatattattaatattttaaaaagaaagttaagtggtatgtgggtaattcacaaactatcatgcaaagaaaaactcagaaagacagaaaagaataaacatgatttgagataacatgtatttacaggggatgtggttttaataaaattagtcccctataattgtccctgacaaggtacagaatggtatatacttataatggtaatggagttagaaacaaagatcatggtggcacttccatccagtaaaaactgcactgaatgaaagagttaaatctcaactgaacttttcagttggttggaacaagaatgcatggagatttatatagctctaattatagaataactaggctgtgacgaagtgtaggttgggcgggtgcatagtgaatacgtaaagtaggacccggattgaggtggaaacagggccaggaacacgtagaagagcacgacattaagccaggagcacattacaaagagctgacatccatgagaacgcagggcatgttcggcacgaagtaacgcacgaaacgtcgaggtaaattctcctcctacacgtatacggacaccatgaataggtagaagtactagaagacagtaagacgacaacgaagttcgcaccaccagcaacacattcaacctggcgacacatagctatactaatccattcn

SEQ ID NO: 653505 - DNA, 81 bp, Homo sapiens
agcggggctcctcccgcgggtggcagcggacggggcgcgcccctcggccagtcctcggtcctcaggcttgtggctccgttg

SEQ ID NO: 653506 - DNA, 496 bp, Homo sapiens
cacgagagagagagagagagagagcgagagagagagagagagagagagagagagagagagagcgagacagagatagcgagtgtgagagagcgagacagagatctctagtctccgtctttttctttcccttcttttctcttctcgcatcctgtacgcctaagtctttggcaggtcactctcttccccccagcccctcctcggcgcgacgtgactcatcgctcggtgcgcccgcttgatatttgacaatttgacctctctatcctgggttcttgtcttaatcactgcttgatgcctttccgctatgttggcaccagattttttgctattgtgtctgcaatctcttccactcactttatcagcatttttctctactcttgtactcgttggtactagcattatcctgctttatggttcccacatcttgttgccatatctcgtcgtatgactttttcacttctctattcggccctcttgtctccagtgggttgtccgggct

SEQ ID NO: 653507 - DNA, 192 bp, Homo sapiens
tctgagtggcccagtgtggatgctgagtgacagcctcaaacttaacactcagtctaaggctctttccactaaggagctgcctctacccagggtccaggaagggctcgccaaggcacctcctcacagcccccttctccaccgaggtgacacacagcacaccgtgtattggacgcacttcctcacgttgacacc

SEQ ID NO: 653508 - DNA, 985 bp, Homo sapiens
acttgacctcagctgcgatctgtctgacagcaaagatgcttattaagaagacgtggaaccccaagttcaccctgcgctcgcactacgaacgtgcatatcgtatccctggtgacctataccaccacagccagtcaggctctgctcaccgcctccgaggacggcacagctcaatgctctgtgaacctgcacgaagtgctggtcacagggacaaggaagaattgctgtgctgctagatgtgtgaacctatacatgctttacctgggactcacatgggattgcccacgtgtattggctgtgtgctatggggcagcaacaagtgaataccatgatacatgatggacaggtggccggagtgccatgcaaatccacttagagttagggaaagacttctcaagaacactcagcagttggacatcccttaatgatggacatacagaaccaaagcagatgaattgagacctactgatacttggaagggacaacagtaggacgccgatggagagaggccatggacgctatcaagtccagaccatacaccaatacgaccatggacatacctagaatctgcatggataggcaacccgatacccgaaatacaatggtgaacgacacaaagacaaggcaagacaggaccggtgatctgggagtccttgagaaacctaacaccacaacagagacaaagtggatagcaacaggagggatacaccacaaacaatcaaatggaacataacagcagagcaacacagcagacatagaccaaacaattggatggccctccatatccggatcgtggcagacaacgacattgatattgaatatggcatgatggatgagcacatagaacaagacggaggatcctagggctaaaaggggacgagcaaggacaccaagtagtagattatcacaaagcatcaccattacgcgcagaagaaggagaagcgaactggaactgaaagagcgggagtcgtgtagcatgaagagaaca

SEQ ID NO: 653509 - DNA, 165 bp, Homo sapiens
ctctagagatccccctgtatctggagacaaaaaagggggaggggggccgaaggctcatcattcaacaataaaacaaaataaataaagtattaaggcgaagataaaaaaaattttgcatatacataatttacacgaaagcaatgctctcacctccccgggatacag

SEQ ID NO: 653510 - DNA, 312 bp, Homo sapiens
gaacagtttgcctggagacattctactggtaccttaccatgaggtatccagtatctccgtgataccttcatctgccccggagattgtgcctccacctacgcgtagccgtcagagactggcaggctcgctaaaggtctgagggtgagcgacctcgagactaaagagggagctacaagatacctcagacgagtctgtccacctgtgcgcagaagcgagctgggctggtacaccgattcagttgagcgattgcgtgacgtgtagcacctagtaattggaaggtcttttcattaattacttaagcaaaacctaaaa

SEQ ID NO: 653511 - DNA, 492 bp, Homo sapiens
tgtattatattcttttgaattacacttttgatatcgtcctcaggcaaacagattttcagaatttaataaataaataaaagcaactctaacactgagtagttttttgaaataaattataattgcaaagaactaaaataacttcatcaagaacacacactacaatttgaaaagatttttctctttttcatggctcctacagagaaaacaaaagtgaaagtgtgggaaagagacaggttttagtcacaaatattagaaatataaaatagcataaaacttatatgatagttcctcttctactatagaaatttatcctccaggataaataaatttgcttcatgcaggacagttttaaacatcactagtaaatgaaattatacccccttagaatataattttacagttgaattttttgtctttttagagactgttaccttatgtatccgtcatctgagcttattttggattacttttggtataagactttagttaata

SEQ ID NO: 653512 - DNA, 820 bp, Homo sapiens
caggactgtggtttgtcgttccacatgtgtttcttgctatgttggattactagaagaagtacagcttacaaaggaatgccctagaacaaggaacgttttcatctattacaatattttctcccagtgttcctgatagtggcgactattgcggccaatggggtcatcatagcactatatagagagaagctgtcaatgtagtgtcttcaaaggagggaaaacgttctacgaatctaagatccatggagctagaattggtagaatctaggctcatcagaatcgtcgactatggattgctccgatcaaactgtgaaaagtaaatgatgtggaccttgctggaaacaaaggcttagcacactatctcttgttcaatggcccaccaagacatatagaattgggaactgatacatgtgtcccttataggctcatttaattatatctctacaatttcttatttagggggaaacttatttgaatcagattagatttagtcataccaccttttatgttttattatttttgaattcatggagccatgataaagagattttgtaaaatcagaattattgatagcgctgtagtgcggagtatgtcaatttgtgaatgtataatcagaagtcgtgaatttatgtataggacatatagctctaggtaacttgccagtatctttgggttgacaccttgtatcgtcacagctctgctctatgtacttataagttttgcaaaataaccatgtgtaacatttgataaagcatatttatgaacatatttcttaataagaaaaatatgccattttattatactttctaggtttttcaaaata

SEQ ID NO: 653513 - DNA, 85 bp, Homo sapiens
tccgttcttcaaggtggaagccaagagaggcatcaggatgggtgggtttctgattgtggcaacgtttgctaccgttcacagttac

SEQ ID NO: 653514 - DNA, 468 bp, Homo sapiens
tcttcgtgccttctccaattaaagggctgatgggactagcctatgaagcagagaagtggtttcttcactacttcttggacccgactctcgtctaggtactctgtctgactcattctgtaacggatggaggatcgatttgggtaccccgtgctcaatgggctcaccatggatcagcacgcacggtgaaggagagctgcaggagaagagtcccaagcatactggttcatgcatgcgatgggctttgtgatcacgaaccagttactgctgtcatgagagtagggggaagagaagctaaaaccaagagtgcgaatgatggagatgtctggcagcgagtcggaagagcctccatgaatgctttagtaccagacttggcaaatggttcccaaattatttatgagatcagctttggtcatgccaatgcctgtgtctaccaaagtcagggtacgttcctgacggtaagggagatga

SEQ ID NO: 653515 - DNA, 303 bp, Homo sapiens
  misc_feature (189)..(189): n is a, c, g, or t
gcgaggccacatcgactacagacaccatggggaaggtgaaggtcggagtcaagcggattggagtcgtatatggagcgcctggtcaccagggactgctatttaagctctggtaacagtggatattggttagccagtcaatggaccccgttcattgatcatcaatctacatggttctacatgattccagantatcgattccgagctcgcgatggtcaatattcctactggcgactcgtccaaggcatgaggatacgggtaagcgttgtcgatcacagtggataagtcgccatacacacgatcgtt

SEQ ID NO: 653516 - DNA, 150 bp, Homo sapiens
tgagacgaaaaggccggctgagcggtctgctgagtgccaatgactatactataacacgaccgtgtcaaatcatctattcacagctgagagacacatctacgtgctccgtccatggctcgatgcctcaggcctgaccttttctcgctacct

SEQ ID NO: 653517 - DNA, 159 bp, Homo sapiens
ggaagacaatatccaagccaaagcagaaacatggcacaagcacaccagcatcagcgcgtgcccgctccagaccacatctgcaggctctgccttgcgtcactgaacccaaagaagtgctacgcgcccgaaaaacgggtcgcgttgaagcatctagctaac

SEQ ID NO: 653518 - DNA, 278 bp, Homo sapiens
ggacggtgcaatgagacacgctatgatctcaccaagtcccttcccaagattctgggacccggagatcacctccaccataaggactcgatcgaggcccaagatgagaaaacacatgctcctggccaggcgcagtggctcatgcctgtaatcccagcacttttggaggccgaggcgggcagatctagaggtcaagagatcgagaccatcctggctaacatggtgaaaccctgtctctactaaaaatacaaaaaaattagccgggggtgggtggagagcgg

SEQ ID NO: 653519 - DNA, 555 bp, Homo sapiens
aaaacaaacttttaggttcaagggcacatgtgccggtttgttctttgggtaaacttgtgtcacgggggtttgtgtgtataaattatttcatcacccaggctagtacccgatagttattttgtctgctgctccccctccaccctccaccctccaataggccccagtgtctgttctgctctatgtgtccatgtgttctcatcatttaactcccacttatgaagtgagaacatgtggtatttggttttctgttcctgcattacttttctaaggataatggtctcctgctccatctatgtccctgcaaaggacatgatctcattcttttttatggctgcagagtactccgtggtgtatatgtactacattttctttatccagtctaccgttgatggatttaggctgattccatgtctttgctgttgtgaatagtgagaagattctgtttcatcccactgaacccacagctacagtcaccccaaaagcagcagcagaggagttcccacaagggagtgcccttaaccgtccccagatggggctggttgggattccaaagaa

SEQ ID NO: 653520 - DNA, 357 bp, Homo sapiens
acctcctacccacgcatcattaaaggatatacatattatacttcatcttcatcctcttcctcctcatcttcatcttcttcttcctcctcctcctcctcatcttctgggtgtcgtgcttcttctttgagcctgtgtgggctgtcaggggccttctttcctgcgttcacttttgcccttgtgcacgatatgcaccaatatccttttcatatttctcctcttatcttagctgctttctgtgcatatggttgtgtatctttgggctgagtgttcacaccacatttcacccaatttctttgcagtatcccccctggatatgccacggtgtgcacttttgatctttgggcgatgtgcacagca

SEQ ID NO: 653521 - DNA, 174 bp, Homo sapiens
taggagtataagactgtcatgaacaacgacgtaatcaccacccaacaatgactaatcaaactaacctcaaaacaaataataaccatacacaaacaattaaagggaggaaccttgatctctaatactaattatccttaaatcatttttaattggccaacaagttaaccttccttc

SEQ ID NO: 653522 - DNA, 114 bp, Homo sapiens
ccccgatagacgtaataaaataaaagtgtcacaagctacatgatggatctcttcttttaagtgtatgcataggagtttcagtttaggctagtgatgggctaactatgctcagcc

SEQ ID NO: 653523 - DNA, 129 bp, Homo sapiens
  misc_feature (129)..(129): n is a, c, g, or t
tgaccaataaagctaaaactcacccgagttgtcaaaaactccagattgacacacaatagacttcgaaagtggctttaacatctctgaacacacaatagctaagacccaaactgggattaggggatcctn

SEQ ID NO: 653524 - DNA, 201 bp, Homo sapiens
ccaaaaagaaatttttgggcaaccgagggctcccaatttggaatgggaggttaacctttgccttttcatttttttttgaagggcaaaatttccgcaaaagcgcgcaaaagtcttttcaagaaggggccgaaggcccaccaaccaattccgggaaattaaaagccctttgggttaaatttgaagggaatttgccaaaaagaa

SEQ ID NO: 653525 - DNA, 112 bp, Homo sapiens
tccaaaaaacagtcaaagaagcatttccctttgaattcagtcctaaaaatatgaatgcctgataatgaatttcaaaataagtatcttacaggtgtgtccatgagacagggta

SEQ ID NO: 653526 - DNA, 421 bp, Homo sapiens
  misc_feature (23)..(23): n is a, c, g, or t
  misc_feature (34)..(34): n is a, c, g, or t
  misc_feature (63)..(63): n is a, c, g, or t
  misc_feature (96)..(96): n is a, c, g, or t
  misc_feature (404)..(404): n is a, c, g, or t
  misc_feature (409)..(409): n is a, c, g, or t
  misc_feature (411)..(411): n is a, c, g, or t
  misc_feature (413)..(413): n is a, c, g, or t
tattgtgggtttttttgaaatgntggtttttaanacttgatttaatcacccactcaaaaatgnttttgatggtcttaaggaaaaatctctgctttnactctttagaaataatggtcattcgggctgggccgccaagggtcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaanacacnantntccatctc

SEQ ID NO: 653527 - DNA, 145 bp, Homo sapiens
agcacgagccgagggatggacatcttgtcattcgtatctttgaataaatgtcacttgttagaggcaaaagaaggaaccgtgaacattttagacaccctttatctttggggtaggctcttgccccaggcgtcggctcttgcctcct

SEQ ID NO: 653528 - DNA, 557 bp, Homo sapiens
  misc_feature (2)..(2): n is a, c, g, or t
  misc_feature (14)..(14): n is a, c, g, or t
  misc_feature (44)..(44): n is a, c, g, or t
  misc_feature (50)..(50): n is a, c, g, or t
  misc_feature (111)..(111): n is a, c, g, or t
  misc_feature (197)..(197): n is a, c, g, or t
gnttaagccagaanatttgttaaggccagaatttttgagcccancttggncaatatagtaagcccataggctgggtgtggtagcctacgcctgtaatccccccactttggnagactgaggcaggcacatcacttgaggtcaggagttcaagaccaggctggccaacacagtgagaccccccatctctaccgaaactncaaaaaattggccgggcgtgatggtgcatgcctgtggtcccagctactcaggaggctgaagcaggagaatcacttgaacttgggaggcggaggttgcagtgagccgagattgagccactgcactccagcctgggcaacaggagaccctgtctcaaaatatatatatatacacgtctgtgtgtgtgtgcgcgcacacgtgcgtataacaagccaagtgtggtgatacatacctgtggtccttgctactcaggaggctgagatgggaggatcatatgagcccaggagtttgagtttacagtgagctgtgattgtatcactgcattccagcctgggtgacagagcaagaccctgtctctattt

SEQ ID NO: 653529 - DNA, 267 bp, Homo sapiens
tacaagaaagagacgagatgctggtggcaggtcatgaggacagcaatggttgtatcaacgtataatgcgttcgtgatggcatatcctgctcggggtgacgggcccatgtgggcggagctcgtccgcatggtgctgaatggctgagcgaccttcccaatctccccagagtccgtgcctttcccctgtgtgaatttgcgtactctagcccaaagtttccctagcgcttccttgtctcccccactctcccctctcgtctcttctcttgta

SEQ ID NO: 653530 - DNA, 229 bp, Homo sapiens
gtcgacagaaaatattttgggcaggtgtggtggctcacgcctgtaatcccagcactttgggaggctgaagcaggaggatcacttgaggccaggagttcaagtccagcctgggcaacatagtgagaagattgggtgtcctgcacatagtaggaagccaaaaatttgtcaagtgcaggtgtctgctgttcctgggaggttttagaggggagcagacgcttgactgtcgacg

SEQ ID NO: 653531 - DNA, 153 bp, Homo sapiens
tggaaatgagagtgtctcattctgttgcccagaactaaagtgctggtggcacgatctcagctcacgtgcaacctctgcctcccgggtttcaagacaattctccgtgcctcagcccctccgtgagttagcgtgggacttacgggttgcctgtgc

SEQ ID NO: 653532 - DNA, 154 bp, Homo sapiens
accatctcatgcccagtgtttcttctgatttttttttccccttccctccctccctctccggcattcttccctggttcagcacaggtaaaacggttcccctccctcccggccttcatggatcaccaccacacgatgaggcatgagatgttggaag

SEQ ID NO: 653533 - DNA, 305 bp, Homo sapiens
  misc_feature (1)..(2): n is a, c, g, or t
nnggtaacccgtatcttctaacacttaacggccagtaggcaccccccatgtaaaagtgagctgccagaccgtctcttaaaaaatgtttccctttataaaagcaccactggccggttgaatcttaagggttaaaattttaatatgaaagatcctcatgaattaaatagttgatgccatttttaacgttaattgatataaaaaaaaaaacaacaaaattaggcttgtaaaactgactttttcattacgtgggttttgaaatctagccccagacataatgttagagatacgggatcctctagagcacc

SEQ ID NO: 653534 - DNA, 720 bp, Homo sapiens
  misc_feature (720)..(720): n is a, c, g, or t
gcacgagggagcacaagcagatcttctctgcggagaaggcagatttccagctcctaagaacaccctgttccacatggaagctgacgtgcccttccccagggacccacgccaaaaggccattcttccaggccagcgtcccagggcgctgctgtgcgtggttcgcagccccggcaaacgatggcctgcactgcgtgctgtccgccctgttcctgctggactctctgcactgtgtcctgatcaccctctcagctgatagtgggcactgcagtgtgaatcttctcatggacaacagaccaatcctgcctccaccagtgccgtcgccaaatcagtaacacagagcaacctcaaacatttctgaatgtttaggtcatctaatacttggcaaaagagtgggccgaacacctccaccctcagctttctcttctgtttgagtgtgagtgtgtgtagcagagtctgagaaagatacatacagccaccttccttttctgagctagggaaaatttgaacaagagcactgaaatgcaaacactaatcaaaaaggaagtattttccattttaattctaaagagtggaaatagaaaaaaatgattttgctaaaacaaaatatgcagacacctttgggcgtgctataaaggcccatgctactccagagatgacccagccggacagaggtgggtgtggacggacagcatggatctagatgattccacacgtttgggn

SEQ ID NO: 653535 - DNA, 877 bp, Homo sapiens
  misc_feature (74)..(74): n is a, c, g, or t
  misc_feature (114)..(114): n is a, c, g, or t
  misc_feature (138)..(138): n is a, c, g, or t
  misc_feature (161)..(162): n is a, c, g, or t
  misc_feature (167)..(167): n is a, c, g, or t
  misc_feature (208)..(208): n is a, c, g, or t
  misc_feature (226)..(226): n is a, c, g, or t
  misc_feature (231)..(231): n is a, c, g, or t
  misc_feature (249)..(249): n is a, c, g, or t
  misc_feature (300)..(300): n is a, c, g, or t
  misc_feature (305)..(305): n is a, c, g, or t
  misc_feature (313)..(313): n is a, c, g, or t
  misc_feature (316)..(316): n is a, c, g, or t
  misc_feature (320)..(320): n is a, c, g, or t
  misc_feature (326)..(326): n is a, c, g, or t
  misc_feature (328)..(328): n is a, c, g, or t
  misc_feature (357)..(357): n is a, c, g, or t
  misc_feature (379)..(379): n is a, c, g, or t
  misc_feature (382)..(382): n is a, c, g, or t
  misc_feature (390)..(390): n is a, c, g, or t
  misc_feature (401)..(401): n is a, c, g, or t
  misc_feature (403)..(403): n is a, c, g, or t
  misc_feature (407)..(407): n is a, c, g, or t
  misc_feature (416)..(417): n is a, c, g, or t
  misc_feature (424)..(424): n is a, c, g, or t
  misc_feature (428)..(428): n is a, c, g, or t
  misc_feature (437)..(437): n is a, c, g, or t
  misc_feature (477)..(477): n is a, c, g, or t
  misc_feature (481)..(481): n is a, c, g, or t
  misc_feature (514)..(514): n is a, c, g, or t
  misc_feature (553)..(553): n is a, c, g, or t
  misc_feature (556)..(556): n is a, c, g, or t
  misc_feature (583)..(583): n is a, c, g, or t
  misc_feature (620)..(620): n is a, c, g, or t
  misc_feature (744)..(745): n is a, c, g, or t
  misc_feature (844)..(844): n is a, c, g, or t
agaggtgcctcccgctcgttgccgcgtcctacccgcaccgtgcgcggctcgagctgaggacaccaacggccgcnactccccggcgagaccaggccggagcgtggacggcgcgcncgccccgcgagggagggcgctgangcgcgcgccggaagcgggagcgnnagcgngagcgcggcggcggcggcgaaggtgcgggcggccgagcggngggcggggctgcggtgcntgcanaaccttggacagaagctncctagctgccgccgccgccgctgccgccgtcgccgccgccgagcgcgatcncagcngatccccnccnagcncccccnancgccgccgagcgccgggaccgcggcggcngggccgcggtcgcgcattgcgnagngcgcgganaggatctgccncntgcngggcagatnnaaggggncagnacgcttccngggagcgccccctcctcctctccgtgggccgccgcaggtncggntgagcgcgttttatccctccggccggcaggctngcgcgcgcaggggcgcgagcccccggcccggtcgcgcanagncacccatgtggcacggtgctgtccctntctcccagctaccggaaggccacgctgtttgaggatngcgcggccaccgtgggccactatacggccgtacagaacagcaagaacgccaaggacaagaacctgaagcgccactccatcatctccgtgctgccttggaagagaatcgtggccgtgtcggcaannaagaagaactccaagaaggtgcagcccaacagcagctaccagaacaacatcacgcacctcaacaatgagaaactgaagaagtcgctgtcgtgcgccaanctgtccacattcgcccagccccaccggccagcg

SEQ ID NO: 653536 - DNA, 139 bp, Homo sapiens
  misc_feature (111)..(111): n is a, c, g, or t
gtggtgatctagagatcccaacctacagcgcctgtatgatggttctttatcatttctcttccccctttttgggcatccgggctggcctccagttttaggtcctttagtttncttctggtaaggcaacgggagaacacct

SEQ ID NO: 653537 - DNA, 258 bp, Homo sapiens
gctagtactgtgtaatatatataggaaaacatgtgtgtgcacattgctacatctatatatcttcacaatatataaataaataagcacgcactatgtgtgagcagatagaaagaatgatagagtcatagctgtaacacgtggttattataaataaataaatagatgaacttctggctgatttaaagcagaataaaaagtgaaaaagtcaattacataaaataggaaaatataatttacgggtaactaaagaaccaagga

SEQ ID NO: 653538 - DNA, 317 bp, Homo sapiens
  misc_feature (4)..(4): n is a, c, g, or t
gtantggggatcgtgggaatacgatcacccaaatagcagcacataacacccatatatacagcagcccccatatgtttaacaccactgtataccagcatcgtgcttgccatttcctatgccttctcttatatgaatccacttaacatgctcttcaatgaccaagagcaatcatttggcagcccccatcttgtagattgaggagccttgaggctcatgataagactaatgttacacgctactgacgatcacatcagctgagcgtagagaatgggagtcagcatgaagccacctgtgaatccgtaggtctaagcttgcca

SEQ ID NO: 653539 - DNA, 437 bp, Homo sapiens
  misc_feature (273)..(273): n is a, c, g, or t
ttctcatgctgaatggagagatcgtacctgaaggagtcaaattatgcgatcaactgtaggctcaacagactaaggacaaaatggcaggtcttcgacaggtaacactatgtgttcactcgatctgttatatccacagcaccaaggcatataatagacaggaaataaatgcgtagatgaatgaatagaacaaaacttgttgatattcatgcaggtattttcctcctttccttaccagaggatgacagaaccctcggaatgacaaaagggagcatngggaacttattaggaggtacgtgtgtttccaggaggtgaggggacagaagagaggtgcactggaagtggtttcccaaatgtcaagagagttgcctaactctttggaggaagataagactccaagaaacaaaatgattaaagaacagcccacgaggcatacagta

SEQ ID NO: 653540 - DNA, 921 bp, Homo sapiens
agagcgaagggcgtacagccggaaaccgtcggacgcgacaaacatgggagccgagactggcgggcgcacgggcgcatgtgagaccgcgaaacccgcacatggggactattagcggaactcagccaggaagtgatgagaagaaatgtttccgccgggagacccttgagcgccagcaacaatgtccggtatccaattcagaaaaggcaccaagtacttccaccaggggaaatcagaatggctgaccagagattagcgagaaagtggtcgacccaagagctaacacggccacaatggtggtatctggtgtcgcaggcttgaagatggagagaactttaagtgttatatgacttgccagatcaactacatgctgccagttggtgcttccccgtgctgctgttgatgctggctttgttccccatgacaagccagttggaccagacgggaaaaatagtagcccccagaactttatattgctgttggaatatctggagcccatcccaccatttagctgggatgaaagaccagccagcaccaattgtgcccaatttataaagaccccagaagctcccattttcccagtggccagattatggaatagttgcaagatttatttaaggtagttcctgaaatgactgagatcttgaagaaaaaatgaatcaggatcatgccctttaaaagaaaacttttgttaaagtattcccacctgaaatcaccagatatttgtgggtattatcaccaatccattggaaagcctggagagctacctttcataatttgagggaaaatttttaaccgatgtcccgaatgcttgtttatgggattgctgtgtttccttttaattatttgtggttcccaaccattattgtttgaacttttttaattctgtactaaatttataatataagcttttcccccgcttta

SEQ ID NO: 653541 - DNA, 393 bp, Homo sapiens
  misc_feature (173)..(173): n is a, c, g, or t
ccccgaacatgtcgagctgtagcatgaagtgtggccggcacacttgaggaactggacttgtttatttatttatttttatttattattatgtattgggagacagagtctcactctgttgtccaggctagagtacagtggcgtgatcttggctcactgcaacctccacctttggngttcaagtgattctcctgcctcagcctcctgagtagctgggattacaggtgtgtgccaccacacccagctaatttttatattttgggtagagggggtttcgccatgttggccaggctgttctcaaactcctgacctcaggtgatctgcctgccttgccctcccagagtgctaggattacaggtgtgagccaccgcgcccggactatccttgactgttcca

SEQ ID NO: 653542 - DNA, 101 bp, Homo sapiens
agagtcagactagagaggaccgggtctgcagccagccggttagggatgtgggggtctgctgatccacacacaccaccttcttcatgtcctcaaagctgtgg

SEQ ID NO: 653543 - DNA, 112 bp, Homo sapiens
aagagtctatttgggattgaagactgaagtctgacgacacggccgttttttattgtgtgagagaccgttggcagcagccgatactgggtgacgtctggggcccgggaacccg

SEQ ID NO: 653544 - DNA, 241 bp, Homo sapiens
ctgaggattccccggcggtgtacaggcggtactacatgcggtactacaggcggtactacaggcggtactacaggcggtactacaggcggtgctacaggcggtactacaggcggtactacaggcggtactacaggcggtactacagacggtactacagacggtactacagacggtactacagacggtactacagacggtactacagacggtactacagacggtactacggacggtactacag

SEQ ID NO: 653545 - DNA, 148 bp, Homo sapiens
  misc_feature (19)..(19): n is a, c, g, or t
tgcatgcatttgccagganatcccacatcattcggattttgttcaactcaatgctgcttcaaaaaaatggtggaatattgataggggggtgagctatgattacgacgtccggcgatattaatgtggatatatttccgcttgtcccaag

SEQ ID NO: 653546 - DNA, 182 bp, Homo sapiens
aagcttgatagcctaggctggtctcaaactcctgggctcaagcgattcacctgcctcagcctcccaaaatgctgggattacaggcgtgagccaccgcgccagcctgtttgcatcattttaagggacacgaattatgtctttctcgggcgttacattatagacggagctgctttccctccttt

SEQ ID NO: 653547 - DNA, 205 bp, Homo sapiens
acggacgtccagctgagatctcctaggcggactacacaggtgtcggtaactggaaaagtctgttcggccggagcgcttagtagagagaccttcactcgccaactgggaggaccgaggggacttaagacataagtttctaccttggggaggttaactacgggtatgttccttaaacgaagccttggtgtattaatctggtcgaccg

SEQ ID NO: 653548 - DNA, 347 bp, Homo sapiens
attctttctctcatgtgcagtctgccaaaaagtacactagatgcttaatatagcccaatataataatcttgtcctttgtgcagctcatatttcaaggagtacaggaggagagagaaaattaagtaaatatatggtgataaaggctaaatgaaaactagggtggtcacagagtctgtctaataccctgacatttgacgcagagacctgacaagcaagacatggagatccagggaatatgacccagaagagatgagcagctgcaaaggacctgaatacaggatgatacgtggcccattaaagcgctagccagggagacagtgaaagtggagctgaatgagtgagcacag

SEQ ID NO: 653549 - DNA, 751 bp, Homo sapiens
  misc_feature (637)..(637): n is a, c, g, or t
  misc_feature (649)..(649): n is a, c, g, or t
  misc_feature (663)..(663): n is a, c, g, or t
  misc_feature (667)..(667): n is a, c, g, or t
  misc_feature (677)..(677): n is a, c, g, or t
  misc_feature (689)..(689): n is a, c, g, or t
  misc_feature (730)..(730): n is a, c, g, or t
acgactggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagaagccggccgggggcccccagcccggaatccttggggggctgtaacaggtcctcggaagggangctcccgccggnaatgccctgggganatcngtcatatgcngaactcatcagncaggccattgaaagcgccccggagaagcgactgacacttgnccagatctacgagtggatggt

SEQ ID NO: 653550 - DNA, 549 bp, Homo sapiens
  misc_feature (385)..(385): n is a, c, g, or t
  misc_feature (392)..(392): n is a, c, g, or t
  misc_feature (396)..(396): n is a, c, g, or t
  misc_feature (417)..(417): n is a, c, g, or t
  misc_feature (450)..(450): n is a, c, g, or t
  misc_feature (455)..(455): n is a, c, g, or t
  misc_feature (458)..(459): n is a, c, g, or t
  misc_feature (461)..(461): n is a, c, g, or t
  misc_feature (463)..(463): n is a, c, g, or t
  misc_feature (472)..(472): n is a, c, g, or t
  misc_feature (476)..(476): n is a, c, g, or t
  misc_feature (485)..(485): n is a, c, g, or t
  misc_feature (490)..(490): n is a, c, g, or t
  misc_feature (503)..(504): n is a, c, g, or t
  misc_feature (545)..(545): n is a, c, g, or t
acgactggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagcaaaaaaanaaaaaanaaanaaaaaaaaaaaaaaaaaaatnaaaaaacaaaaaaaaataaaaaaaaataaaaanggaanctnnancnaaaaaaaanaaanaaaaaaaanaaaanaacaaacaaaaannaaaaaaaaaaaaaagggaaaaaataaaaaaaaaaggagaanaaaa

SEQ ID NO: 653551 - DNA, 107 bp, Homo sapiens
tgaaaatgggcaggcctccctgtagggttgcctgacaattccctagatgccctctttaaaatcagaagctgcatgctggcccacccagtcacagacaacggggaaca

SEQ ID NO: 653552 - DNA, 227 bp, Homo sapiens
actggtgggtcgttctacgctttggagtaatcaccccggacttgagttctggacgtgccaattgttggtgtccgcgctctcatacgcgcggtacacccaggtggcaggcgcagtcactctggtatcggtgatcttgcctgccgtaggctgcggtcagttcgttttccttttccagggtgcggctccccatgggtttacctgccttggcagtgagaacgacccacctg

SEQ ID NO: 653553 - DNA, 86 bp, Homo sapiens
ggtataaattttactcttgcaacataactaccatctctttcttaaaacgagatcaggttagcaaatgatgtaaaagaaaaaaaaaa

SEQ ID NO: 653554 - DNA, 892 bp, Homo sapiens
ggctcttcttatgttcgaagcgacgaaaatgtttctctccctggtgggtgccctcaacctgatgtgatgggggggttccttcccttctccccaccaatattggggggggagaatcaaatgctgggcttacattctaatacctgttccgcgcctcataaaagggggggatcaccttcaagggtttgctgttatccccaaaccgcctgagctttttgtgatccagacagtcggggattaccgcccccagattagcctaaagttaggtgcaatgtggaccccctctctccacgaatccgggggtggtctaactgcgtgctctgggcgatgagccgacacaacttggtagtttcagaaagccactatagcagggggggtattaattgcactcactggcctcctaagcaaagggaccgtttatttctgtattctgtctctatgattatagaggaaaaccatttccaagggtttcctagctacgtgtgttcccctgcgccccacgattttttccacgcctcatgagagcttcccacgggaaatatgcccacgtatgtagcaaagctgtgtcttacggtagtcctctttccccaggtgttacctttctgtctacatgggttcctagttggcaatatcacgcgttggtccaaacggtaaaatcgcacgtcgttttatcgaggcaccacatttaattttacttgcctctccattaagaggacacattaactgcttttttccacacaagagtgcaatgcctatagtcccttggccaagaaggtgaggaatcagaaaaggggttagaaaagtatccctgtattcaatcagagggtaatattctcccccggataaatggaagggacaatgaagtaaaacttagatgatacggggacaagaacaa

SEQ ID NO: 653555 - DNA, 320 bp, Homo sapiens
  misc_feature (235)..(235): n is a, c, g, or t
  misc_feature (287)..(287): n is a, c, g, or t
aagaacttcagtaggaactgattggaatttaatgatgcagcattcaatgggtactaatttcaaagaatgacattacagcagacacacagcagttatcttgattttctaggaataattgtatgaagaatatggctgacaacacggccttactgccactcagcggaggctggactaatgaacaccctacccttctttcctttcctctcacatttcatgagcgttttgtaggtaacgncgaaaattgacttgcatttgcattacaaggaggagaaactgccaaagggggntgttggtggaagtttgttctgtctaatgaagtg

SEQ ID NO: 653556 - DNA, 178 bp, Homo sapiens
  misc_feature (20)..(20): n is a, c, g, or t
  misc_feature (162)..(162): n is a, c, g, or t
  misc_feature (164)..(164): n is a, c, g, or t
aacctttattcatcctcctntccaagacctatgagaaggttccaggccccaggaacacaggcttcttggccccagatgcacctccctgcaccccggggttgtataccacaccccgggcccctaatcccaggccccgagataggaaagccaactagttctttntntgtgattcagtagg

SEQ ID NO: 653557 - DNA, 361 bp, Homo sapiens
  misc_feature (10)..(11): n is a, c, g, or t
  misc_feature (19)..(19): n is a, c, g, or t
  misc_feature (361)..(361): n is a, c, g, or t
gcgctgtcanncaggctgnagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttttttgcagggtcttgatttcgcttaggccagagtgatggcaccatcatagctcactgattttgctatttacttttgttttn

SEQ ID NO: 653558 - DNA, 850 bp, Homo sapiens
agcggggaacgacggagggcgctgcggtaaggagcagccgccacagacacagccgcttcgcagcctcccgccgctggtttgtcacgccccgcggctgcgggcggcgggcggccgagcgcgctctgaggttctgtccctcatcgctgaacccgctgtctcccgtccgcagctcctcgcgggaaggggggcggtctggtgtgcctgacgcagagccgaacttacctccaccagaccctcagacatgaactgcacaaccatacaatcacatcaacttacaatcgtagcatacatgcaataaatgacccactccttaccagaccattcaactctccaccacaacacatatgattacaataaacgaccatctataactattaaaaaacacaatacaaatcaccaccatcacactcatctcaatctacacagatatacgatataaactacacattatatccactactagaagaaataccagaaatctcatctgataacatctaagacaaacacacacaaataatactctcatagacacacagataccagcaagcgagagcagcacgacgagctaccctacacaacacaaataaacatatctataacccacacacacacacattcaccaatcacgacatataatacaacagaataattaccatcatcacagaaacactataaatacataaacaaataacaccatcacaactaccaacaatatagactatctcaaatataccaccacagcccagaaaactagaaacaacacaagcataaacacaacagaacaaacatccaccaacacaacatactcactccacatcaactgaccacaatagaatcacaacacaaccag

SEQ ID NO: 653559 - DNA, 922 bp, Homo sapiens
gattgagctcgacgaggacgtattgtattacatgtaactgccgctcgggtttttacaataatgaaacaaatcaaaggcttgtgaaacatctctaaatcttcctgttcattgaccagtttctcaatcacaaaaaacaggaacgtctgtgaggttcaattctggaaagggggattggtttagtggctcttctgatacaaccacagacccctcggataatactgtggtccaaagaaggctgctgtatgttctctgtatgctagactcattccttgtgaataatactcatattatagcttttaatactcaactgcacagttccatatagacttgatttttcggacgattgttttttacctcattcctaatttcaccggatttattctagcctaacattcattgcatgaatgcttagaattcatattgttccttcagttacgacctgttattctccccttttacatgagaacgtaacccctagttgttacttaactaatttgttaaccatagtcaccattttcttattctttgaatacttattatctattgcggcctaacttgtgtttagttttttcatggagttttatcatatcgcggtgcaaaatcgttatatctacaacatgctttagtattttttatatttcatttccattagctaatttatatgattacgcgagcccctttgagtgttatatccgctttgacattgatgtattcgctcttattttcctggttgcaaatatgctatgtttattcacacttaatttgctaccccatattggtttattatggcggtgtcaccatatttttgtgttgatgcttttattcgatccgtatctgtatacgcttacttcctccttgccacgccattttttatatctaacccgttcccgtctccgcttaatttcccattcccgttataaat

SEQ ID NO: 653560 - DNA, 567 bp, Homo sapiens
gacttttccctatcaatagatagccttacagatgaatttcttagcctgcagaaatgtgttaaactgtactaaaacagatttagtttttgtgagataaacagatagtgaaaaataaacttagccaaatctcatgtgaggataaaaaaaagcgatgtcccagaataagtcaatgtgacactcaagatctaaacaatattaattaacttttaagtatttaatcaaatttcagcacccagcaaataataggcactgtaaatatttgcttaatatacgtagctgtgaatttttgcccacatttaggcggacgggacacttaacgccagaatattcccgaaagtcaagttttgtcatcttacacttaggaagttacgttaccaacttctcaagtctcgtagtatttttcttaagcgcaatttggcactttccagttacctcgttggttaccggtcatcaggttcttgacaaagattgcaatacagtagtttaagaactatttaaactaggtattccattaactaggtaaaaaccactcgaatgacctcgtggtccaattccattcgcaagggt

SEQ ID NO: 653561 - DNA, 454 bp, Homo sapiens
cagtttcttgtcattgtttcatgacagtaggttgtcgtaagacaaggctgcatgaagtgtgaactggacttttcttggatccataaaacaatgtgcttttggagaatgtgggcatcgatcctactacctcacgcgtgcaaagcatttgagctaattccccagccgtttggaatttccacaagaagcaaccaagagggtccggtcttgtcaggctatgctgttggtggacttgtttgttgatgtgccagcacttgcagaggctcagtgcatttcaacaattgagcaaaatagcaaatggccggttagctcagttggttagagtgtggtgctaataacgccaaggtcatggttcgatccccatactggctattatgtacatttgagtgtcaaaattacgagtcacatgcatgtggtcgacgcggccgcgaatttagtagtagtagtaggcggccgc

SEQ ID NO: 653562 - DNA, 184 bp, Homo sapiens
ggtgtcgtgaaactacctcggagagccgaaatgggaaggaaaagactctatgccacgttgtcgtcattggacacgtagattcgggcaagtccaccactactggccatgctgatctataaatgcggtggctgcgacaaaagaaccattgaaaatttagagaaggaggctgctgagtgggaaaggg

SEQ ID NO: 653563 - DNA, 1211 bp, Homo sapiens
cagcttttcgtggcaggtggatggtgcttgaactgaatctcaaagcaatgaacaggctgttatttagccaactagtgacattgaacggagtcacttcacgacacgagtgatgctgcctgtgcctgctaggactaggactagggacaataacagagaaactggcatgtccatattcaccctcacacttactactactctctgttctctactctctctctgatgacaccccaaccacctcaccacctgcatacacctcatctacatagacaacacatgtacaacaaacaaaggcacacataaacaatcactcttcacttacacacatactacttaacacccagagaagacagctactacaaccgaccacacctcaccccacactgctaaccaacctcccatcatctagcactatttaactctactacgcacaaccttcactacaatacaccttgcgaaacctataattctgttgtaactaacaccttcactgctagccccattaatacaaccacacactaacagccaactacaacgcagcactgcacacaccaagaataattaataaacgcaaagtcaccacatcacactatcaacaaccacttacgcacgccgtagacaacacacacttaccaacatagcgaacctataagagttaaacctcaacactggataaagacaggtccggctaccttgaccacaactacacccagagccagctgcgtaaacaccactgccagatcggtaacacagctacgacactacgacagtataaggaacgacaacaacgacctgaccgacaagagaaaaatacaaggggagaaaaccaccccataactacagaccgacagaccagaataaacaaaacaaacagaacccaggaaacagtaaaacagcaccaacaaggaaaacaagaacacatgcaaaacaatataggagagactgctccaatgctagacggacaggtcgagtaccaggcggacatcaagaaagagacaccacgcactacacagctgcacaagactgagattagcgagacgactagtaactcatcaaaaagcaccagttaataaaccacaaccacgcacacacacagcaacacacacactgaagacaatgagaactcagacgcatagtactacaccaatatcaaaggagataatcgaactcgacgatatctaaggagatgcattagaagataagaaacaaagatt

SEQ ID NO: 653564 - DNA, 727 bp, Homo sapiens
  misc_feature (90)..(90): n is a, c, g, or t
  misc_feature (107)..(107): n is a, c, g, or t
  misc_feature (238)..(238): n is a, c, g, or t
tggggctctctgaccagcaccaggggggtgggcaaaaacaagcgccttacaaaagggggcaaaaggggagccaaaaaaaaaggggttganccattttctaaaaaagnatgggtatgatgtgaaagccaccgtgctagtgttctcaatataagaaaatatgggaaagacgctcgtcaccgaggcacccagaggacaccaaaatggcttctgagtggctctcaggggctcggtggtgttntgaaggtgagctctggcgtgattgtgcagaagtgagtgaagtgtgctttataaaaaatctcaagcgtgatatacgtgaagatgtctcggggtaaaaacggccgtgactaactctccagggcagtggatcttacccggtgacaaaatgtgtgtcccatgggctcaaaaagtgggcagacaatgtgatgggaagcctcacgttggatgtcaagactaccgagggtaactggctacgcacgggtccgggtggtgggttttactaaaaaagcgcaacaatcagatagggaagaccctcttattgctcagcaccaacgggtccgccaaatccggaaggaagatgttgggaaatctggacccgaagaggtgcgacaattgacttgaaagatgtggtccataaatggattccagacgcttgggaaagactagaaagggtggccatctattatcctctcctgatgtctccgtgaaagtaatggcgaaacccagttgt

SEQ ID NO: 653565 - DNA, 1417 bp, Homo sapiens
  misc_feature (1322)..(1322): n is a, c, g, or t
gctcttgcccgtatcgcagaatcatggatatatcgtagtattactgatctgatgtctcgtatactctgagtactaatacccctggatggtcgatgcatggttgcttgcttggttgcacaattgtgagagtaccgggctcaccctcctggcttgtcttggatcgactctgagcgatggtgtggccacgtccctgacttggcgaggggcggattcactccctcgtagcgtctgtggcagacggccttgcgggccccgtagtaggccgtgtgctcgtcttgtaatgcctcgaataagtggggcctaatgcctcgtataggtaagggaaagtcacctctttgttcgagcttacagagtcccgtccgcgtaggtacagtagatgtagaaaagccaatagtgagcaacggatgctttcagacgtaacaagtctgctttcccactctcgggcatttggaattagtctcgaatgagttcgaagccgttgtgggtgtctgcgtgcacggttttaagcttcgtgactgcacgagagactgtgccctgctagtcctcttggtcactctaccctgtactcccactgttgcgcctactcatagaggacgtgtcattgagatccattggtgcttccagaggagcccgcgttgcgccttccacaaggcaatcttttttgaatgcttagcgcaaggccagggtcgtgttagagcacgctctcgcgagattccaatctgcccttgctcggattttgcatacgagtgtagtgtacgccaggaaagacccgttggtgctgcctcccgttagtgcttagcgtgggttagtcctggtaaacgttttggcccttgcgattgatcgtagagaggtttcagagtgcaagcggtatagcctcctagttgcgttgtcccatcttctctgttcactgaaaggccgggtctcgaacctttactcttttgtgggggctaaagaacttgagtttttcaccaacgaggacatgggttttaagtggctcggaggggtccaccccggtggggagctctccgccacggttggcgctgttttttacccccgcggtagattcgcgggagtggaaagtgactcccccttgtgtgcacagttgtatgagcatatcttctgccccagctttgtgagggtggttttgccgggagacctgcattcccacagcttgtctgtgggaggcgcaaactgcccctcctatataaaaggcccacgtcgtatgagggtgggctcaccacgaggagtggtgctcttcgcgcaacgcaggaccatcgtccgggccggaggaagaaatccaggttgtgagtcacaaccaagtnaggagagggtgtggcggcagtatgaaccacgtgacacgagccgacggcacatctgtagttgtggcgagcgcatcgcggtgataggttatataggc

SEQ ID NO: 653566 - DNA, 174 bp, Homo sapiens
ttcttgcattaactattaagattaatcagattcttgagtctgcatgtagaggtaatgtatcccgcgttactaattggaactactacatgagaattataaaactggcatattgggtttgactctcaatctttccaaagctcttcgtatttttctgctttcatcccacatttttct

SEQ ID NO: 653567 - DNA, 1138 bp, Homo sapiens
ttctcgaggatcccagttactcctttgagacaccaaaaaaagtgcttccatatggttacattgttaattccataactcgcatttacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaaaaaaaaaaaaaaaaaaaaaaaaaaaaaaaaaaaaaaaaaaaaaaaaaaacaaaaacacaaaaaaaaaaaaaaaaaaaaaaaaacacaaaaacaaacaataagaaaacaaaacaacaaaaaaaaaaagacagggaggggcacctcaatgatcgcacaatcacagagaaacagagaacacaaaaacaacaacacaagaaaacgaaagaaagcgagaagcaggagagagagcgaccatccaataaagaagagagacacaagacaaacacactacaacaaacacgacacgtaccaaccgcgcgagcgacgagggcacgcaggggcgggagaaaaagacggcgaggacaggagaggcgcagacgagcgggagagacacaaaaaaagaaagcccagaaagggggcgcgaggcggcggacgaaaagcaggagagccaaacaaccgaacggcagacccagaggcaaggaaggacgagggggagtggatgagcattcctatcaacagtaaagtaatatagacaggagagataagagaggcaacagcgagagagaagagcggcaagacaggaaggagaagaaggaaacagagaggacggagcaaaacagaaaagagaagagactcgcccacgctaaccggaacagaaatataaaaaaagacaagagcaacggcaagcaaggcgaacagcagggggagaggaggaaaggacgaaaacagacgacaacaggcaagaacagacggcactcaaacagatataaaccgagaaagagcaagacgaaggcaacacaaaggacggcagagcaacacgagagaacgcgagagcgggaggcaaagagaggacaatgcagaaagcgacggacaacaaagaacgcaagcagcagaaaa

SEQ ID NO: 653568 - DNA, 109 bp, Homo sapiens
agtactatggcaacagttgtagttaaataaacatcacaggtcacacttgttctaggctcccaagcctgggtcactgctacatggatttgcgccaaaaaattcccaggct

SEQ ID NO: 653569 - DNA, 550 bp, Homo sapiens
gtgattggcttggcgagtgggcagtgaggtcagcgggaatgacgggaacatgcgggtgacactgcctcagatgataccattaggggggccacaagatgggccctaagtcaacaccgttcttcatgtagtagttctccagcttggcccagcaatgtgcttgccctaggtgtacttacgcacgcagttgcgatgtggggccggcatcttatgcatgcaggcatcttccgcgggcctggctccgccatgtgaatccatcttctggagcacgtagttggcatacaggtcctacatcatggtgtatcaaggcactgtggagaccgtcgttcatggtgcacagctcatcgatgagcacagggcgctccgtaacgtgcggcgtgcttcccaaacttctccacaagatgggttgcaacgttggtgcggactcaatacacgtacattggctcggatttcggttacaattttgctttgatcctcaggccgaccgtgttccagtacatgttggctcacatagtcccccatatagatgtgtacatctgtctgtgtctggtgc

SEQ ID NO: 653570 - DNA, 349 bp, Homo sapiens
attcgcggccgcgtctaccggtggtgcagtcttggctcactgcaacctctgccttctgggatcaagtgattctcctgcctcagcctcctgagtagctgggattatagacatgcgccaccgtgcccagctgatttttgtatttttagtagagatggggtttcgccatgttagccaggctggtctggaatcattttaaaaccaaaaggtttgtatttaactaacttactaagattattgtattccgccagatgcggtggctcacacctataatcccagcacttcgggaggccaaggtgggctaatcactagagcccaggagtttgagaccagtctgagaaacatggtgaca

SEQ ID NO: 653571 - DNA, 236 bp, Homo sapiens
  misc_feature (4)..(5): n is a, c, g, or t
  misc_feature (72)..(72): n is a, c, g, or t
ttcnngcgcaaggccgccgctatcgccgagcaataccaggccgtgatcgccaactggatcgcccgccaaagnggctcgacccaggccaaggccggcttcgaggcctccatcagcatcaaagcgctgcacgaagcctgtgcccttccctcgcgcagccaaggcgaattactgccttccacagccggccgcctgagcatcgcacggcgccgcccgctgggcgtgatcggagtcatcag

SEQ ID NO: 653572 - DNA, 421 bp, Homo sapiens
gggttttacccccgcttccattagaaccacaggaaaggccttgttttccaaaccaaagtgggtaataactgggggaaggaaaaaaaaccctcgggttttcccttttaaaggggggaaccctttcaaaaacaagggctgggtggacccggccccctcaagggtgccgggaaatatggtcccctgttgccgggccattctcggggttaaaaaccccattaaatcacccaactggggatttttgggggcaaaaaccccccccggggtttttaaaccctgaaattattttgaaggggggggtttaaaaaaaaaaaaaaattttaacccttcctgggggaagggtttctgttccccgggagggaaaattttttcctttctccaaatcccccttggtaggtcttttctttataaatttttccgtgga

SEQ ID NO: 653573 - DNA, 124 bp, Homo sapiens
atccatgtggcatctgataggagtattcaacatgcgataacccaagggatgtatctgggttagggggagggaaggggagcattagtgctgacgagatattcttacttcatgactatggagttcg

SEQ ID NO: 653574 - DNA, 620 bp, Homo sapiens
gatcccgtatcatttcaggtctttgaatgtttttaaacgaaatgcagatcaaattgtaagtaaattttgaataccactgagtcaaaagcttctttcgtagataagaaattattcaaacaagtaatttgatgagtgacacataggaatatcttgctagtgcttgaatttgaaccagtactataaattcttagaggatttatctttcattgcaagttgaataaaattcgctccataaagatgtggaatctattttgatattttaatgttaaacaaataattagtttttgaatttaaaaggtggaaaagtaccaaactcctaaaatttgctataaggttcaaaaatgttagttaatgtactccatattgtgtttgtagatcttctaatttgtagtctttatctagctctgattgccagttttgctgcaataaaaacaatagaataagaggtttacaatttgaaaaaaaaacttatatttgaaaattgagtttgggtatgtgggacttcaagaaaaatatttttaaaacgttattagattttacttatgtcctaagcactccactgtatattgtggatttaacaatggggtcaaataaggactcccaatttaagaatcagattt

SEQ ID NO: 653575 - DNA, 385 bp, Homo sapiens
  misc_feature (366)..(366): n is a, c, g, or t
atgatcgcacagaccaggtaactgtaacacagattggataacttacctaagatcatataattagatagacccagggttctaaccgaagggctggagaaagctggtatataatccacagagcatcattaggtagactgtggcagaattaggtactttcacttctctttgccaatcaaggacagcaataacgtcagtcctctcctcttcatgctgttacaagcaggctgcagtcaccagaacagaccagggtttttcaccttaggaatgtccttccctttccgtataaagacgctctttactgacagtattaagatagacttgggttattcttttttctagtaatggtgagggacctttgtttggctntaaattttgcctagttctc

SEQ ID NO: 653576 - DNA, 226 bp, Homo sapiens
caaggtcaggaattttcgagaccagcctggccaacgtggtaaaaccccatctttactaaaaatacaaaaattggccgggcatggtggtgggcccctgtaatcccagctactcaggaggctgaggcaggagaactgcttgaacccgggaagcagaggtgtgcagtgagccgagatcacgccagcggcactccccgcctaggtgaccaaagcgcccactccttttcca

SEQ ID NO: 653577 - DNA, 210 bp, Homo sapiens
  misc_feature (55)..(55): n is a, c, g, or t
  misc_feature (57)..(57): n is a, c, g, or t
caccgttcgaacagcttcctgtccgaaaatacattgtaaatgtctatcagatatntnaggatggggagcagagtttgatcctgtctacttcacaaacaacagcgcctgatgcccctcctgacccgactgtggaccacgttgatgacacctcaatagttgttcgcctggagcagaccccaggctacctaaaaacatagagtaccgagctcg

SEQ ID NO: 653578 - DNA, 847 bp, Homo sapiens
  misc_feature (475)..(475): n is a, c, g, or t
cacaaggatcatacaagagctatgaaagtgaagagagacatacgttatctaacaatctgagagagatgactcaatcagcatactctctcttggcgcacaatgacagggacagatactgtacaatacaggagcatgacaacgaaaacaaacaccaatgcaccgaaatgacctcacagtgccacacctcacgccaacacacacaccacaatatagcccaaaactccccactgatgcccgcacaccaacaacactttgtcccccgttccccccccccccctaccaccccctttcccgaccctccaccccatccttataatttacacttaccagggcccactacaccacttcaactcgtcccccctcctctccacccccaccacccatctctttcccgtatccaccttttcacttgatatcatcccgagcgccctcgtgccatttcgtcccccaccccccttgcgccatcttatcccanacttccccaatttccattagtttctactttctcccccatccaccaattacactcccccccctcccgttctcctttgcccccctacccccccacattctccaccccttttccccccctatttcccccacattgtgttttaccttacctcccattttcccactttttttcccctctccctcgtgccccacccaccccttgtctcccactcaccttcgttttctccataccactctacaccaccccctctccccgcttcactgcccaccccatttcacccacacttcccccattgattcaccgaccctcccgtgtccaccccacccccaccacctttacccagatttatcccacccccccacccccacttcacct

SEQ ID NO: 653579 - DNA, 434 bp, Homo sapiens
caaatctctgagacaagtacattgaagactatctcttgacagacacgtgtatccacatgcaactacaaccatgaccattgacatcatctgtgggttcctgaaggaaaggtgcttccgaggtagctcctaccctgtgtgagtagtacaaagtggtaaagggtggctcctcagtgcaagggacaacacacctcagaaggccgatactgacgctgacctgatagtacttcctacagtcctctcaccaattttcaggatcacataaatcgccagggagagtacatccaggaaataaggagacagctgaacacctgtcaaagagagagagcattaaccagtgaagttagaggtccaggctccacgcatgagcaacccacgtgcgctcagattcgtactgagtacactccaactcgggaagggggtggagtccgatgtgc

SEQ ID NO: 653580 - DNA, 119 bp, Homo sapiens
ttgaacttccagggaaatactctcctcaagaacatcctttaattgttggctgcattcgctattcaatctggcccaaacggtgtcggtttccttattacgtctaattgatgcctgaatag

SEQ ID NO: 653581 - DNA, 418 bp, Homo sapiens
actctcgaggggacagctcatctgtactgactgggaggtccatgcccatagagagctgccgtcctctctggacactcactttaatgagaagcggacaaactggacttccctaatgtaggacagtggtgaagcttccaaaaattataacagatttatttatttattcaatgtttttaaagtattaggcattttttgtttgtttgcttgtgtgtttgtttgttttgagacagtcttgctctgtcacccaggctggagtgcagtggcacgaactcggcttactgcaacctttgtctcccggattcaagcgattctcatacctcagcctcctgagtaaataggattacaggcatgcgccaccatgcccagctaattttcgcatttttagtagagatggggtttagccatgttggccaggctg

SEQ ID NO: 653582 - DNA, 614 bp, Homo sapiens
  misc_feature (79)..(79): n is a, c, g, or t
  misc_feature (140)..(140): n is a, c, g, or t
ttcatggcataaatcaactcacattgttgtgcaacatagccactatccatctcagagctttccaacagcctttactganccatgttcttgttggacaatgccctccatctccttcccacagcccctggcaaccccgcttnactttttgtctctatgatttgactactctaggtatcttatgtaagtggaatcatacaatatttgtccttttgtgactggcttatttcgcttagcacagtgccctcaaggttcttccatgtcgtagcatgtgtcagcatttccattgcttttaaggctgaataatatttcattgtatgtgtagatcacatttggtttattcatttatctgtcaatgaacatttgagttgtttcttgctttagttgattgtgaatcatgctgctatgaacatgggtgtacaaatgtcttttcaagcccctgcttttatttcttttgtatatatacccagaagtggaattactgaatcatatgctaattccatgtttaattttttgaggaaccaccatattgcttttcacaggagtatcattttacattcccatcagtaatgcactccggtctgggcaacagagtgggaccctgtttcacgaaaaca

SEQ ID NO: 653583 - DNA, 1116 bp, Homo sapiens
  misc_feature (1116)..(1116): n is a, c, g, or t
acaggcccttcctagagtgtcactggaaatcacagtcaacgccattgaaaactgacctcccacaccagaacgtgctacgttctttctgtcatgcctatgtgtgctccattccgtcatttctacttggctcaagaacaacatttctgcagtcaggtgcagactgtttacaaaaagaggcagcaaaatcaatgccatccttgaacatgatgagatgtgagaacttacaaatgcaacaaaggcaatacatgcatagcaaattcatttcttcaggtacagcaatcagttgcataggcatgtgagggtgttaacttggggtgaaagtggaggaaggtcccaggtgcaatcggctctcgatggaaatttggaattaaagcaaatcaaacgtcctgggggttacacaagaataccagatttcaaaagtttgcctgtagagcaaaataaaacagtcagtagtagtcattaatccttgaggcccaacgcagccgatgggtcggtgtaagggaaatttctgagatgggagtgagatctgatcggatcctgggaaggatgtataccaccagttagaacagtgtagggtactgggataccatgggcaagtctagagtgggcggagtgaaaagggacaagcatgggcatatcagtataggcatgtccacatgactaacaggaggattgaaatgatcttatggacacaatattatagagacattcaacgagtaataagaactcacagaaacagagataagatatcagcagcccaggacagcctgagcaccgtagcacggaactcaatgccccacacctgcgcaccaaggcacactccaccaaggcacgcaagcaatacagacaacgcacacgcaccacccacaacccagtgcgccacacaaacagcagaagaaaaagcaagacaaaacagaacacccaaaagacaacaacgatacaaggaacaagaaacgaacaacaaacaaaaacaacgccccaaagccagcggacaagcaacgagacaggcacagcagtacgagtaaagcgcagcagcgcgaaaaagagaagcacacacaacaagaagcagacaacaagacgacaccacccacggtgtaccagctccctacacaacan

SEQ ID NO: 653584 - DNA, 754 bp, Homo sapiens
  misc_feature (530)..(530): n is a, c, g, or t
  misc_feature (535)..(535): n is a, c, g, or t
  misc_feature (550)..(550): n is a, c, g, or t
  misc_feature (588)..(588): n is a, c, g, or t
  misc_feature (616)..(616): n is a, c, g, or t
  misc_feature (632)..(632): n is a, c, g, or t
  misc_feature (635)..(635): n is a, c, g, or t
  misc_feature (640)..(640): n is a, c, g, or t
  misc_feature (642)..(642): n is a, c, g, or t
  misc_feature (649)..(649): n is a, c, g, or t
  misc_feature (655)..(655): n is a, c, g, or t
  misc_feature (657)..(657): n is a, c, g, or t
gtggcaatcttgctcgccgggcagccgcgcacacaaccatgatgcaaaggatacccctgatgagccctgggcatttccagctcgagagttccttcgaaagaagctgattgggaaggacagtctgtttcacgatagcaaaacaagcactccccaggggcgcagagtcatgcgcatgcatcgtcaccgtatggcaaaaagcatacctacatgtgggcaacacacatttgctagtcaatcaacttggttggccaagcagaggcattcagccaaacccaggcagcagcaaggccatgcagcaagctaaatcaatccatgcaagccagcacaccggcaattcaagcaatcgtcgcaagaaacacagccaaaggcaagccaagaacagggatgtggagtgaggggaacgagttcacatactatccgggatctcaagtataccattgaaaacccaaggacacatttgtggactcacaccaccagaagcctgttaatgctatcatcgagcatgtgcgggacggcagtgtggtcagggncctgntcctcccagattacnacctggttacagtcatgctgtcaggcatcaagtgcccnacttttcgacgggaagcagatggcagtnacactccagagccttntgntgcanancaaaatntttcantnagtcgcgactgcttcaaagagatgtcagatcattctggagagctgacacaacagaacattctgggtaccatccttcatccaaatggcacatcacaga

SEQ ID NO: 653585 - DNA, 379 bp, Homo sapiens
acgaatcattggtcatgatgaagattggataagtgtggaaggcactgatctgaggaaatacctgtagttgctcacgtgagtgcagatacgaaggaatgggtcgagaaactgaccgcagtttgtatcagatctgatgcctttcttcactttccgatatgacgtatacagcagctatataggagtggtgtggcgtacattgtcgctccactccggatatctgttgttgaccaatttgtgattgagaggctgtctactaactgggcatcatcctcgctcgtacgaagcttccgggtcttacaccatctgattttaccaaacagtgtttaccgggtggcttatgtgtaggtgaacagtcacgcctgaaacttaagcggatcag

SEQ ID NO: 653586 - DNA, 236 bp, Homo sapiens
  misc_feature (93)..(93): n is a, c, g, or t
  misc_feature (166)..(166): n is a, c, g, or t
  misc_feature (197)..(197): n is a, c, g, or t
  misc_feature (222)..(222): n is a, c, g, or t
gaataaactggtttggaaccagaaaagtacaaaaaagaacagctagaggtacatagacacaggacaattaatcaatttgggaaaaaaaaaagnacttactttctccattgctgcctgaattgtttcccaatctgccttgaaatgccacttttggccaatatttttncaaaaatttgaccaaaaaagaaaaagcactnaatttccctttttatacaaaaatgnttaagtaggcaagt

SEQ ID NO: 653587 - DNA, 948 bp, Homo sapiens
aggggaaatatgtgaaaagaggcatccagaggaatgaatgtaatgtgtgacaaacagtcggcagaacatcactggctaaggaatttctggacacaccttcaaattggcaagtgtcatattctcaggatgatttttcttcaagccagagttgtgagaatagagacagataaaataatggatttatgcatgttaccatgtcgctatgaagcgacttgaacatggaatcaatgatgtcagccatttccatgctgggatgggaaagcgcaagactactctggtcggtatcaacagaccaggaaagtgtctagaggaaattcccacttttaatcatcgaaggcttctcttctctcctaactcattaagccccttgagcactatatggaatagaagctatgtcctgactatgtccatatgaagaatgtataaggaggaggagtacaagaggtctatcagcctgccagactctccgggactatctttgagtggccatgtgtggcccatgtatctaaagctacagacaagcaatgcaggacatcacatgggaagttgtgtacctggatggaacgagaatctgatagaggacctctctttgcaagtatatgaagatctaatacaagaactagcaagagcacaaagtgtttgcaagtgacagcataaagacggaacacaacaaatccttcgtgaagtgaacttagggagactccaaggagtaatcctaagaacctctcaccaagatacaatgtagtactgtggtacaatgactagccattgtttatatgatttgagtggtattatcgcacatggttttcaccaacatgtgggacaataaatatccatgccaatggacaggacgttgtaccctaagcaagttgctcccatctccagggagcgctatagatacagcagagctcacagtgagatgagaaagtgctccactttctgaacata

SEQ ID NO: 653588 - DNA, 115 bp, Homo sapiens
caatactcgcgggcacgtcatgtatgtaggtctcacagatttcaagcctggctactggattggtgtccgctatgatgagccactggggaaaaatgatggcagtgtgaatcggaaa

SEQ ID NO: 653589 - DNA, 384 bp, Homo sapiens
agaccatacaggatcccctcttctccgaaagcaacatctctgatggtgcactccaccgtcaccagtggctatggcgggtgccagtggtgtccgcagtggctctactgcctggggttgatggacagctagcctactcctagtagcagtgttcttggctgtttgaggtggcttcagtcccagcactggcaagagccattgggggtggccttgcgagctctgttggaggcggcatgttccaccatccagtacaccaccacctcgctcctccagctaggaagagctatcagcactagacgtgcgtctgcgacctctcggtccccaccaggtcctcaggccccgtctctggctgcagagccctctcctcattttgcctttcggagaaaa

SEQ ID NO: 653590 - DNA, 839 bp, Homo sapiens
ggatatgctgcaagataatgtatttaacaatattggggcaaatattcaataaatagtgtacatcgttaaacattcttacttgaaaaaatgcatatatatatgtgtgtatatatatatatatatatatatatatgaacagaagacaaggaaagtggtgtagtgtctaaaaaattctagtgggagcttatcagcagtttatcaaataataagagcgagagaatctctatttggtccttaatcactgggacacagagtagtcaagtggaaatatttggtgaattacttataagggtactgagtatatatatatgatttccaacctgttttaaacgacttatgagtaagagatagcattttctagtgtgtggcacatataatgccactttggaactcgttgtgacaaatgtagatgtgactcttaaaaattaagccttgcgtatagtgggccctcataagctgtgacaattttttcccaaaaaatagccacaataaatagtaatggaagctatatcaacggggggattgaaaggtcatgagtgtaatattatatacactctatcaacatagggtaacaagctgaacatcccacccaatagaagaagtctcacaggaaaagtcatggtactcaaggtgctccacggtcaagcggccccactttaccattcataacactcagggggcaacaacatccggaaccaacacaacgacaccgacagccacaaacaacagacgggcgggcgcaaaaaaaaccccccgcgggaccaagacaggcaccccgtcttggcacaccggagcccaaggggggcaaaacacaacagcgcccgaaacacgcacgggac

SEQ ID NO: 653591 - DNA, 282 bp, Homo sapiens
aggaccccgcagtgtgagctgccctcagcaacttaggtggttgatttgaaactgtgaacgtgtgatttcttcaggagactggaagtctctagaacagccttgtctatgcctatttgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaactca

SEQ ID NO: 653592 - DNA, 620 bp, Homo sapiens
  misc_feature (5)..(5): n is a, c, g, or t
ccganattcagaggtcgcagaataacgtgctgaaaaacataaacaggggactttataaactcctggacctcagcgttacggactccagctggcccattcattactacatattttaattctaaatcggggtgcatcataaaatcacgcaaccgcacagcaaccttagaagctattgatataaaaccatttgcatccggcagatcaagagtacaataatcaacattgtatgtatcacgcaagaaatgaaccaacaacccgcttccaatgtatccattagtaggaaaaaataacaaactactcttaaacctcccaccgacactaaactgctaaccacatctaacactttgaattctagaaccgctcaaaaagcggtctcataagtccgacaatgtgctgatcgggcaaaaccatgtactacagcttattatctacctcgcgtctgccgaatcagacagccggtatagaaaacgtgcgcattaggacgcagtccgtagaatacaggtgatatccaggatcaaacaagaatcccctgtatacctatcataagtaacatcatctccccggtaagggcaggtgtaagactcttctcttgcagtgctctgataggggtgtgcttcaca

SEQ ID NO: 653593 - DNA, 303 bp, Homo sapiens
cgtcgaccagacctcgtcatcattggcgccctcatcgtggctaacaagaccctgtctccacagtatttcatttggtgggccgctccgactgcaatgatcctggatcgtgtctcggccgaggccaaggaccctggtgattccgacgccctatcctgggcacgcacgtggtgctggatcgtcgccgtgctgatggccgtcaccaccttcatgacccagcaggtgtacccactgcactaccaaaagatcctcgggggttcatcaagtaccggctggttgctcgtcagtcgcaacatgcgtcgacgc

SEQ ID NO: 653594 - DNA, 164 bp, Homo sapiens
atcaactctggagttcgaggggagggatggccaccagagatccactcggtcacccaacagttttaccaaccaccccgggttcggaactaataggaaaagactctttgtgaagaagcgagccagtgactgaaacaccctggtggaaacctgttgacagaccttgc

SEQ ID NO: 653595 - DNA, 161 bp, Homo sapiens
aatacctacctgaagaggaagaagaaggagaaagaaggaagcagaagaagaactaagaagaactaagaagaaggagaagaagaaggagaagaagaaggagagaagaactaagaagatgaaagagagagaggaaggtggggaactaaggatgaaggtaggta

SEQ ID NO: 653596 - DNA, 248 bp, Homo sapiens
  misc_feature (207)..(207): n is a, c, g, or t
ataacattaccttggtacctcagctcatgctagaccattctaatttgagcgaagctaaatcatgggtctatagatctagtttagcaaaatctccacacgatgaaatttagcttactacccctaactgttcaatgttttgggtccaatttagacaccaaaaaatgttttataatcctagacattacattaatgaactttttataaacnaagtcctgtctgggcatacccgttcgcataatgttagagat

SEQ ID NO: 653597 - DNA, 864 bp, Homo sapiens
atgatatgttttgaccgtgtggagtttcgtgtcccaacaggattgtgccgtgccctgtggtcaacactcttgattactggggccagcgccccctatgggttaacccgtcgcgcagcgtctgcttatgggtggacaaaaacgcgttataccgcggtcgtgtgtaccacgtgtatgaagccctgcgacatggccatgcagactgacggagatgatcgcggtaagggtggttcaggaaatttgcctgtaggagcagccgaaaacctagctgggttgcagcgcagcgtgagacaccgatgggcaacccgcgcccccacctgtcagatgaattagtgacacccggagcacaggcccacatgtgtggtatgcgccagaatcccgcttagaactaattttctggaccggcgggccggtgctaatatcagacgcgtggacaacatagggcgagctgtgagtgccgaaaagtaagcgctgtatgggattaattatgttagatatttagacaagctcaatagactcttgagggggacaacatcagcatttcgggaaaatagaaaggaatgctccccccaaggcaagcgcaaagcgattactgtgcagccggccccacgtggtaggagaacccgagccaccaagaaagtagggcagttataacaccagacccccagtgctgacggcccccgcccagccagtatgttcatagagggcccagcagtccacctccgcataagcgtttagtgcagcacaacaaaaccacctgtgagacatgtacaacggagccaacaccacccactgatgggggctacaataccggaaggcgctcacccaacaaatatacgccccagggcaaacccacggtccacgaca

SEQ ID NO: 653598 - DNA, 290 bp, Homo sapiens
gcggcgcccttttttttagttaaatttatcttggtacaaaatgcctttcttgctgcgcgcagtggctcatgactgtaatctcagcaccttgggaggccgaggccggcggatcgcctgaggtcgggagtcgagaccagcctgaccaacatagagaaaccccgtctctactaaaaatacaaaattagccgggcccggtggttcatgcctgtaatctcagctactcaggaggctgaggcaggagaatcgcttgaacccgggaggcggaggctgtggtgctcggcggccgcaag

SEQ ID NO: 653599 - DNA, 504 bp, Homo sapiens
acaattctaagatgggaaaaagcatggacaactgtaaggggaagaaagggatcctcacccttctccctaatgacacgctttgggcttagtcttttggggctgctataaccaaatatcctaagttgggtggcctataaacaacagaaatgtatttctcactgttctggaagctgggaagtccacgatcaaggctctggcagattcgatgactggggaggccctgttttctagttcgtacttggcaccttccagctgtgccctcacgtggtgcaaaggacaaatgagcttccttgggcctctcttacaagaggtctgtcttcatgacctaatcacctcccaaaagccccaccccctaatactatcaccatgggggttagggttttcaacatggaatttgtggggggatacaaatattgggaacatagcactttcctcatctatgatttcggtgctgtggaattggggagaaagagaacatttaggattcagggggtaagtttttgt

SEQ ID NO: 653600 - DNA, 444 bp, Homo sapiens
gcgtcgactgtttcatggcgcaactcccaagaacctagcgtgaggcaatagacacaggctaccgggcgcgccgacaggcaaaaatcacccgtctcgatagtcgctatcgatcgcctcggtcgttccgggatcgggcaccacatattccttaacgaactataaatatggaaatacgttcgtttacggaatattaaaaaacccttacaacggttctcacaccttatccactgttgcccgggcaactgttcgcccaccaacagtcgatcaacaaaacagtccgccagccagcacccggcacctcgcttaccccgccaggtgcctgcaaacaggggatctgggcgcttggtacagctcttgctgatgccctgtcactgaccctgctcgctgagcaactgtttgaaaaggaactgatcatgtctcgcgcactgaaagtcgttggtcgac

SEQ ID NO: 653601 - DNA, 150 bp, Homo sapiens
  misc_feature (30)..(30): n is a, c, g, or t
  misc_feature (49)..(49): n is a, c, g, or t
  misc_feature (89)..(89): n is a, c, g, or t
  misc_feature (132)..(132): n is a, c, g, or t
caatggcatcaccccccgccggtggctgcngctgtgcaacccggggctngccgataccatcgtggagaaaattggggaggagttcctgnctgacctgagccagctgaagaagctgctgccgctggtcagtgncgaggtgtttcatcaggg

SEQ ID NO: 653602 - DNA, 896 bp, Homo sapiens
aaatgaattaaaaatgtgaaatcgggttaaagtgatgatgataaaatagcatgcaagaaacaagctccttccatcagacttggctactgtttccttctggtacgattcgggttcggaagagcctcttgtagtccttctcttatgaggtatgtcgtgcgttatcttaatatgtctgtaagcattatggagatataattcacataccttagcaactatcagcttattttaacgggtacaagtgtctagtggtaactgagtgtattcacaaacgttgtgtaacccgtgaaacacagtcaacttgttagaagcatttcgttaccccgaaaaacgaaaccctgatacccctagaagcatgtcaacctctcagttttctcgccagagggcagcagccaaaattcttcggaggcgccttggggatggcacagcatgagtacaaccgagagttctcggtgctgataagcattatggacaagagaacgtgcggggcaggtccgcagttgtgatgacgggaaagaagggtaaccaaacgtacaacgcggggactaacaggggggaccgcggaccattgcaccaaagcacccggataaccccggatcaacaggcacggccgagcaatacaggaggcgataccgccaagcgcaactgccagaacacgagtgggcaagttcggccgcagggggaagaacaggggggcagaaagtgggaaggggggagacaagtgcagaaccgagggggtagggcccgtggacaaggggacggaccagcgacacgggaggccacggtcacaccgaaggggtacgtgacacgccgcggcgaagggcagacaaggggcgggcgggtccaacaatcgacaagcggacaaagagggccaacacacgatgaagcgaggcgtaaag

SEQ ID NO: 653603 - DNA, 388 bp, Homo sapiens
tcccccgccccgccaacatccgtcacctcacgcgatagcgcccggcaccttagcctcctctccaggaaagcggacgccttttccgacctgggacagccgcgtgatgcccggatccccaatcaaaggcgccttggaccttcaggatcaccccggtctttctcagaacttcatgagtcccaggtgctagactcatgtctcgcggatggcctttcccgtgcctggtctttcttgtcttaaatggagttggacctctaataggcccttctaagttctcaaggtagctacccaggttagtggtactactatcagtaggtggagcgtttagaagggtagttggggcgaggagtgaacttcgggaatgacttctaggtcaggtcttcgctgattc

SEQ ID NO: 653604 - DNA, 256 bp, Homo sapiens
agtggttggtgtttactggaatcttgttttttttttttcggtttttttgactactcggggggttttccttttttacaggaactaaatcaacaaactttttcgattcctcaactttagatttttattttttttgattaccatttacttttcttcatttaaaacttttaacgcctcagcctttttcttaggccaaggccttccaccaaggatttactccgggacggatctaactggattttccgaggtgggtttaaga

SEQ ID NO: 653605 - DNA, 287 bp, Homo sapiens
tgttatctatcttgatcttgtcattgctgtcttccattttccatgatagtcttgagtatattaagtcatagttattttgagattccttgtgagatagttacaacatctgtgtcttatctgtcttctgatgatagctttatctcttccaagtgtgttcttttcttgcctttttgtatgtctcataattttttattgaaaactgcgcatcatgcataggacatagatactgtcttggagatcagcctgcctttcattctgctaggccatgtgggattttgtgttcccct

SEQ ID NO: 653606 - DNA, 196 bp, Homo sapiens
  misc_feature (56)..(56): n is a, c, g, or t
  misc_feature (95)..(95): n is a, c, g, or t
tcgaattcaagctttctaacgcatgtacgggggacatgctagttggtagatattcnctggagtccagctttaaggcttgtcaaagtaagccaatngtttctcttttgggcccctatacaaaggcacagaaggaaagaatcaagattcatacaatattaatggtgaaaacactgtagtaataaattttcatatgcca

SEQ ID NO: 653607 - DNA, 421 bp, Homo sapiens
  misc_feature (14)..(14): n is a, c, g, or t
  misc_feature (28)..(28): n is a, c, g, or t
  misc_feature (47)..(47): n is a, c, g, or t
  misc_feature (89)..(89): n is a, c, g, or t
  misc_feature (148)..(148): n is a, c, g, or t
  misc_feature (257)..(257): n is a, c, g, or t
  misc_feature (274)..(274): n is a, c, g, or t
  misc_feature (280)..(280): n is a, c, g, or t
  misc_feature (292)..(292): n is a, c, g, or t
  misc_feature (304)..(304): n is a, c, g, or t
  misc_feature (327)..(327): n is a, c, g, or t
  misc_feature (335)..(335): n is a, c, g, or t
  misc_feature (367)..(367): n is a, c, g, or t
tattggcccaggcnggtctcgaactccntgaccctgtgatccacccncctcagcctccccaaagtgctgggattaacaggcatcagccnatcacgcccggctgggatttttaaattgggtgaattaacatactcattcaacgttggcnagttttggccagatgccatacgcacgcctgtaatctcgacatttgggaaagccaagaagggaggatcacttgaggccaagagttcgagactagcctgggcaacataacnagaccccaactctatgnaaaacnaaaataaataanattagtcaggcntagaggcctatacctgtagtacnacctatgnaggtagatcatttgagcccaagaattcgaggntgcagtgagttatgatcatgccattgcatgctagcctgggtgacagagtgagac

SEQ ID NO: 653608 - DNA, 171 bp, Homo sapiens
gctgtctgcctctccaggcttgtcggacatccttctggctgggcctgtgcggaaacttgaggctgaaatcagtgagctgcatgcacttgaccggcatggcctgtcatccatcacttgagtgcacggtccactcgaccacaagccctgattctgctcaactactcactgtac

SEQ ID NO: 653609 - DNA, 795 bp, Homo sapiens
ctaggcagtgaatgccccttcatgaaaaaggaggaagcgctcccccaatgagcgggctctgtgccccgtgggacctggctcctcctgggccgtctcggcctgaacgtgtgtggctggacaagtcacttttcagaccagtgcatgagagctcctacctgccagagagctggcagatgtggcttgccagcgcatggctggcctccgtgccgttggccccgttgtgggtctcgtgcaccctagtggaagccaggtggtctgccaccactgtgacctgggggatctggggtcaacaagtcctccttcgatcaggctgacgcggtgccttcgtggagttggtcctcagggccgctgtttgcatcggtacctccgatggtgcaagctccgcgaggcatgtggtgactcccaacatcaggccagcaagtgtggcctgtcccctgagctgtggccaggcagtcgcaagcccacctggtcggatggcgctagcccccgctgggcagtgctgcaggcactggtggttcgggaggtgtggctggagaagtccccggtatgatgctatgccgacgagtgggcttctacgaggccctgtttgacggccatcccccagtgaagtgtcgcctgcaagagcgagccgggctggcctgagggttcccggcggggcggaagaccggcggggcgcaacatcttagggaacaaggcggggcggctgggacggccgatggggaggccctttgcttgccctatgtacttctgcgaagagtcaaggcccctgtacagagctgctaaaaagccagtgcg
